United States Patent 10,167,482 (GENES AND USES FOR PLANT ENHANCEMENT) - sequence listing, part 10

SEQ ID NO: 39608 - protein, 555 aa, Dechloromonas aromatica RCB
MLKNPDILVVGKHSFNDAALSQIAKSKGDEAAWQQAFQRFGVKAAEHVSGDFAVALNEPNGQVFLAIDRFAIRSLCYRQIGNRLLFAERADELADASTEIDPQAIFDYFYFHAIPSPRTIFKGVYRVPPGHYVLFENAQLTVAPYWIPTFEETRNQPFEKLRDEFRDILQQATTRQLDGGKAACFLSGGTDSSTVAGMIGLAHGAPAATYSIGFEAEGYDEMAFARIAARRFNTEHHEYYVTPDDLVSSIPMVASSYDQPFGNSSALPAYYCAKMAKEGGVSKILAGDGGDELFGGNSRYAKQRIFNSYRHLPSFLQKGLLEPLFSLPGMDQIPLLKKGSSYIEQASIPMPDRLQLYNLITRLGVDQVLTPGFLQAINLNAPLGLQREVWSSAVTDSLTNRELAFDWRFTLAESDLPKVCGTTRLAGINVGFPMLDDELLAFSLRLPVEYKLKGLKLRWFFKEALRGFLPDEIIVKKKQGFGLPFGVWLNRHDALRKLARNSVMGLVDRGVLRGEFVDQLFNKHLQEHPGYYGEMIWISMMLEQWLVHHRANYSI

SEQ ID NO: 39609 - protein, 197 aa, Medicago sativa
  misc_feature (78)..(78): Xaa can be any naturally occurring amino acid
  misc_feature (110)..(110): Xaa can be any naturally occurring amino acid
  unsure (1)..(197): unsure at all Xaa locations
MSASRFIKCVTVGDGAVGKTCLLISYTSNTFPTDYVPTVFDNFSANVVVNGSIVNLGLWDTAGQEDYNRLRPLSYRGXDVFILAFSLISKASYENVSKKWIPELKHYAPXVPIILVGTKLDLRDDKQFCIDHPGAVPITTAQGEELRKLINAPAYIECSSKSQENVKAVFDAAIRVVLQPPKQKKKKNKAQKACSIL

SEQ ID NO: 39610 - protein, 445 aa, Acidobacteria bacterium Ellin345
MSKAQQLVRSVGLFDATMLVMGGIVGSGIFINPYVVAQQVHTAPLILGAWLAGGVIATLGAFIYAELAGRQPSVGGQYAYLRDAIHPLAGFLYGWVLLLVIQTGGMAAVTVTFARYFLVLTHWAVPERVVAVVTLSLLTLINCLGVKFGSRVQSALMILKIGAIAFLVVAGFLYIREPFAVGGTVLDRPLSPGLLSSFGAAMVPVLFAFGGWQTANFVAGEVRDPRKNLARALLLGVAGVIVLYLAVNFVCVRALGPVGLAATRVPATDVMRLAMAQRGATIVTLGITVSTLGFLSQSILTAPRVYFAMAEDGVFFRAVAKVNEKTHVPILAIVLQSVWTIVVALTGRYEQILNYVVSMDFVFFGLTACTLFVFRKRSSLENGASGGFQVPGHPWTTLVFIAASWLVVTNTIYKYPANSLLGFAILLVGMPVYWLWRRKGKVLSQ

SEQ ID NO: 39611 - protein, 333 aa, Bacteroides fragilis YCH46
MIKVGINGFGRIGRMVFRAAVKNFGNDIQIVGINDLLDAEYLAYMLKYDSVHGRFEGEVAVEDGALIVNGNKIRLTAEMDPANLKWNEVDADVVVESTGFFLTDETARKHIQAGAKKVIMSAPSKDSTPMFVYGVNHTSYAGQDIISNASCTTNCLAPIAKVLNDKFGIVKGLMTTVHAATATQKTVDGPSKKDWRGGRGILENIIPSSTGAAKAVGKVLPVLNGKLTGMAFRVPTSDVSVVDLTVVLEKAATMAEINAAMKEASEGELKGILGYTEDAVVSTDFRGCANTSIYDSKAGISLDSNFAKVVSWYDNEWGYSNKVCEMARVIAAK

SEQ ID NO: 39612 - protein, 308 aa, Phaeodactylum tricornutum
MKFTAACSLALVASASAFAPIPSVSRTTDLSMSLQKDLANVGKVAAAGALAFGLATAPANALTKSQINELSYLQVKGTGLANRCPEVVGEDSITPKGGQRLVDMCIEPKAWAVEEEIGKAGRTEKKFVNSKVMTRQTYTLDGIEGALKSEGGSIVFQEQEGIDYAATTVQLPGGERVPFLFTVKDLVAKGNGGSFKPGFQMGGDFNTPSYRTGLFLDPKGRGGTTGYDMAVALPGLQSGEEGDDDLFKENNKTFDITTGRIEMEVNKVNAEEQEIGGVFVATQLSDTDMGSKVPKKVLTKGIFYARVE

SEQ ID NO: 39613 - protein, 331 aa, Erythrobacter sp. NAP1
MAGSTDIVTVDVGGTHARFAIATIHTDGAIALGEPVTIHTETHASFQTAWEDFASQMGGTIPDQLAMAVAGPIKPDIIRFTNNPWIIRPPLIESKLGCTNHVIVNDFEAVAHAAARAPDEEFLHLAGPDEPFPEPGTISVLGPGTGLGVAYFYRRPDGSYRVQATEGGHGDFAPLDSIEDAILARLRKRHTRVSDERVVSGPAIVDIFHALAAIEGRAVRELSDVEIWTAGTDGSDSLAAAAVDRFCLALGSVAGDIALVQGAKGVVIAGGLGYRIRETIRASGFASRFTAKGRFAGLMATLPVKLITHPQPGLLGAAAAFAQTHLEEPQP

SEQ ID NO: 39614 - protein, 398 aa, Pyrobaculum aerophilum str. IM2
MFLMEVKLHEFEKVYGDANKAAEARRQYLEKVTGVKLENIGRTIIDLNTVVGRNIENVIGAVQIPVGVAGPLLVRGDYANGYFYVPLATTEGALVASVNRGAKFVTESGGARVKVLKDGMARAPLFRVPSLIDAVELVEWVTGHFEELKKVAESTTRFGKLKDIQHFIVGNYVWLRLVFSTGDAMGMNMVTIASEAVAKFIQENFPKAKLIALSGNMCVDKKANAVNFILGRGKTVVAEAVIKKEILERLGITPEDVHNVNVRKNLIGSALAHSYGFNAHFANIIAAIFIATGQDVAQVVESSMGITSTEAREDGLYISVFLPSLEVGTVGGGTGLPTQREALELLGVAGSGNPPGVNALKFAEIIAAAVLAGELNLLIALARNELASAHKKLGRGAR

SEQ ID NO: 39615 - protein, 385 aa, Phaeodactylum tricornutum
MKVATTLTLAFICCASAFGLNGQTTSVMKKVGFGAGSKPMVQAIDVQGNRLGSNMQPLKSAVANEDAPRGGATKSPVDIGLLLYFGLWYLGNYYYNITNKLALNAAGGKVGFPMTISSLQLGVGSIYALFLWLAPDARSRPKISMDDIVKMLPVALCFMGAHSASVFAMGMGAVQFAQIVKASEPAFAAVLSQFVYGKKSRRHKWLCLPIVIGGVILASVKELDFAWSALIAACIANMFAAVRGNENKKLMETPGLKDRIGTVGNQFAITTVLGFILSLPVLFLREGSRFGEFVQLAKTTPAIWMNLVASGLWFYGYNECATMTLKKTGAVTQSVANTAKRVIVIVGVALVLGESLSPIKLIGCSIGIGGVFLYSIIDNLVKPKK

SEQ ID NO: 39616 - protein, 440 aa, Gibberella zeae PH-1
MFYQGTLQEGISTAVSQQKLVLCFVADDSDESSQWETEFLADDTLRDLFEGHVLLRLEAGSASAGYLAQIFPLPRTPTVVIIKNGELKEYIAPGTGKDEFLRRVKEAFNSSATPQPAPAQPAQVAPPQPVTPTAPEQTQTTVSSSTSENVRRILSERATRLQAQREENERKVKEERARTKERAKAEAEAGMNTDNARAHKAAEAVKKKRQQDQEERARILKRIEDDKAERRIRAEEREKQRRGSMKGGDVAASLVNAPETKLADSTKTGGMTALQVRLFDGSTLRSRFKTNAPLKEIRQWVDENRSDGAQPYTFKQVLTPLPNKNIDETEEDKAIGELGLSPSSTLVLIPVKKYTSAYDDDSQGIVSRIIGFILSIFSWILSIFSSDERAHRGSVGPTSSRERSQIREFQNPSDQRDQQLYNGNSAKLNFEPRPEEEKDS

SEQ ID NO: 39617 - protein, 827 aa, Arabidopsis thaliana
MEANKKAKPSYGDVISNLPNDLLCRILSYLSTKEAALTSILSKRWSNLLLSIPILDFDDSVLLKPQKGQRKNVFFKAFVDRLLSQRVETSSHVQRVSLKCRQGGVEPDCVIKWILTTVRDLGVLDLSLCIDFGIFHLPFNVFRSKTLVKLRIGTMIRLSQFPSDVVSPTLNSLVLDLVEFRDGDKVEFRQILLAFPSLQSLRVHESNKWKFWNGSASSRTLKSLVYRSDDDSSAPKPCVSFDTPSLVYLDYSDMVADKYENLKFDSLVEARLDLHLTAFQIMRKPNNIGIVSGDVTTLFKGIRNVKILCLSPDALEALYYRGEKIPMFNNLITLSLGSDKPHGSPFIFWKLLPSLLNNSLKLETLIIKGLVHYVAEGWEGLSPMTPMSRLCFSWDTVSDSLSSSAMKVLEISGYKGTWQELNQMKRFLGNLSRLEVIGSELMSSKPEFVICQFEPPARLMATPLVVQIIVAYVARTQTSALRMVDSKRMDSGSKDMINDLPDALLCHVLSYLTTKEAASTSLLSRRWRYLLAFVPNLEFDDSAYLHRDKRVKNPLHEKGLVGFVLTVDDKRKKLSTSFPDFVDRILDLQGNSPLDKFSLKMVDDHDPVDPDCVAPWIHKVLVRGVSDLHLVIDMNEWTSLPAKIFLTETLVKLTLKIRDGPPIDVKHVHLPKLKTLHLESVMFDEEDIGFSKLLSGCPELEELVLHHIWSCVWTSCSVSVATLKRLTFCCNNMKFCGMHEENPNNVSFDTPNLVYLEYAEVIANNYPKVNFDSLVEAKIDIWMTNDQLDEVRIRDIYEKNVMVGNATDLIVGIRNVRVLCLSADTLE

SEQ ID NO: 39618 - protein, 202 aa, Shewanella sp. MR-7
MYTEFDGIIFDMDGTLVDSGQLHEQAWRQTLNHFGIPVEPALMRSLAGVPTIGTLEILIAHFGVTPTASYEAMNEYKEALVRDTMHLYVKPTALAEFAKQNQGKRPMAVGTGAYTEEAIQILTLCGLLELVDYVVGADQVASPKPAPDTFLRCAELMGIAPERCIVFEDAKAGIQAAEAAGMFVVDVHAELQIENDYFLGTR

SEQ ID NO: 39619 - protein, 218 aa, Triticum aestivum
  misc_feature (3)..(3): Xaa can be any naturally occurring amino acid
  misc_feature (5)..(5): Xaa can be any naturally occurring amino acid
  unsure (1)..(218): unsure at all Xaa locations
PVXSXYRANLAGAGQRVGIQIRVFRKKQTPLQHVLDQVLSCVRREKLLPEITSSSNINASDQAVLVTSLSSWYYERIREEYGGGRVAGGVHQPSHEGRQKRGDTSHDRRALSEMYLLSTCDVLVTTGFSTFGYVAQGLGGIRPWIMPSTPMWSESDTADTKVVPEPPCVRAMSVEPCFHSPSYYDCTARRDVDVGKVVPYVRHCEDVSWGIKIANQSS

SEQ ID NO: 39620 - protein, 509 aa, Zea mays
  misc_feature (204)..(204): Xaa can be any naturally occurring amino acid
  unsure (1)..(509): unsure at all Xaa locations
MMIARRLLRPNAPAQATSLLKHVTGTASLQGNADSLLDGTVRHFGSAPSAQPEENGFKGHGMLAPFTAGWQSNDLHPLIIERSEGSYVYDINGNKYLDSLAGLWCTALGGSEPRLLKAATEQLNKLPFYHSFWNRTTKPSLDLAQEILSMFTAREMGKVFFTNSGSEANDSQVKLVWYYNNALGRPNKKKFIARSKAYHGSTLXSASLTGLPALHQKFDLSAPFVLHTDCPHYWRYHLPGETEEDFATRLATNLENLILKEGPETIAAFIAEPVMGAGGVIPPPKTYFDKVQAIVKKYDILFIADEVITAFGRLGTMFGCDYYNIKPDLVSLAKALFNAYVPIGATLVSPEISDVIHSQSNKLGSFAHGFTYSGHPVACAVAIEALKLYRGRDIPGHVKQIAPKFQDGIRALADSPIIGEIRGLGMIMGTEFTNNKSPTDLFPAEWGVGAIFGEECQKRGMLVRVAGDAIMMSPTLIMTPGEVDELVRIYGEALKATEERVAALQSKKN

SEQ ID NO: 39621 - protein, 442 aa, Alteromonadales bacterium TW-7
MTKISLPTCSPLLTKEFIYGVATASFQIEGGSTHRLPCIWDTFCDTPGKIADNSNGHVACDHYNNWKKDIDLIESLGVDAYRLSISWPRVITKSGELNPEGVKFYTDILDELKKRNIKAFVTLYHWDLPQHLEDEGGWLNRETAYAFAHYVDLITLAFGDRVHSYATLNEPFCSAFLGYEIGIHAPGKVGKQYGRKAAHHLLLAHGLAMTVLKQNSPTTLNGIVLNFTPCYSISEDADDIAATAFADDYLNQWYMKPIMDGTYPAIIEQLPSTHLPDIHDDDMAIISQSIDYLGINFYTRQFYKAHPTEIYEPIEPTGPLTDMGWEIYPKSFTELLVTLNNTYNLPPIFITENGAAMPDSYNNGEINDVDRLDYYNSHLNAVHNATEQGVRIDGYFAWSLMDNFEWAEGYLKRFGIVYVDYSTQQRTIKNSGLAYKALISNR

SEQ ID NO: 39622 - protein, 272 aa, Brassica napus
MVRCSNNLVGILNFIVFLLSIPILAGGIWLSQNGSTECEGFLDKPVIALGGFLMVVAIVGLIGSCCRVTWLLWTYLFVMFLLILLVFSITVFAFVVTNKGAGEKVSGRGYKEYRLGDYSNWLQKRVNSDKNWNKIRSCLVDSKVCSKLDDKLVGVPVNNFYHEHLTALQSGCCKPAEKCQFAYVSATNWTKTAGTHPDPDCQTWDNAPNKLCFDCQSCKAGLLDNVKSAWKKVAVVNIIFLVFLIIVYSVGCCALRNNKRDDSYGRTYGYKP

SEQ ID NO: 39623 - protein, 596 aa, Coprinopsis cinerea okayama7#130
MNECDETLDLGVLTDTVLENPGLTFAYSGHLHNATVARFSPSGFYCASGDASGTVRVWDVVGEDKALKGEYRVLAGRINDLAWDGESKRIIAVGDGRDKFGHAFMMDTGSSSGEIIGHSKAVNAVSIRPQRPFKAITASDDAQINFHAGVPFKYERTIKTHTKFVQDVKFSPSGDHFLSVGSDAKIFIYEGKTGDTVAEFTDSPHTGTIFAGNWSPDGKSIVTSSGDRTVKLWDVETRKVVSSWALGTAIEAQQVGNTWNDDINIVSLSMSGALNQFDPRVGDKPVHVYTAPQMPITSLLSTKSDTFLAGTADGRVYSYSTSKQESTPVGGPGHSSYVVDLAASPSSSSGTTTAYSVGFDDHVREIDSVGESYVQAAVKTTAQPKSISISSNDTIFVAQPELIEVFRSNQKLYSLAPKAFKPTAIAARPSGNGNENESVSLVAVGAEDNKVYLFEWDGKELKPKESGGVFDNNKGPISVLAFSPDGKVLAAGDTKGKIMPYSIEEKKPITPTWVFHTARINTLSWTSNSQFLASGSLDTNVYIWSLAKPSKKVVIKEANPGGVNGVQWVNGGEGGKLVSAGADGCARVWDVVFPEA

SEQ ID NO: 39624 - protein, 412 aa, Dechloromonas aromatica RCB
MEAKVPPTHSPMTQFATVDGELQVGGLPLSRLAERVGQTPFYAYDRELLRTRVRELKAVLPAGIKLHYAMKANPMPALVAFMASLVDGIDVASGGEMKVALDAGGVPQEISFAGPGKRDAELRQAVAAGVLINVESFRELDLLARISTELGLPARVAVRVNPDFELKGSGMKMGGGPKQFGVDAEQVPLLLARIGELKLSFEGFHLFAGSQNLKPESICEAQQKSYELALALSRHAPSPVRFLNLGGGFGIPYFPGERPLDLSSIGDNLAQLASRAAQDFPLASLVIELGRYLVGEAGIYVSRIIDRKISRGQTYLVTDGGLNHHLSASGNFGQVIRKNYPVSIGNRMNAEDIEIATVVGPLCTPLDILGDRMALSVAMPGDLVVVFQSGAYGASASPQSFLGHPEVTEVLV

SEQ ID NO: 39625 - protein, 126 aa, Roseovarius nubinhibens ISM
MPYDYDDQNIFAKILRGEIPNDTVLETEHSLAFNDIAPQAPVHVLVIPKGPYVCYDHFASTASDAEIVDFNRSVADVCRMTGVAPGAAGAGYRAITNCGEDGVQEVPHFHLHILGGRMLGRMLAKD

SEQ ID NO: 39626 - protein, 332 aa, Alteromonadales bacterium TW-7
MAAFGTVFMPQMIQARFSDNQWGETSVVPCDKLEFHAGAHVLHYSSTCFEGLKAFRHEDGSVYIFRMDANIARMQQSSALLSLPSFDGDMLKTMIIDIVRQYADETPLPPGSMYIRPTHIGTEAAIGKAAAPSMSSLLYTLLSPVGDYFAGGATALRVLLEEDGMRCAPHMGMVKSGGNYASALGPISAARKQYQADQILFCPGGDVQETGAANFILIDGNEIITKALDSTFLHGVTRNSILTIAKDLGMTVSERNFTVTELLERAAKPGTEAALSGTAAVLTAVGTFIHNDKEYKVGTGEPGPTTARLRQALNDIQWGKSEDKHGWLTKVV

SEQ ID NO: 39627 - protein, 134 aa, Mycobacterium sp. JLS
MTIRSFTFTLDDGVPPAVAPFAHATAAGQTLYVTGQMPTDHTGEIVGTGIEAQTDQVLRNLLRVTRLCGGGLDDVVAVRAYLTDWAEYAAFNTAYAAWFPDRLPSRTCVGVTGLAVGARVEIDWTCWRADGWGR

SEQ ID NO: 39628 - protein, 461 aa, Treponema pallidum subsp. pallidum str. Nichols
MAHLPKEYDFSIESLGESKIPSPIYLSHTLGDFIPNYVSDNEYISHELSARLGETVGPFTHKNLMERAGPRQKIFFNPHHVHAGIVTCGGLCPGLNDVIRAIVRCLWGRYGVKRISGIRFGYKGLLPDYNFDILPLTPEVIDNCHKTGGSLLGTSRGGGNRVVDIVDGIERLNLHILFIIGGDGSQKGAKEIADEIKHRNLKISIIGIPKTVDNDISFVQKSFGFDTAIVKATEAVAAAHMEARSQINGIGLVKLMGRESGFIATYTAIASHETNFVLIPEVSFDLDGPNGLLAHLEKRIALRKHAVLVVAEGAGQDLMVNADGVPSGDSQGGSLRVSSGTDASGNKRLADIGLFLKEKIGVYFKEKRIHINLKYIDPSYLIRSAVAAPIDSIYCERLGNNAVHAAMCGKTKMIIGLVHNKFVHLPIDVVVCQRKHVNPEGSLWRDALDATGQPIVMKNII

SEQ ID NO: 39629 - protein, 507 aa, Bacteroides fragilis YCH46
MQEKIIILDFGSQTTQLIGRRVRELDTYCEIVPYNKFPKGDETVKGVILSGSPFSVYDESAFKVDLSEIRGKYPILGICYGAQFMAYTNGGKVEPAGTREYGRAHLTSFCKDNVLFKGVREGTQVWMSHGDTITAIPENFKTIASTDKVAIAAYQVEGEQVWGVQFHPEVFHSEDGTQMLRNFVVDVCGCKQDWSPASFIESTVAELKAQLGDDKVVLGLSGGVDSSVAAVLLNRAIGKNLTCIFVDHGMLRKNEFKNVMHDYECLGLNVIGVDASEKFFSELEGVTEPERKRKIIGKGFIDVFDEEAHKLKDVKWLAQGTIYPDCIESLSITGTVIKSHHNVGGLPEKMNLKLCEPLRLLFKDEVRRVGRELGMPEHLITRHPFPGPGLAVRILGDITPEKVRILQDADDIFIQGLRDWGLYDQVWQAGVILLPVQSVGVMGDERTYERAVALRAVTSTDAMTADWAHLPYEFLGKVSNDIINKVKGVNRVTYDISSKPPATIEWE

SEQ ID NO: 39630 - protein, 377 aa, Aspergillus nidulans FGSC A4
MPEIFDDKSQHCIPFLLQRLKAHQARHSNDPANTPPFFLGLNGVQGAGKTVLVSTLNSILRSPPYSLAVVTLSLDDLYLTHEDQVSLAKSNPTNPLLQHRGQPGTHDLPLAQSVFSALRAGRPTAIPQYDKSAFSGQGDRVPMEQWETVNVEGQEQIKVLIFEGWSVGFRAWDDDILKQKWEDAVKRKEQDKEYRGRLGHVKFEDVRKVNEALRGYDVLTDDAQDNHFVYEWRQEQERTLRATKGIGMTEEQVNRFVDGSRLSAQEHSDRFRIRLRHLRRRRAGRGDNFDWLSIKIILTTMDETYFIHRRSPKNMHEEIVPSQPDSLRSMQLREEPQIWKRRMQCRRTRLPQMTAFNDIGVNVDKKDYNLPLIMERG

SEQ ID NO: 39631 - protein, 356 aa, Prochlorococcus marinus str. MIT 9313
MSSTHLPGGNQALLGCSATELEGWAVAEGQPAFRGRQLHEWLYAKGARSFEAITVLPKSWRLSLQQRGITIGRLLEVNRAVAVDDTTKLLLATVDGETIESVGIPTQQRLTVCLSSQVGCPMACRFCASGKGGLQRSLATHEIVDQVLSLREAMDRRPSHVVFMGMGEPLLNIEAVLAAIRCLNIDLGIAQRRITVSTVGVPHTLPHLAELAMKRLGRAQFTLAVSLHAPNQELRERLIPTACAYPFETLLQDCRHYLAVTGRRVTFEYILLGALNDQPQHAEELADRVRGFQSHVNLIAYNPIDDEGFQRPNPETIEAFRRVLEQRGVAVSLRASRGLDQNAACGQLRRQHAATG

SEQ ID NO: 39632 - protein, 273 aa, Pseudoalteromonas tunicata D2
MDKYAVFGNPIKHSKSPAIHSKFAELLGEQLHYQAILAPLEHFEATVNAFFDGGGLGANVTMPFKEQAFAMCQQLSERAQVSGAVNTLKRLESGGLYGDNTDGAGLVSDLLNNDVTLKNQRILLMGAGGAARGVLLPLLNEQPRKITIVNRTKEKAQILAELFSQYGEIDYCSFDELPDSSFDVVINSTSSSIAGVLPSLTEVHIADAKAIYDMVYSDSSTVFLNWAKQHNTTAILLDGIGMLIGQAAEAYYVWRNVYPPSERVIELAKQKAV

SEQ ID NO: 39633 - protein, 425 aa, Thiobacillus denitrificans ATCC 25259
MSRNEALFEASQKVIPGGVNSPVRAFRSVGGTPVFFSRARGSRVWDADGREYIDYVGSWGPAILGHAHPGTVKAVQDAAANGLSFGAPSEAELTIATRITELLPSVEKVRLVSSGTEATMSAIRLARGFTGRSKFIKFEGCYHGHADFLLVKAGSGALTFGNPTSAGVPPEVAAQTIVLDYNDVAGLERTFAEIGDEIACIIVEPFAGNMNLVKPSAEFMAAMRRLCDEHGALLIFDEVMTGFRVDLGCAQKLLGIRPDLTTLGKVIGGGMPVGAFGGRADVMDALAPVGPVYQAGTLSGNPVAVAAGLATLASVSEPGFYPALAARTEKLVKGLTAAAREAGVTFCADSVGGMFGLYFAAEPPASFAEVMRCDKEKFNRFFHAMLDHGVYLAPSAFEAGFVSAAHSDADIDATVAAAREVFRTL

SEQ ID NO: 39634 - protein, 339 aa, Brassica napus
MADNKKIKIGINGFGRIGRLVARVILQRNDVELVAVNDPFITTEYMTYMFKYDSVHGQWKHNELKIKDEKTLLFGEKPVTVFGIRNPEEIPWGEAGADFVVESTGVFTDKDKAAAHLKGGAKKVVISAPSKDAPMFVVGVNEHEYKSDLNIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDNRSSIFDAKAGIALSDNFVKLVSWYDNEWGYSTRVVDLIIHMSKA

SEQ ID NO: 39635 - protein, 129 aa, Zea mays
MAQGTLEVLLVGARGLENTDYLSNMDPYALLQCRSHEQKSSVASGKGCEPEWNETFVFTVSDGAAELFIKLLDSDGGTDDDFVGEATIPLEAVYTEGNIPPTVYNVVKDEEYRGEIKVGLTFTPEDQGF

SEQ ID NO: 39636 - protein, 297 aa, Escherichia coli
MATNLRGVMAALLTPFDQQQALDKASLRRLVQFNIQQGIDGLYVGGSTGEAFVQSLSEREQVLEIVAEEAKGKIKLIAHVGCVSTAESQQLAASAKRYGFDAVSAVTPFYYPFSFEEHCDHYRAIIDSADGLPMVVYNIPARSGVKLTLDQINTLVTLPGVGALKQTSGDLYQMEQIRREHPDLVLYNGYDEIFASGLLAGADGGIGSTYNIMGWRYQGIVKALKEGDIQTAQKLQTECNKVIDLLIKTGVFRGLKTVLHYMDVVSVPLCRKPFGPVDEKYLPELKALAQQLMQERG

SEQ ID NO: 39637 - protein, 238 aa, Prochlorococcus marinus str. MIT 9313
MADLQTQMKQAVAAAAVEQIKDGMVLGLGSGSTAALMIQALGAKLASGELRDIVGVTTSFQGEVMAAELGIPLRNLTAVDRIDLAIDGADEVDPSFQLIKGGGACHVQEKLVASRADRFVVVVDSTKIVDRLNLGFLLPVEVLPGAWRQVQGRLAELGGIADLRMAQCKAGPVVTDQGNLVLDVSMAGGIGDPEDLECRINNLPGVLENGLFVNLTDEVLVGQISDGVAGVRRLQRRE

SEQ ID NO: 39638 - protein, 843 aa, Oryza sativa (indica cultivar-group)
MAGASHHLVVFLAALLALLPGSSQLQYSQTWTLFKIQQMLNHPPVLSHWRRTTDFCGGGGTAAPSAAVVCYGDTVTQLHIAGVRGAPPLPMNFSIGALVMALSRLPDLKVLTLSGLGLWGPLPDKIGRLAALEIVNMSGNYLYGGVPGGLSQLTGLQTLILDDNLLAGELPAWIGELPQLAVLSLRNNSLGGAVPASVGRMESLRSLVLASNNLTGNLPDMSGLTNLQVIDVGDNWLGPAFPALGRKVVTVVLSRNRFTGGLPGEITSFYLLERLDVSWNRFVGPFMPALLSLPAIRYLNVAGNRFTGVLSDKVACGDNLQFVDLSSNLLTGSEPACLRPDKKPATVVLVNANCLEATGGDASQHPSPFCQNQALAVGITHGGKVRKKLTHHAGFLAGIAMAALAAASAIAVVAVVAVRRKNKKGVMVRPPAMLGEDNSSSTSGYPSKMFADARYISQTVKLGALGIPPYRTFSLVELEAATDNFENSLLLGQDSFGEMYRGRLGNGTLVAIRSLKVKRNQSSLSFSRHIETISRLRHRNLVSALGHCFEYDLDDSTVTQLYLVFEYVQNGNLRCRISQGTEGRKLTWAQRISAAIGIANGIQFLHAGMMPGLFGNNLKINNILLDQNHVAKISSYNIPILGEAMKSEKCYDVCQSKKGGPGGKHHTESPLLNDKTDIFDFGVILLEIVSGKTITSLYEVEIMKELMLWAVADEDLVRRRSFADQEVSKGCSDESLRTIMQICLRCLAKEAVQRPSIEDVLWNLQFAAQVQDDWEGDNRSSDGSMVSSSSRITKSSRFQNEQTRSGREKECEDSSARGSVWLQAATEDGNFETGRRQAEDERY

SEQ ID NO: 39639 - protein, 89 aa, Brassica napus
IFEVNDIMSSKGWHLNALQRPNSIHICVTLQHVPVVDDFLQDLREAVETVKANPGPITGGLAPIYGAAGKMPDRGMVNELLVSFMDSQY

SEQ ID NO: 39640 - protein, 1465 aa, Adiantum capillus-veneris
MATPGGPKTKHSVSVAQTRADARLHAAFEGSGDAGAGGSRAPFDYSKSGMDASSVTSVAPEAITAYLQRMQRGGLTQAFGCMLVVAGQKIVAFSENAPEMLEVAAGLGTDLRMLFTQGSTAALDQAVKEEDLSSVNPLVLQSCGGSAKQFYAMLHRIEDVAGVVIDLEPIENGVVEKKSSAEMAVKPIARVQSLPGGEIGRLCQVVVEEVQEMTGYDRVMAYKFHEDGHGEVVAEVRRPDLEPYLGLHYPSTDVPQASRMMFMKNGVRMIGDCTLPPVRVVQAKELAQPISLAGSTLRAPHGCHAQYMSNMGSAASLTMAVAIDDYDDDSSLSCGSRKLWGLVVCHHPSPRTVSYPLRCACEKLMVAFGVQLNIELDLAAQLRENHILTTQALLCDMLRRIRGAPIGIVSRSPSIMDLVKCDGAALYYGGRFWPLGTTPSEFQIRDLAEWLLGASEEIASTGVTCTDSLAEMGYPGAALLGDAVCGMAAAMITPNSDFLFWFRSHTAKEVYWGGAEHDPQSRDDDSWMQLPRSSFKAFLEIVKRRSLPWEEVEVDAIRSLQLILREDLEQFCAAVGAVKASDGDDEDSLVPSAKKLSLKETEENGGADNSKKLERMHSAAAGGGGGGGRWEKMRLPSSLAQEWMEAIRGTGDGGASGGGGGGPFDWDLISAFQHNSFIVVDALKPDFPIIYASTGFFNLTGYTSREVIGGNCRFLQGPDTNPADVASIREALAQGTGTFCGRLLNYRKDGSSFWNLLTIAPIKDDLGSIVKLIGVQLEVSKYTEGIRANNRRPNGMPQSLIRYDVRHQDKVSAFIAQLVAALTKPDKVETPRLSSAMRFSLTGQTIESLPQPTAIPREGGGRTRRPRSSSFLSLLGMEKEKDIPEEDELQELEVIMLEDASVGRPGSLDDPERTRRGIDLATTLERIGKSFVITDPRLPDNPIIFASDRFLELTEYTREEVLGNNCRFLQGRGTDRKAVQLIRDAVKEQRDVTVQVLNYTKGGRAFWNLFHLQVMRDENGDVQYFIGVQQEMVAPRPVHQPPELPDILPDRVEQEKAEVVRATAQRVDAAARELPDANLVPDHLFAPHSKVVTPLPHSKTNSSSWFAIRRVQRRLRRGERLGLKHFRPIKPLGSGDTGSVHLVELRGTGQVFALKAMDKSMMLQRNKVHRARAEREILAIMDHPFLPTLYASFQTKTHVCLITDYCPGGDLFLLQDKQPTQTLSERTASFYAAEVVVALEYLHCMGVIYRDLKPENVLLQKNGHILLTDFDLSFLTSCRPQLILQGGKGRSRRSKRRRRVTFCAEPRVSSNSFVGTEEYIAPEIISGEPHSSAVDWWALGILLYEMLYGRTPFVGRNRQKTFYNVLNKELIFPTSIPVSLAGRQLIAGLLQRDPTIRLGTLRGASELKKHPFFREINWPLIRWRKFSANQAHNANNVSSLDEGESDSGNAWEANGGSTQSFQDTF

SEQ ID NO: 39641 - protein, 367 aa, Roseovarius nubinhibens ISM
MSTPSLLILPGDGIGPEVMTEVRKVIDWFGAKRDLAFDVSEDLVGGAAYDKHGVPLHDDTMARAQEVDAVLLGAVGGPKYDELDFSVKPERGLLRLRKEMDLFANLRPAQCFDALADFSSLKKDVVAGLDIMIVRELTSGVYFGEPRGIFEEGNERVGINTQRYTESEIERAARAAFELAMRRNKKVCSMEKANVMESGILWREVATRVGKDYPEVELSHMYADNGAMQLVRAPKQFDVILTDNLFGDILSDCAAMLTGSLGMLPSASLGAPMANGRPKALYEPVHGSAPDIAGQGKANPIACILSFAMALRYSFDQGDEATRLENAIEAVLASGARTADLMGPEGGTPLSTAEMGDKVIEALDQSL

SEQ ID NO: 39642 - protein, 577 aa, Glycine max
RADALRKLDKIGQGTYSSVFRAKEVRPGKIVALKKVRFDNFEPESVRFMAREIMILRRLDHPNIIKLEGLITSRLSCSIYLVFEYMEHDITGLLARPEIKFSESQIKCYMKQLLSGLEHCHSRGVMHRDIKGSNLLVNNEGILKVADFGLANFSNSGNKQPLTSRVVTLWYRPPELLLGSTAYGPSVDLWSVGCVFAELLIGKPILQGRTEVEQLHKIFKLCGSPPEEYWKKTRLPHATLFKPQQPYDSSLRETFKDFHASTVNLLQTLLSVEPSKRGTASSALSLEYFKIKPYACEPSSLPIYPPSKEIDAKHEEESRRKKIGGRACKPESRKPSRKPLALSKLAPAEDLTSQTQTSHKMNDRSVHIIKQEDTNTCEEAPKQSSGKPEDASSYMKNASQVDIPFPGPLQVSKSSGFAWAKRRRDDTSVRSHSRSISRGFIFNSLETSTLNSRDNSESRNHENKEFFGARTNSRGNHLLEISKLAMQNQWSKFDRPDSFDTCDEYHSQELSLAIYNRQDSLSKRSNLSYQDQEEKVEFSGPLLSQMHTVDELLERHERHIRHTVRRSWFQRGKKQGK

SEQ ID NO: 39643 - protein, 530 aa, Oryza sativa (indica cultivar-group)
MCGILAVLGVADVSLAKRSRIIELSRRLRHRGPDWSGIHCYQDCYLAHQRLAIVDPTSGDQPLYNEDKSVVVTVNGEIYNHEELKANLKSHKFQTASDCEVIAHLYEEYGEEFVDMLDGMFAFVLLDTRDKSFIAARDAIGICPLYMGWGLDVCRIKILVLIYVPSKKFKVFVTGHEVGFFFDVISGSLFKAIIKRLMTDVPFGVLLSGGLDSSLVASVVSRHLAEAKVAAQWGNKLHTFCIGLKGSPDLRAAKEVADYLGTVHHELHFTVQEGIDALEEVIYHVETYDVTTIRASTPMFLMSRKIKSLGVKMVLSGEGSDEIFGGYLYFHKAPNKKEFHEETCRKIKALHLYDCLRANKSTSAWGVEARVPFLDKNFINVAMDIDPEWKMIKRDLGRIEKWVLRNAFDDEEKPYLPKHILYRQKEQFSDGVGYSWIDGLKDHANEHNAARLTVPGGPSVACSTAKAVEWDAAWSKNLDPSGRAALGVHDAAYEDTLQKSPASANPVLDNGFGPALGESMVKTVASATAV

SEQ ID NO: 39644 - protein, 868 aa, Coprinopsis cinerea okayama7#130
MKANYKFSNICGTVYRQGNIVFSADGNTLYSPVGNRVSVFDLVNNKSFTFPFENRKNITTIALSPDGNVLISVDEDGRALLVNARRGVVMHHFNFHKTVKDIKFSPDGKYIAVTHGPHVQVWCTPNHLVREFAPFNLHRTYTGHHDEVLSISWSPDSRCFITTSRDMTARLFTLNPLDGFRPKTFAGHRDAVQSAYFSANGDTIYTVSKDGAVFTWKAKDEDGSDSDEPMASTSTEIYGRIANTRWGIQKRNYFNQANTKVVCSTFHPASNLLVVGFTSGIFGIWELPEFTSIHTLSISQEKISSVAINASGEWLAFGARKLGQLLVWEWQSESYVLKQQGHFFDMNTLDYAPDGQTIATGGDDGKVKLWSSFSGFCFVTFTEHTAPVSTVSFAKQGSVLFTASLDGTVRAYDLIRYRNFRVFTSPRPVQFSCLAVDPSGEVVAAGSTDSFEVFLWSVQTGKLLDILTGHEGPISSLAFSPAGDNQLASGSWDKTVRIWSVFGRSRAVEPFNLSGDVLAVAFRPDGNELAVSTLDGQITFFDVRDGKQTNVIEGRKDVSGGRKADDRVSAANSSSGKSYNSLAYTADGRCLLAGGNSKYVVLYDVREGEGLMLKKFQISQNLSLDGTEEFLDSRKVNEVGINTDLIDDGDESDLEDRLDTTLPGARRGAGDMSVRKYRQEARTKCIRFSPTGRAWAAASTEGLLIYSLDEAVTFDPFDLSIDLTPQAVLEVLSQREYLKALVMAFRLNEKPLIQRVYESIPPADIRLLSRQLPLVYVPNLLRFVAEHLEKSPHLEFDLIWSKTLLMLHGRYLKERSGEYASVFRVLQKGLSDSEQSISRICDENTSLLSYLVDQTKIRQQKDVEMSSS

SEQ ID NO: 39645 - protein, 426 aa, Escherichia coli [sequence omitted]

SEQ ID NO: 39646 - protein, 362 aa, Bacillus cereus G9241
METTVRKQKKNLETKKPSIYSLQLHEMQDWLKEQGEPKFRAGQIFDWLYKKRVKNYEDMSNLSKGLRDKLSNSFDITTLNTLVKQTSSDGTIKFLFQLYDGYSIETVLMRHEYGNSICVTTQVGCRIGCTFCASTLGGLKRNLEAGEIVAQVVEVQRALDESEERVSSLVVMGIGEPFDNYDNLMGFLRIINHEKGLHIGARHMTVSTSGIIPKIYKFAEEDLQINFAISLHAPNSELRSKLMPINRAYKLPDLMEAIKYYVNRTGRRITFEYGLFGGENDQVEHAEELAALLKGVKCHVNLIPVNYVPERDYVRTPREQIFLFEKTLKDRGVNVTIRREQGHDIDAACGQLRAKERKEETR

SEQ ID NO: 39647 - protein, 426 aa, Escherichia coli [sequence omitted]

SEQ ID NO: 39648 - protein, 219 aa, Ageratina adenophora
MATLIQFNTPYTSLSADNIPTTESSSTSDYSTGTSFSDEEVMLASKNPKKRAGRKKFRETRHPIYRGVRRRDSGKWVCEVREPNKKTRVWLGTYPTADMAARAHDVAALAMRGRSACLNFADSLWRLPIPESSNVKDIQKAAVKAAEAFRPTETDVAVIEESNELTGNVFCVDDESIFEMQGFLADMAEGMMLPPPRTIEYDNCQDDLEFFVDASLWSF

SEQ ID NO: 39649 - protein, 500 aa, Kalidium foliatum
MAFPIPSRQLFIDGEWTEPIKKNRIPIINPATEEIIGDIPAATAEDVELAVAAARRALKRNKGEDWASASGAHRAKYLRAIAAKIMERKGQISKLEAMDSGKPLDETEWDIDDVAGCFEYYAEQAEALDAKQKAPISLPMDTFKCHVLRQPIGVVGLISPWNYPLLMATWKVAPALAASCATILKPSETASVTCLELADVCREVGLPPGVLNILTGLGPEAGAPLACHPDVDKVAFTGSTATGSKIMSSAAQMVKPVTLELGGKSPILVFEDVDLDKAAEWAAFGCFWTNGQICSATSRLLVHESIAADFLDRLLKWCKNIKVSDPFEDGCRLGPVISKAQYEKVLKFISTAKSEGATVLCGGSRPEHLKKGYFIEPTIISDVSTSMQIWKEEVFGPVLCVKTFRSDDEAVELANDSQYGLGSAVLSKNLERCEKVTKELQAGIVWVNCPQPCFCQAPWGGSKRSGFGRELGEWGLENYLNIKQVTEYISDEPWGWYKSP

SEQ ID NO: 39650 - protein, 413 aa, Botryotinia fuckeliana
MADLQGRKVFKVFNQDFIVDERYTVTKELGQGAYGIVCAATNSQTQEGVAIKKVTNVFSKKILAKRALREIKLLQHFRGHRNITCLYDMDIPRPDNFNETYLYEELMECDLAAIVRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPYMAKRPFPTLFPNANPDALDLLDHMLAFDPSSRIDVETALEHPYLHIWHDASDEPGCPTTFNFDFEVVEDVGEIRKLILEEVHRFRQHVRVQPGQQGQSNGPQVPIPQEQASWRAEDPRPQEAYGQGPNDLEQDLQGGLDAMRS

SEQ ID NO: 39651 - protein, 384 aa, Mycobacterium tuberculosis H37Rv
MRAVVIDGAGSVRVNTQPDPALPGPDGVVVAVTAAGICGSDLHFYEGEYPFTEPVALGHEAVGTIVEAGPQVRTVGVGDLVMVSSVAGCGVCPGCETHDPVMCFSGPMIFGAGVLGGAQADLLAVPAADFQVLKIPEGITTEQALLLTDNLATGWAAAQRADISFGSAVAVIGLGAVGLCALRSAFIHGAATVFAVDRVKGRLQRAATWGATPIPSPAAETILAATRGRGADSVIDAVGTDASMSDALNAVRPGGTVSVVGVHDLQPFPVPALTCLLRSITLRMTMAPVQRTWPELIPLLQSGRLDVDGIFTTTLPLDEAAKGYATARARSGEELRFCLRPDSRDVLGAHETVDLYVHVRRCQSVADLQLEGAADGVDGPSMLN

SEQ ID NO: 39652 - protein, 148 aa, Brassica rapa
MEQTFIMIKPDGVQRGLVGEIICRFEKKGFTLKGLKLITVDRPFAEKHYQDLSAKPFFSSLVDYIISGPVVAMIWEGKNVVLTGRKIIGATNPAASEPGTIRGDYAIDIGRNVIHGSDSVESANKEAALWFPDGPVNWQSSLHSWIYE

SEQ ID NO: 39653 - protein, 453 aa, Coccidioides immitis RS
MHSFRGLLHDSVSASSVSRQGHGDPLGFPGLPECSEPCEPFSSRPPPRKFITPLQFAIRIQQSRQYRAATANSNRLLESLDNKKPLPFSYASKVKLREKYLIVGFISSGTYGRVYKAKGRDGVGGDFAIKKFKPDKEGEKVEYTGLSQSAIREISLCTELNHPNVVRLVETILEDKCVYMLLNGLLYLHSQWVMHRDLKPANILVTSKGAVRIGDLGLARVFKKPLNSLFSGDKVVVTIWYRAPELLLGARHYTTAVDLWAVGCIFAELLSLRPIFKGEEAKMDSKKTVPFQRNQMLKIIEILGLPKKEKWPGLSSMPEFPQLQAMAMAPGSGHLHKPSNLEHWYHVCLKSGGYSGSSPAGSPGKEGFDLLSRLLEYDPEKRISAKEALNHPYFTTGTPVAKNCFEGFEGKYPNRRVSQDDNDIRSGSLPGTKRSGLPDDTLTSRAAKRAREM

SEQ ID NO: 39654 - protein, 199 aa, Asparagus officinalis
LDEYSKFHGYSPAVVTGKPIDLGGSLGRDAATGRGVVFATEALLAEYGKSISGLTFVIQGFGNVGSWAAQLIHERGGKVIAIGDVSGAIKNSNGIDIPALVKHKSGGGVLKDFRGSDAFDPKELLVHECDVLLPCALGGVLHRENAADVKAKYIIEAANHPTDPEADEILSKKGVVILPDIYANAGGVIVSYFEWVQNI

SEQ ID NO: 39655 - protein, 192 aa, Gloeobacter violaceus PCC 7421
MRRLSQVGTCLAVLALLTAAGAGAQQAGPLKQNPTTTTASEPTAPIIPDASKYRQLEQESSVLSVAGTDQMLKAAQQMAKDGKFVDAVARNQEAITMLNQMSTLHSQLSKAFAGIDNRIADQEKQVALQAAIRRDEATYQLALIHRAQGKPELAVPLLVRITTSQNPTRDLGQKAYQQLFEIGFVKSQYPRQ

SEQ ID NO: 39656 - protein, 285 aa, Mycobacterium sp. JLS
MAAARVCVVGSVNADLRFAVPSLPRPGQTVLASSMTTSPGGKGGNQAIAAARAGGDVSLVAALGDDPAAGQLRAHLRANGVGLDGVVTVPGPSGSAVVIVDAAAENAIVVAPGANAHLSVASSAVREAIAGADVVLLQLEIPLHTANDAARVARDAGAVVMVNASPAGAPPHELLRLSEVADVVVVNQAEAGEWHWPVPHLVITRGARGASYLGDGERFDVPAPAVEAVDTTGAGDVFAGVLAVHWRSGHENALRRACVAGALATLVPGAGDCAPTAEAIDDALR

SEQ ID NO: 39657 - protein, 442 aa, Alteromonadales bacterium TW-7
MKQLSLPSGSPLLAKHFTYGVATASFQIEGGAADRLPCIWDTFCSKEGKIADNSNGDVACEHYTRWQDDIDLIESLGVDAYRLSISWPRVMTKKGHLNPKGVKFYTDILDELKRRNIKAFVTLYHWDLPQHIEDEGGWLNRNTAYEFAHYADLITKAFGERVHSYATLNEPFCSSYLGYEIGVHAPGIVGREHGRKAAHHLLLGHGLAMLVLAKNSPNSLNGIVLNFTPCYSVTQCEEDLKATAFADDYINQWYMQPVMQGQYPDIINQLPKAQRPDILPGDMDIIAQPLDYLGVNFYTRMHYQASETDFYHELPHKAPMTDIGWEIYPEALTELLVSLNEKYTLPPIYITENGAAMADEFKDGEVKDTDRIDYYHEHLNALHNATAQGVKVDGYFAWSLMDNFEWAEGYLKRFGIVHVDYNTQKRTVKASGKAYTKLITSR

SEQ ID NO: 39658 - protein, 265 aa, Oryza sativa (japonica cultivar-group)
MGRRHGGGGGGGGGRGRGGRGRGGGEEDDLHLHKAARSGDLAAAESLCEANPLALNSRDRLSRTPLHLAAWAGHVELVKCLCKHKADVGAAAMDDTAAIHFASQKGHVEVVRELLASGASVKAKNRKGFTALHFASQNSHLELVKYLVKKGADIAAKTKGGQTALHVAEKDDVRDFLKECEQSLKKGGELPSEKKDDSVSTIAEKPDDDKSSGEATKDEDEAGFGEKRKSDGIAAALRSPELKKAKVSLGHLISANDMEEEEEAD

SEQ ID NO: 39659 - protein, 426 aa, Escherichia coli [sequence omitted]

SEQ ID NO: 39660 - protein, 337 aa, Thiobacillus denitrificans ATCC 25259
MHTGTTLTQFIIEEQRRTAGATGDFTSLLNDVVTACKAISNAVNKGALLGVMGALESENVQGETQKKLDVITNDIMIRSNEWAGHLAGMASEEMDDVYAIPGQYPLGKYLLVFDPLDGSSNVDVNISVGTIFSILKAPVAGRAAKAEDFLQAGTKQVCAGYAIYGSSTMLVLTFGHGTNGFTLDRDVGEFVLTHPAMKIPTETKEFAINASNMRFWEKPVQRYVDECLAGKTGPRGKDFNMRWVASMVAEVHRILTRGGIFMYPKDTKDPSKAGKLRLMYEANPMAFIVEQAGGAATTGYQRILDIAPEGLHQRVPVILGSKTEVDTVTGYHHEKAA

SEQ ID NO: 39661 - protein, 479 aa, Streptomyces avermitilis MA-4680
MSSTFRNYIDGAFADASDGRTLDVVDPTTGDVYATSPLSGAADVDAAMAAAAAAFPVWRDATPSVRQRTLLKIADAMEARADELVAAESRDTGKPLHLTRSEELAPAIDQVRFFAGAARMLEGRSAGEYMEGMTSIIRREPVGVCAQVAPWNYPLLMAVWKFAPALAAGNAVVLKPSDTTPASTVLIAEIIGGVLEELGLPRGIFNVVCGDRETGRLMVEHPTPAMASITGSVRAGIQVAQSAAKDVKRVHLELGGKAPAVVFEDADLAKAVEDLVVGGFFNAGQDCTAATRVLVHESVHDEFVAALAKAAADTKTGQPDDEDVLYGPLNNAGQLAQVSGFIERLPEHATIEAGGHRVGEKGYFYAPTVVSGLRQDDEIVQNEVFGPVMTVQSFTDEAQAVQYANGVDYALASSVWTKDHARAMRMSKNLDFGCVWINTHMALVAEMPHGGFKKSGYGKDLSAYGFEDYTRIKHVMTSL

SEQ ID NO: 39662 - protein, 367 aa, Buchnera aphidicola (Tetraneura caerulescens)
MIKKFKLAILAGDGIGPEVMEEGIKILEVIKKKFMLKLDIKEYLVGGVAIDKFGTALPKSTIDGCLNADAVLFGSVGGDKWKHLPVEQQPERAALLPLRKILNLFVNIRSSKLYSSLSHLSPLKSKIVNNGFDILCVRELIGGIYYGIPKGQKMDNYKRRYAVDTSIYYEEEITRIANFAFEIATFRRKKVTSVDKANVLETSILWREVVNKVAKKYPEISLNHLYVDNASMQIIKNPMDFDVILCPNLFGDILSDECGMITGSIGMLPSASLNKSKFGLYEPAGGSAPDISGKNIANPIALILSISMLFKYSFEQLNIADAIESSVINVLKDGYRTFDILTTNTNEKLLSTSSMGSKISDYLKHEE

SEQ ID NO: 39663 - protein, 215 aa, Schizosaccharomyces pombe
KGQSNESLPQESYIVHTLVMVASDTGPLRIRSGHLPEVHPPAAEDKGKFEVVPFLLSSLDGIAHIRVFLPNDLKSQGQKLTVGKALSEVKRRFPEGITLLDPVENMNIKEPTFIKLMKKVNILESRLLSNPLHNFSELEEKYAEYLRKLALLEEVKDLKKKLSKARSIMQLDELNSRKRVLRRLGFTTSDDVIEVKGRVACEISSGDGLLLTELI

SEQ ID NO: 39664 - protein, 122 aa, Arabidopsis thaliana
MAGAVGTSMLGSLIVFTVILSLQEIYRGKLASSELFTILGGFTSSLLFLFSLTFIGNFQESSGIKSGWGAVILAEIIALIAAGTVHRVCITTCFLFSAGLLYEVNKISGYMLSKTESKSKRH

SEQ ID NO: 39665 - protein, 438 aa, Methanocaldococcus jannaschii DSM 2661
MHYYFITNLVIVMTQMDDAKNGIITEEMKIVAEKEKIDIEKLRKLIAKGYVVILKNVNRDTNPVGIGQSLRTKVNANIGTSPDCVDIELEIKKAKIAEKYGADAVMDLSTGGNLEEIRKAIMDAVKIPIGTVPIYEVGKLAREKYGRVIDMNEDLMFKVIEKQAKEGVDFMTLHCGITKQSVERLKRSGRIMGVVSRGGAFLTAYILYHNEENPLYKNFDYLLDILKEHDVTISLGDGMRPGCLADNTDRAQIEELITLGELVERCREKGVQCMVEGPGHIPINYIETNIRLQKSLCKNAPFYVLGPIVTDIAPGYDHITAAIGGALAGYYGADFLCYVTPSEHLRLPTIEDVKEGVIATKIAAQAADVAKGNKLAWEKETEMAYARKNHDWEKQFELAIDKEKARKMREEIPSKEEKACSICGDYCALLMVEELGKR

SEQ ID NO: 39666 - protein, 204 aa, Buchnera aphidicola (Chaitophorus populeti)
MLTISQILDLNWDKVNNLIPIIVQDVFSNEILMHGYANKKSLLITLKKKKLTFFSRTKNRLWTKGETSKNYLKVIDIIPDCDQDSLLALVQAIGNTCHLNNKSCFKKKKNINVSFILELERILKYYKKNNNSTSYTSNLYKKGINKISQKVGEEAVELVIAAINKDKKNMLEECADLIYHILVLFSYTNIPFIDLIKILKKRNT

SEQ ID NO: 39667 - protein, 377 aa, Methanocaldococcus jannaschii DSM 2661
MLFMKYEGEIAIGPVHPTMLEPHRLRLFIEDEIIKEAELVIGVNYRGIELIMEGLPPEKISILSEKICGICSHIHVWCNVTVTERGCDIEVPERAEYIRAIVEELERLHSHMLLFGHAFEVLGFETMAFRAFMIREPIMQILGEITGGRAQYSCPIIGGIRPRCNIKESKIPALLERLEKFEENLKKLLERTVNDPMIMSRIKDVGVLDKKTAKKLHALGPTARGSGIHSDMRKMGQVPVYDNFEFEEIVFDDGDVFSRLAVRFYECFESVKIIRQGLKDLPNLDKRIYNPNYELKEFKPIDVYNEAQRGQVYYSYGLDENGRVRQVKIRTPTATNLACMEAILPGHHVSDAELIIASCDPCFTCTDRMIVVKENKI

SEQ ID NO: 39668 - protein, 151 aa, Schizosaccharomyces pombe
AKNNPNNPLVQHRGLAGTHDVTFLNNVLNAFVKGSDEEVSIPFYDKSKFGGYGDRGDESQWKKANPKTTTYVIFEGWMVGFEPLDSCMLSVRARSTRWQNIEGSLLWVNRKLADYQPIFQKIDSLVELEAQEINYVYRWRLQQEHALKARI

SEQ ID NO: 39669 - protein, 1338 aa, Kluyveromyces lactis NRRL Y-1140
MSFLKKKSSTAGHSRSGSASSILNKHVDPANISEFYPSSLDHKVTSGLKNDYSFDSSSKGSRKSSGGSTNSLTSERLLFNWDVTDPSQWTMPRIIQWFRANDFNDQWITFFKRNSISGNKFLKLLAYDNFAPYEKSLQQSKSSSYERFQYLLKKTLEENVVKGNNRNGNRIINNSRSSSESAKVSQRLSTSFSTHIRSTSESALLNIENITKDSSSSEPTTSKKQEASNYSLPLRQAKTNSASALYRRSLISLRNASSTKDNASKNDIKITIPPRPLSTTENTNKSPTTPSSVSPSHTAYTGIFRRQHKTSSSESSLFTSIFGHGVVEEPEETPKPRPVENRRIPAASTVNASTSKQSINVDDKARLWDKIKRKGQLPAEPSSQPAARIIIEEVKESPKAEPPEIVIPEEIYPKRPSDSRELFIMLTKDNSTFSPFNVQPHLGTDVSELKKAVALALGLTHSNFSIHLTDFGAEFGSQIPDGLLADFQKTSFQNIPNKLYIQDLEKKANLNPRPRTETLASQHSTAASTKSKTSVKSNASAASNGEGSSSDLTSIDDQGSSHRRAYPQTPSHYYDNSTSAETDYWSFKDSVPETISDAPHITLPKSRPSLKLNSSVLNTHASEKSTFRIIRQTSDTDIDFNKRRESPYVRVAELAPKRKAPKPPVNGNPVTSGSLPSAAAKNVSESPLESPPKLDRNGKTIYQKNKPRPPPPLTTELGSRRSVSSLSGQDLNEVKESPVQSFTPASTQVMVPQPYKGALETLKPRKSSADLSIRPRMSLRQFSRSNSSLNRKVLSTSRQTLNRTNSKPLVTSSTAADIFDENDISFADAPELSDSDDYSASSDEIIWSRDRKSISNDVPEFSFNTEDTIDLVGTDTTQVSVGATEGSDTPKKMALRPSPDVVYQNLEKFFPDADLDNPILEGLTPPPSPNADSSPPSPRGFEKSLKTKSEQQPAFLSSRGESSQFLTPVKSLKPPKRTKTIRIIAQEASEARKNEVSQKLQRKNTKMWGTKVVEITDKRTISINKSRNSRGEYKEFAWIKGEIIGKGSFGAVYLALNVTTGEMLAVKQVTVPEFSSQDESAISMVEALKSEVSTLKDLNHVNIVQYLGFEEKNGIYSLFLEYVAGGSVGSLIRMYGRFDDQLIRHLTKQVLEGLAYLHSKGILHRDMKADNLLLDNDGVCKISDFGISRKSNNIYSNSDMTMRGTVFWMAPEMVDTAHGYSAKVDIWSLGCVVLEMFAGKRPWSNFEVVAAMFQIGKSKTAPPIPDDTKDLVSPAGQSFLDQCFEIDPEMRPTADSLVGHPFCKTSSSFDFPKTKLAQFIKSNDKLNSSRLRISSQEL

SEQ ID NO: 39670 - protein, 207 aa, Coprinopsis cinerea okayama7#130
MSSHNEDGNSIVNDLNGMNFSNLYGAIDRQNVHGLNLTTPEDAKAIIKPWAEREDDTIWAESNVDDQLIIHIPFMENLRHLSDGTAGRGESTPRHLRVFANHSTIVDFAAAEATKPHLNISLQEGETSVVEYPLRAAAFSSVHSLSLFFNEAVGEEVSRIYYIGFKGDMRSVKREVASELEVPAPHTADAPLSQKAENRAAHRPTAH

SEQ ID NO: 39671 - protein, 543 aa, Oryza sativa (japonica cultivar-group)
MASAAEAVEELTRLYRELPPRPAVEEVEAAEAVLASADAEEAARLDEVAREEASASASSSAAAPGRADGELLAVLREARRNAVRLRALQQRKEAAYVVELERRFKVFDDLIQRASRVVSSSSDAAEAGGGTTGDGYVGVGADSVDLEMELRKKEAAVAAAAAVAEMERGSKGLAALGLESKPISSLRRDVSAGTDMEKLSLIQVASLIESSAKKGITELSLRGKLVDQIEWLPVSLGKLQDVTELDLSENRIMALPSTIGSLRYLTKLDLHSNQLINLPDAFGELSNLIDLDLHANQLKSLPSSFGNLTSLANLDLSSNMLKALPDCLGKLANLRRLIVETNELEELPYTIGSCTSLVELRLDFNQLKALPEAIGKLEKLEILTLHYNRIKGLPTTVGSLSRLRELDVSFNEVEVIPENICFATSLVKLNLSRNFADLRALPKSIGNLEMLEELDISSNQIRVLPDSFRCLSRLRVFHADETPLEFPPREVVKLGAQAVVKYMNDLNAARGTNQKKTDRGSFWTWLFSLFGCCKKNQEVGLPV

SEQ ID NO: 39672 - protein, 379 aa, Glycine max
MSTAGQVIKCRAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 39673 - protein, 556 aa, Streptomyces avermitilis MA-4680
MQHERAGTSAGPEDLIDVAKLVTAYYALHPDPAEPGQRVAFGTSGHRGSSLATAFNEDHIAATSQAICEYRDSQGTNGPLFLGADTHALSEPARVTALEVFAANGVTVLIDSDDGYTPTPAVSHAILTYNRGRASGLADGVVVTPSHNPPADGGFKYNPPSGGPAGSEATSWIQDRANEIITGGLKDVRRVPYTQALAAPGTGRYDFLGTYVADLPSVLDLDAIRAAGVRIGADPLGGASVAYWGRIAEQHGLDLTVVNPLTDPTWRFMTLDWDGKIRMDCSSPYAMASLIEQRDRYRIATGNDADADRHGIVTPDAGLMNPNHYLATAISYLYSHRERWPAGAGVGKTLVSSGMIDRVAADLGRRLVEVPVGFKWFVDGLADGSLGFGGEESAGASFLRRDGSVWTTDKDGILLALLASEITAVTDKTPSEHYAALTARFGEPAYARIDAPASREEKALLAKLSPAQVGADTLAGEPVTAVLTRAPGNDAPIGGIKVTTDNAWFAARPSGTEDVYKIYAESFLGPDHLSQVQQEAKLVVDAALGADAPGAGSDMA

SEQ ID NO: 39674 - protein, 358 aa, Candida glabrata CBS 138
MLQFRTPLTRLTPMARLATRSAVRMASTKTMTVREALNSALAEELDRDDDVFIIGEEVAQYNGAYKVTKGLLDRFGERRVVDTPITEYGFAGLAVGAALKGLKPIVEFMSFNFSMQAIDHVVNSAAKTHYMSGGTQKCQIVFRGPNGSAVGVAAQHSQDYSAWYGSIPGLKVLVPYSAEDARGLLKAAIRDPNPVVFLENELLYGEQFEVSEEALSPDFTLPYTAKVEKEGKDISIITYTRNTEFSLAAAKILEEKYGVSAEVINLRSIRPLDIDAIVKTVKKTNHLITVESTFPSFGVGAEIIAQVMESEAFDYLDAPIQRVTGADVPTPYAKELEDFAFPDPETIVRAAKEVLSIE

SEQ ID NO: 39675 - protein, 129 aa, Brassica napus
MASEKEAALSATPSDAPTIFDKIISKEIPSTVVYEDDKVLAFRDITPQGPVHILLIPKVRDGLTGLSKAEERHIDILGRLLYTAKLVAKQEGLDEGFRIVINDGPQGCQSVYHIHVHLIGGRQMNWPPG

SEQ ID NO: 39676 - protein, 119 aa, Coccidioides immitis RS
MTQDLSGSAILGTLLISRERKLNWDEINMTLKELVTGDASQPTAATREEMSNARLPIAFRDSCAHLLIPLNRCRVQEYYLPWKCENERHSYEKCQYEEFKKRVAKMDELRAAKGGARSN

SEQ ID NO: 39677 - protein, 255 aa, Bacillus anthracis str. Ames
MKKKLGLLAMVVALMAITAGCSEVNQPITPKSTGIWNEYFVYPLSQLITYFANLFGSNYGLAIVVTTLIIRFALLPLMIKQTKSTKAMQALQPEMVKLKEKYSSKDQATQQKLQQEMMQLYQKNGVNPLAGCLPIFVQMPILFAFYHAIMRTSEISKHTFLWFDLGQADPYYILPVVAAITTFIQQKLAMAGTAGQNPQMAMMLWLMPIMILIFAINFPAALSLYWVVGNIFGIAQMYLIKGPEIKASKAGGSSK

SEQ ID NO: 39678 - protein, 108 aa, Arabidopsis thaliana
MAPELIGGGLVDFAVDIWAFGCSVLEMLTGKTVWGEHGDLVHDDWVDLIGHSDLTPQISTRLSAEAQDFLMRCLVKEPGSRWSIGELVDHLFLCSDVEFSHNGFVYDG

SEQ ID NO: 39679 - protein, 419 aa, Mycobacterium sp. JLS
MSPAQQREFDIVVYGATGFVGKLTAEYLADHGAGARIALAGRSQDKLLEVRESLGPKATDWELITADASQPSTLNAMAARARVVITTVGPYTKYGLPLVAACAAAGTDYADLTGETMFVRDSIDHYHKQAVDTGARIVHACGFDSIPSDLTVYALHRKVAADGEGELGDTSMVVRTLAGGASGGTIASILEVLNTASTDPEARREMTDPYTLSPDRSAEPELGAQPDMRWRRGAEIAPELSGYWTAAFAMAGPNTRIVRRSNALLGYAYGRRLEYSEVMSTGRTPVAPAVAALTTAGSAAVMGLGSRYFNRLPRKLVDRVLPAPGTGPSEQTRERGHYTVETYTTTTTGARYLARMSQRGDPGYKATSVLLGECGLALALDRDKLSDLRGVLTPAAAMGDALLARFPGAGVSLETSRLA

SEQ ID NO: 39680 - protein, 481 aa, Oryza sativa (japonica cultivar-group)
MGVPSAPAPDAHRRGVFLLSVGAGGGGAGTAVVEVEVEHPHSLSLSPPPMSSCGRYILHRVCRFDTLAGVAIKYGVEVADVKRVNGLTTDLQMFAHKTLRIPLPGRHPPAATATATAPSHPPPSSSPAATHRPREWATRRPPKNSALDPLLKPPQSTVAPSMDLLQNYYGLARPPKGDPENEGTEMATYSIGQHTKARSLSTGFSLVNGEVDDAEKPIRRRQKSDAEFSTREGNSGGVLMKAGPGLALRPKSGSRPEINNSQQDLVATAVPSYGDGLQAKNKEKRLLRECLEHYNALHPGSEFQLAAGKVIRHEGCAEHDHISIGDHGNFLARRKRTGCFSFLPGGPRTLFFYELDHFDGVVTCIPLDDEPVDEGYSFLCFCLGWDKRRSGIFDCVCKTCGHHVPVPYPFPKKKTYACGHGIGEVRPLCRICYSLSPFVHPSPGKFKVWHQRDCKIQRFGPSMSYGDPYLYGPWERVTAWR

SEQ ID NO: 39681 - protein, 99 aa, Brassica napus
GKKRKHSETESAAPPKKDDSAPERPKRTLLGWKDKAQDAEETKPAPGFRNKEKVLVTCSRRISFRYRHLMLNMVSLLPHCKKDSKVEAKSSKGATLNEL

SEQ ID NO: 39682 - protein, 163 aa, Treponema pallidum subsp. pallidum str. Nichols
MDGGYFLGQLHAVFSGEVFLSATCSWLASQVIKVAIACRRSAIRSVHGFFDFAVWRTGGMPSSHSALVSALTLSFALKCGLHSDLFIFSFFSAIIVVRDALGVRRSSGLQAEALNSLGARVSEKLDFSFRPVREIHGHKPLEVVVGVAVGIVTSALFYSSMSP

SEQ ID NO: 39683 - protein, 318 aa, Triticum aestivum
  misc_feature (154)..(154): Xaa can be any naturally occurring amino acid
  unsure (1)..(318): unsure at all Xaa locations
MVGRMERQTVSTSSASCSPSAASSSSSSCGGRKRPDILNMIRSAACLNSSSTDTGKGRSKQSSTKVTHGFHLVEGKSGHDMEDYHVAEYKCDKNHELGLFAIFDGHLGDRVPSYLRANLFSNILKEPLFWTDPQEAIKNAYGSTNKYILENAKXLGPGGSTAVTAIVVDGKDMWIANVGDSRAVLCERGAANQITVDHEPHISNERQRIEQQGGFVTTFPGDVPRVNGQLAVARAFGDHSLKTHLSSEPDIRHVPINSSIEFVILASDGLWKVMKNQEAVDLVKSTKDPQAAAKRLTTEALARKSKDDISCIVIRFRC

SEQ ID NO: 39684 - protein, 259 aa, Datura stramonium
AGRWNLEGCTALVTGGSRGIGYGIVEELASLGASVYTCSRNQKELNDCLTQWRSKGFKVEASVCDLSSRSERQELMNTVANHFHGKLNILVNNAGIVIYKEAKDYTVEDYSLIMSINFEAAYHLSVLAHPFLKASERGNVVFISSVSGALAVPYEAVYGATKGAMDQLTRCLAFEWAKDNIRVNGVGPGVIATSLVEMTIQDPEQKENLNKLIDRCALRRMGEPKELAAMVAFLCFPAASYVTGQIIYVDGGLMANCGF

SEQ ID NO: 39685 - protein, 235 aa, Mycobacterium avium 104
MSSPDQDPREAIAQGDDEVIDVRRGMFGAAGTGDTSGYGRLVRTVTLPGSSPRPYGSYFDDVVDTLTESLQSNGIEFHQAIEKVVVYRDELTLHVDRAALPHVAQHLRDDPRLRFEMCLGVSGVHYPHETGRELHAVYPLQSITHNRRVRLEVAVPDGDPHIPSLYRIYPTTDWHERETYDFFGIIFDGHPSLTRIEMPDDWHGHPQRKDYPLGGIPVEYKGAQIPPPDERRAYN

SEQ ID NO: 39686 - protein, 275 aa, Triticum aestivum
  misc_feature (140)..(140): Xaa can be any naturally occurring amino acid
  misc_feature (173)..(173): Xaa can be any naturally occurring amino acid
  misc_feature (189)..(189): Xaa can be any naturally occurring amino acid
  misc_feature (243)..(243): Xaa can be any naturally occurring amino acid
  misc_feature (265)..(265): Xaa can be any naturally occurring amino acid
  unsure (1)..(275): unsure at all Xaa locations
MEDERSTQSYQGGEAAEQVEVTDRGLLGNLLGKKKAEEDKEKKEEELVTGMEKVSVEEPEVKKEEHVDGEKKETLFSKLHRSSSSSSSSSDEEEEEVIDDNGEVIKRKKKKGLKEKLQEKLPGHKDTEGEHVTALPAPAXAPASVQTHHDTDVVVEKIDGDVKTEATPAVPEXEEKKGFLEKIKEKLPXAGHKKPEDAAGGGPSRTLAPAPGHARCSSTGATRRAPAAEEVSSPDAKEKKGLXLGKIMDKLPGYHKTGEEDKAAXAATGEHKPSA

SEQ ID NO: 39687 - protein, 255 aa, Mycobacterium tuberculosis H37Rv
MSVLDLFDLHGKRALITGASTGIGKRVALAYVEAGAQVAIAARHLDALEKLADEIGTSGGKVVPVCCDVSQHQQVTSMLDQVTAELGGIDIAVCNAGIITVTPMLDMPLEEFQRLQNTNVTGVFLTAQAAAKAMVKQGQGGVIINTASMSGHIINVPQQVSHYCASKAAVIHLTKAMAVELAPHKIRVNSVSPGYILTELVEPYTEYQPLWEPKIPLGRLGRPEELAGLYLYLASEASSYMTGSDIVIDGGYTCP

SEQ ID NO: 39688 - protein, 153 aa, Streptococcus dysgalactiae subsp. equisimilis
PMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLFLLYDSND

SEQ ID NO: 39689 - protein, 504 aa, Zea mays
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWSADFRASVGAMLDAVDAEFGKDDGSDKKPSASYLVPLQQCIFRFLCKAFVGADPSADWLVDNFGFTILDIWLALQILPTQKIGLVQPLEELLIHSFPLPSFLIWPGYYVLYRFIEKHGAEAVAYAEAQHGIGKKDAINNMLFVLGFNAFGGFSVFLPFLVAKVGGAPALRERLRDEVRRAMVGKGKDGEFGFATVREDMPLVRSTVYEMLRMQPPVPLQFGRARRDFVLRSHGGAAYQVSAGEVLCGYQPLAMRDPEVFERPEEFVPERFLGDEGARLLQHLFWSNGPETAQPGPGNKQCAAKEVVVDTACMLLAELFRRYDDFEVEGTSFTKLVKRQASPSVAQAAAAAGAQQ

SEQ ID NO: 39690 - protein, 391 aa, Gloeobacter violaceus PCC 7421
MRLATRLEKLQSNVFSLMDEAKARARRAGLEVVDLSLGSSDLSPPAHALERIRESILDPTSHGYLLFQGTRSFREACAAWYERRYGLALDPETEILPLIGSQEGTAHIPLAVLDPGDVALLTDPGYPSHEGGVHLAGGQIYPLALRPETGYLPQLEQIPEEVLERSRLLVLSYPHNPTAATATLAYFERAVAFCRAHDIVLVHDFPYADFHLSGEQPPSILQADRERAVAIEFFSLSKSFHMGGFRIGFAVGNRDLVAALRQVKASIDFNQYRGILDGAEAALRGPQDYVREAVAVFRARRDRAVAALAQAGWQVPAPEATMYLWAALPECWRGSSAEFCIRLVEQTGVALAPGSGFGSSGEGYVRFALVRSEDMLERAIAQIAGFLQRSC

SEQ ID NO: 39691 - protein, 308 aa, Candidatus Desulfococcus oleovorans Hxd3
MVVAIGEVLFDVFPEDKRIGGAPFNFAVHLANMGFPVHFVTRVGKDANGRAILDLMHRFGLSRENVQIDPEYATGRVMVHPEADGGHRFDIVAPAAYDYLACTDQVMDLMRTPPDMVYFGTLAQRSEQSRQAMEEMFQAAPPETRFFCDINLRPGGYDRAIVDGALQQADLLKLNDAELAVIGEMFDIQGDTETMIRRLMEARGLVLVALTLGSRGGRLFTPDDHVRIDLPSRSAGPPVVDTVGAGDAFAAVTAAGFLQNRHLSTILEAATEFAGRICGIQGAVPDSPDFYRQGRLPEFFYKDTGESR

SEQ ID NO: 39692 - protein, 436 aa, Acidobacteria bacterium Ellin345
MSDTIRKYQEYVITSFVKAVQPVVIESASGAIIKDISGREFIDCFAGISVVNAGHCNPKINAAAKAQIDKLVHCGSYIYHSQPTAQLAEKMAKITPGRLKKSFFANSGAEAIEGAMKVARLFTGKHEIISLQQSFHGRTWGTLSITGNQGRKKRGGPYAPGIAFAPAPYAFRSPWPNEPEKFASYCAKQVEETIRYSTSGDVAAFIAEPVMGEGGIIVPPQNYFREVKEVLDRHGILFIADEVQSGFGRTGKMFAIEHYDVEPDILVTAKGIANGYPIAAFTTRDEIAAAFKPGDHLSTFGGNPICCAAALANIEFFEEEKLCDQSTEKGQHALTRLRALQGRQSGIGEVRGLGLMIGVELVKDDHLTPAAAEAEAVRDTCFKAGVLIGVGGTNANVLRLQPPLVITYEQLNTALDVLEGAITEVVGRTAAVAGKA

SEQ ID NO: 39693 - protein, 453 aa, Acidobacteria bacterium Ellin345
MASIVLRTKVPGPKALELASRRSAAVPRGIYASTPIYVSRAEGALIEDVDGNTFIDLAGGIGVINVGHRSPAVVEAIHRQTDRFLHTCFQVVGYESYIRLAEKLNEITPGEFPKRTFFVNSGAEAVENAVKIARYHTKRPAVICFEDAFHGRTTLGMALTSKTHPYKAGFEPFPSEIYRIPYAYCYRCSYGKKYPSCEVACADALEGVFKRTVAAESVAAIIIEPVLGEGGFVTPPSDFLRKLHGICKQHGIVFIADEVQTGFGRTGAMFACERYGVEPDILIGAKSLGGGLPIGSITGRAEIMDAPIPGGIGGTFGGSPLACEAALATIEAMQRQDLPARANALGERFRARALRWQAQWPQIGEVRGLGGMQAIELVRSAESRTPNDSATKHIIQYCYERGVITLNAGTYSNVIRILMPLVISDAQFEEALDVMESALSHEFATSRVTTGVS

SEQ ID NO: 39694 - protein, 193 aa, Cryptococcus neoformans var. neoformans JEC21
MQTIKCVVVGDGAVGKTCLLISYTTNKFPSEYVPTVFDNYAVSVTIGDDPYTLGLFDTAGQEDYDRLRPLSYPQTDVFLVCFSVTSPASFENVREKWFPEIAHHCPGVPALIVGTQVDLRDDPAQTEKLGRQRMKPITQDMGERLARELGAVKYVECSALTQRGLKNVFDEAIVAALEPPMATKKKSKKCLIL

SEQ ID NO: 39695 - protein, 493 aa, Acidobacteria bacterium Ellin345
MDTATKTSTKTYQMYIDGKFVESATGKLFPVYDPSTEEVIAECPAGNAADVDRAVAAARTAFDDGPWNATTAQERGRVLFRIAEKIRQHTAELAEIECRNSGKPIVEAEYDIADCATCFEYYGGLATKITGQVNPVPDNAVSLSLKEPIGVAGQIIPWNYPLAMAAWKLAPAIAAGCTVVIKPAEQTPLTLLELAKHFEEVGLPNGVVNVVTGYGEEAGAPIVAHKDVDKIAFTGSGSVGKLIMREASATLKRVSLELGGKSPNIFFADADFEAAIDGALFGVFINQGEVCSAGSRILVERPIYKKFVEAMTEKAKKIKLGAPLDRDTKMGPLVSKDQYERVREYQEIGKKEAKVASGGNRPSGFAKGYYVEPTIFYDVDNSARIAREEIFGPVASVIPFDNEADGLKIANDTPFGLAAAVWTRDIFKAFRMVKKIRAGIVWVNHMQPTYYEAPWGGYKQSGFGRELGPWGVEEYLETKQVHINLSEQPIGWY

SEQ ID NO: 39696 - protein, 435 aa, Magnaporthe grisea 70-15
MTVLPLEPEFSQAYNELAGTLEDSTLFEKYPELRTALSVVSIPERVIQFRVVWEDDSGALRVNRGYRVQFSSALGPYKGGLRLHPSGGADFDPKGKSDAEIRRFCVAFMTELSKHIGADTDVPAGDIGVGGREIGYMFGAYRKLRNRFEGVLTGKGLDWGGSLIRPEATGYGLVYYVGHMLEYAGVGGWAGKRVAISGSGNVAQYAALKIMELGGTVVSLSDSRSALVAVEGGRTITEADVKRVMELKDRRRPLSDLLPESEEGGSTSPGGLKHLPGARPWTHVGKVDVALPCATENEVSKEEAEALVAAGCRFVAEGSNMGCEQGAIDVFEANRRSKGKGDAVWYAPGKAANCGGVAVSGLEMGQNSSRLKWSREKVDKELANIMETAFRTGLDTAKEYVNRASDDELPSLVAGSNIAGFVKVARAMQAQGDWW

SEQ ID NO: 39697 - protein, 456 aa, Acidobacteria bacterium Ellin345
MHDALRQEIELFEKRTPKSAEAHKRNLKRLPLGVASNYRAYDPYPIFVKDAFGSKFRDLDGNEYIDHNLTFGALMAGHCHPAVMKAVEKRLTTGTMFGMPHDMEWELAEEICARFPIEMLRFASTGTEATMHTVRLCRAATGRDKIIKFEGGYHGLHDAALVSVKPKLEQIGDLKAPIAVPGGQGVPKTAVANVLIASFNDLESVEHRFKTHPNEISAIILEPVMMNVGICMPEPGFLEGLRELCDKHGALLIFDEVKTGAKLGWGGASEYFGVIPDAICLAKSIGGGLPLAAFGASKKVMGLISDHKVFHGGTYNTNPVSMAAGLATFREVLTRENYAHVEKLSHKLVTGYRRVVEEVGLDAYLEIAGANGVLMFAPKRVRNYRDWLEVDASLWQQYWFAMVNRGVMPQPYWWDEQWTMSVAHTDADTEKHLAVFGEIAPALAVAQKEPREAVVH

SEQ ID NO: 39698 - protein, 107 aa, Triticum aestivum
MAKLMCLCFIILAIAVAVSADECEGDRRAMIKECAKYQQWPANPKLDPSDACCAVWQKANIPCLCAGVTKEKEKIYCMEKVAYVANFCKKPFPHGYKCGSYTFPPLA

SEQ ID NO: 39699 - protein, 341 aa, Arabidopsis thaliana
MDNSAPDSLSRSETAVTYDSPYPLYAMAFSSLRSSSGHRIAVGSFLEDYNNRIDILSFDSDSMTVKPLPNLSFEHPYPPTKLMFSPPSLRRPSSGDLLASFGDFLRLWEINEDSSTVEPISVLNNSKTSEFCAPLTSFDWNDVEPKRLGTCSIDTTCTIWDIEKSVVETQLIAHDKEVHDIAWGEARVFASVSADGSVRIFDLRDKEHSTIIYESPQPDTPLLRLAWNKQDLRYMATILMDSNKVVILDIRSPTMPVAELERHQASVNAIAWAPQSCKHICSGGDDTQALIWELPTVAGPNGIDPMSVYSAGSEINQLQWSSSQPDWIGIAFANKMQLLRV

SEQ ID NO: 39700 - protein, 785 aa, Triticum aestivum
  misc_feature (200)..(200): Xaa can be any naturally occurring amino acid
  unsure (1)..(785): unsure at all Xaa locations
LKILHPSTSPSHGATTATRAVAGSDVQTTSTATSARVQGKLLLQSSDSPNSPLRLSLQLVSATVPGSDGRGVRGEAAALDAVISSGETELDVELLWDEALGAPGAVLVTNNSDFPVYLQLLSLSSPAVHFVCNGWVYPVGTRPYRLFFTNDAYVKEKTPPALLKDREDELRLLRGEGSPADKPLQKWDRVYDYALYNDLXGNPDLREDLARPVLGGSEEYPYPRRTRTSRPPSKADPASETRASLEEGIYIPCDERTGAVAKAPNLPKLDGHFGSLADVHGLFDSNAKPIPFPVPQVISANRTAWRTDEEFARQTLAGTNPLSIELVTGLPLTSKLDRALYGDQDSKITKEHIEKNLGNMTVAQAIEKDRLYVVDHHDWVMPYLKRINELPGAEEKGEISQRKSYATRTLFFLQDDSTLKPLAIELSSPHPEDERLGATSTVYTPPDELKAGDAASDTFTAWDLAKAHAASNDACKNNYVLHWLRTHATMEPVVIAANRQLSVLHPIHKLLKPHFRNTLDTNSTARHIVIGSGDERQGGAFYRNMHEVNFFTGKYGMEMSSKAYASFNFTELAFPNELIKRGVARGDPKNAEELELLIKDYPYAVDGLEIWTAIKEWVTDYCAIYYADGDGAVAGDSELQAWWSEVRNVGHGDLRDAPWWPAMDSVGDLVETCATIIWLGSAYHSAVSFGQYAYNGFVPNRPTVTSGGDAGRRKTGVTEVESSGDHPKNQTFGLWAHHNRRLSRRAVMGDRQTGQGKTTQGGQPSRINSTWTHPGAPKKNLPPPE

SEQ ID NO: 39701 - protein, 345 aa, Arabidopsis thaliana
MAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAEC

SEQ ID NO: 39702 - protein, 691 aa, Ashbya gossypii ATCC 10895
MERNTVQRSGTMQTGGSSSASKNYSNINANLHARVKAFQEQRKLQRSGSVGSKSSGQSQDSAAIQHIVNKPLPPLPPGKGKEAAPPLRRQGSMLKADSRPRSMSSFTGSPPAVGASIADAEPVASAERPAPVLQANVGQEADSMPVQQSIPLKAAAVPGRQPHQKTHSASDIFQRTSSHVLPQIPIPLNPIRKAPRPPDAGMGHQRGRQGSHSGIVLGPQSGAGGTGSASDAPKHIMTKSKPSLSARRGLKLPSGGISLKMKQPLQEFASQPSNKDTALATSGVVPGHRVSKSNPGSLTNGIQTTSTSSDKQVDTKGTEPSKSGNSGTNSNGGLFAVFSKYVDIKSGSLNFAGKLSLSSQGVDFSNGSSFRITLDELEFLEELGHGNYGTVSKVLHKPTNIMMAMKEVRLELDESKFRQILMELEVLHKCQSPYIVDFYGAFFIEGAVYMCMEFMDGGSLDKSYDPHEIGGIEEPQLALITESVIRGLKELKDVHNIIHRDVKPTNILCSATQGTVKLCDFGVSGNLVASLARTNIGCQSYMAPERIKSLNPDKATYSVQSDIWSLGLSIVEMALGAYPYPPETYDNIFSQLSAIVDGPPPRLPKDTFSSDAQDFVRLCLQKIPERRPTYASLLEHPWLKKYRGLDVHMSEYITKRLVQRQHYLEQSGGDELPKVLPALHGRLVKPQPHIP

SEQ ID NO: 39703 - protein, 153 aa, Streptococcus dysgalactiae subsp. equisimilis
PMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQESASMAGHLKLGKLVLLYDSND

SEQ ID NO: 39704 - protein, 516 aa, Methanocaldococcus jannaschii DSM 2661
MMCGINGIIRFGKEVIKEEINKMNKAIKHRGPDDEGIFIYNFKNYSIGLGHVRLAILDLSEKGHQPMGYNVDEDKIIYRDDELDRADIIIVYNGEIYNYLELKEKFNLETETGTDTEVILKLYNKLGFDCVKEFNGMWAFCIFDKKKGLIFCSRDRLGVKPFYYYWDGNEFIFSSELKGILAVKEINKKENINKDAVELYFALGFIPSPYSIYKNTFKLEARQNLIFDLDKREIRKYYYWELPDYKPIYDKKKLIEEGKKLLYDAVKIRMRSDVPVGAFLSGGLDSSTVVGVMREFTDLSKLHTFSIGFEGKYDETPYIKIVVDYFKTQHHHYYFKERDFEELIDKYSWIYDEPFGDYSGFPTYKVSEMARKFVTVVLSGDGGDEVFGGYMTHLNGYRMDFIRKLPKFLRVVGSKLPVKKDLNGIANLYLLKEAFRLSLINPEEFYAESIKEDAIRPEIYKKWTIEKLRYCLNKGDNKLGEALRIFDLLFNTLCDNFLVKVDRASMLTLWKLEVHF

SEQ ID NO: 39705 - protein, 562 aa, Glycine max
MAPSTTVPNGTLPSGSVTGRLASVYSEVQKTRVDHALPLPSVLKHPFTILHGPPSSAAGNPDEIAKLFPHLFGQPSAALARSDAAQTQKKLKIGVVLSGGQAPGGHNVISGIFDYLQERAPGSTLYGFKGGPAGIMKCKYVELTSEYIYPYRNQGGFDMICSGRDKIETPEQFKQAEETAKKLDLDGLVVIGGDDSNTNACLLAENFRSKNLKTSVIGCPKTIDGDLKCKEVPTSFGFDTACKIYSEMIGNVMIDARSTGKYYHFVRLMGRAASHITLECALQTHPNITIIGEEVAAKKLTLKNVTDYIVDVVCKRAEINYNYGVILIPEGLIDFIPEVQHLIAELNEILAHDTVDEGGLWKKKLTDQSLKLFDFLPQAIQEQLMLERDPHGNVQVAKIETEKMLIQMVETELEKRKQEGKYKGEFKGQSHFFGYEGRCGLPTNFDATYCYALGYGAGALLHSGKTGLISSVGNLCAPVKEWTVGGTALTSMMDVERRHGKFKPVIKKAMVELEGAPFKKFASLRDEWALKNCYISPGPIQFSGPGSEVINHTLLLELEAQA

SEQ ID NO: 39706 - protein, 117 aa, Synechococcus sp. PCC 7002
MKKLLAIALTVLATVFAFGTPAFAADAAAGAQVFAANCAACHAGGNNAVMPTKTLKADALKTYLAGYKDGSKSLEEAVAYQVTNGQGAMPAFGGRLSDADIANVAAYIADQAENNKW

SEQ ID NO: 39707 - protein, 751 aa, Cryptococcus neoformans var. neoformans JEC21
MGPNTRPAPQAPTHYSRHRPQSITGNNAPQSRTKPRIGQYIVERTLGTGSFGKVKLATHAVTGHQVALKLINRSKITTPDMNARVKREIQYLKVLRHPHIIKLYEVITTPTDVIMVMEYAGEELFNYIVQKGKHGMTEDEARRFFQQMIGAIEYCHKHHIVHRDLKPENLFLDSRRNIKIGDFGLSNLMTDGDFLKTSCGSPNYAAPEVISGKLYSGPEIDVWSAGVIMFVLLCGKLPFDDEHIPTLFKKIENGVFHIPSHVSEPARHLLKRMLEVDPLKRCTIAEIRQMPFFQENLPRYLQPLPELADMERYPSLTMDDMTTLLLINEGQADPKKVAEDKGLVFSEDLGVIDPDIVEELLEKITTYSEGMVWEALKMPGDNQVKVAYQLVRDHRRILKDSNAYEDEDSSAMEEFMASSPPAWNADIAPPIDVQQNGADEYPDLEDVDLEIQDIPNAHFDVLDSSLPGWMTPPSSSTSAMSTPTTTHPTSAQNSANPSFSSVTSDTTASGSTAEEAARALLSPAPSSASQSVTSFSSPTPQPQPQRRLDKSMTKPKWHFGIRSRSPPMEVMLEIYRTLNVLGMQWRLKDIPLPDIGGAPPGGYSEEVELVLEDLKEKNGERPVMGRKPPSKKDAMAQEKLAQGLYHVETRARYGDVMVRMDLQLYRVDDQHYLVDFRNLGYYMVSEKDMSLPDVSRQGHSHEEGASNAGGSVPSATSATAAGAKEAGIGGVSGPFHFLEMACQLIAELASG

SEQ ID NO: 39708 - protein, 153 aa, Streptococcus dysgalactiae subsp. equisimilis
PMAYVLWNHFMNINPKTSRNWSNRDRFILSAGHGSAMLYSLLHLAGYDLSVEDLKNFRQWGSKTPGHPEVNQTDGVEATTGPLGQGIANAVGMAMAEAHLAAKFNKPGFDIVDHYTFALNGDGDLMEGVSQEAASMAGHLKLGKLVLLYDSND

SEQ ID NO: 39709 - protein, 313 aa, Gloeobacter violaceus PCC 7421
MQAVIVAGGKGTRLRPLTYRTPKPMLPIFERPFLCLLVERCRAAGIVDILMNVHYQAGQIQDYFGDGGAFGVRIRYSVEQNPLDTAGAVKLAEPYFTGAPLVVFNADILTDLDLTALVAAHRQAGAAATLALTRVLDPTAFGLVQLTDHNQVAAFREKPTAEEAARLGIDTINAGTYVLDPRIFADVPAQTPWSFERQLFPNLLAQRQKVLGFVSDTYWLDIGNPAKYWQAHLDILSGRMPLPLPAQQIAPGIWVAEGAAVDAAARLEAPCYIGGCCCVGPEAAIAPGTVLGSASLVNRPLSPGIYPPGTMVP

SEQ ID NO: 39710 - protein, 251 aa, Treponema pallidum subsp. pallidum str. Nichols
MKLVLIRHGESEWNRLNLFTGWTDVPLTPRGESEAQEGGRVLQEAGFDFDLCYTSFLKRAIRTLNFVLQALDREWLPVHKSWKLNERHYGDLQGLNKTETAQKYGEQQVRVWRRSFDVAPPPLTVGDARCPHTQASYRGVCASGRTPVLPFTESLKDTVARVVPYFEEEIKPQMISGQRVLIVAHGNSLRALMKHIESLDETQIMEVNLPTGVPLVYEFEADFTLCGKRFLGNEADVAARAQAVADQGKSN

SEQ ID NO: 39711 - protein, 363 aa, Triticum aestivum
  misc_feature (235)..(235): Xaa can be any naturally occurring amino acid
  unsure (1)..(363): unsure at all Xaa locations
VKLPTRPRGPQLFYRERERERERERERDLRVGSPEEPSRTQPEGERSEGLAAKMAKLKELLDRSENRICADCSAPDPKWASANIGVFICVKCSGVHRSLGTHISKVLSVTLDKWTDDEIDSMVEVGGNSQANAIYEAFLPEGYRKPHPDSAQEDRQNFIKSKYELQEFLEPSLRIVSNHPSNAGKQASNSHSGSSKSEIGMVEFIGILNVKVIGGTKLAIRDVSSSDPYVVLTLXGQQKAQTSVIKGNLNPVWNEELKLSVPRKYGPLKLQVLDHDMVSKDDLMGEAEIDLQPMINAAASFGDPELLGDIQIGRWLKSGDNALTADSAVMVTGGKVKQEVSLKLQHTESGEVTVEMEWMALNI

SEQ ID NO: 39712 - protein, 539 aa, Ashbya gossypii ATCC 10895
MSRQVLHSDMRSVGTEVSAASQKKYLMEETVDIPTKPATAYITVCLLCVFVAFGGFIFGWDTGTISGFVNQTDFRRRFAQVNDEGGYYWSNARVGLIVAIFNIGCAVGGIILSRLGDMYGRRIGLMIVSLIYVVGIIIQISSNTKWYQYCIGRVISGLGVGGIAVLSPMLISETSPKHLRGTLVSCYQLMITAGILLGYCANYGTKSRYDDSRQWRIPLGLCFLWAIFMITGMAFVPESPRYLIEKDKIEEAKRSLATSNKVPVDDPAILAEVNNIQAGVELERMAGSASWGELFTVRTKILQRVIMGAMIQSLQQLTGNNYFFYYGTTIFDSVGLEDAFKTSIILGAVNFGSTFVAMYTVDRFGRRKCLLYGAAAMAVCMVIFASVGVTRLWPNGPDQPSSRPAGNAMIVFTCLYIFFFATTWAPIAYVIVSETFPLRVKAKGMAIATAANWIWGFLIAFFTPYITNAIRFYYGYVFMGCLIFAFFYIFFFVPETKGLTLEEVEEMWQEGVVPWRSESWVPSARRHAPYSSDKQAAGI

SEQ ID NO: 39713 - protein, 229 aa, Triticum aestivum
MARGLHHLLLLAALLQLLSTTSAATAGDVATGSGSEKVHVAIYYESLCPYSVRFVANHLLKAYRDGLLDAADLTLVPYGNAKVNAHGAITCQHGPEECLLNTVEACAIDAWPDVKVHLGFIYCVSDLVMKNKHREWESCFQKQGLDPRPVTECYKGERGHNLSLEYGKQTAALVPPHQFVPWVVVDGKPLYNDYGNFKAYVCKAYKGYPLLEACRSLGLEADNNVYGPL

SEQ ID NO: 39714 - protein, 546 aa, Ashbya gossypii ATCC 10895
MSAAIAQPDNRSVMSTHSSTASNKPSKEENKESGLVEIPVKPASAYITVSLLCILVAFGGFIFGWDTGTISGFVNQSDYKNRFGELNESGDYYLSDNRTGLIVAIFNIGCAVGGIFLSKFADMYGRRIGLMIVTLVYVIGIVVQISSTDKWYQYCIGRVISGLGVGGIAVLSPMLISETSPKHLRGMLVSCYQLMITAGIFVGYCANYGTKAKYEDSKQWRIPLGLSFAWAILMIGGMVLVPESPRYLVEVNKYEDAKRSLARSNKVPVDDPSIQAEFDNIHAGIELERMAGSASWGELFSTKSKILQRVIMGVMIQSLQQLTGNNYFFYYGTTIFKSVGLEDSFQTSIILGAVNFGSTFVAVWAVGKFGRRRLMLAGAAAMTVCMVIFASIGVTKLWPNGEDQPSSKPAGNVMIVFTCIYIFCFATTWAPIPFVIVSETFPLRVKAKGMAIATAANWIWGFLIAFFTPKITNAIKFNYGYVFMGCLIFAFFYMFFFVPETKGLTLEEVEEMWQEGVVPWKSESWTPSYKRNAYETEEVKPEKTWA

SEQ ID NO: 39715 - protein, 535 aa, Ashbya gossypii ATCC 10895
MTVSEGMTPSKSELSGDGSNSHPIESKKDIVSVISTETKPFSAYIFACLCCFMVAFGGFIFGWDTGTISGFVKQTDFIARFGQLSPSGEYELSDDRTGLIVSIFNIGCAVGGIFLSKIGDAYGRKIGLATVTAVYVIGIVIQISASDKWYQYFVGRIISGLGVGGIAVLSPMLISETSPKHLRGSLVSCYQLMITAGIFLGYCTNYGTKTNYTDSRQWRIPLGLGFAWALLMIGGMAFVPESPRYLVEAENLPKARMSIARANKVAEDHPIVEHELNTLQTAIELEKLAGKARIVDLFNVKKKIFQRLIIGIFIQSLQQLIGNNYFFYYGTTIFNAVGMDDPFVTSIVLGIVNFGSTFFSLYTVDKFGRRKCLIWGAFAMAICMAIFASVGVTKLWPNGEDQPSSKPAGNVMIVFTCIYIFFFATTWAPIAYVIISEIYPLRVKARAMALATAANWIWGFLIAFFTPRITSAIKFCYGYVFMGCLIFAFFYIFFFVPETKGLTLEDVDEMWQEGVVPWGSESWLPRSDREVAHDA

SEQ ID NO: 39716 - protein, 1104 aa, Kineococcus radiotolerans SRS30216
MPRRTDLKSVLVIGSGPIVIGQAAEFDYSGTQACRVLRAEGLRVILVNSNPATIMTDPEMADATYVEPITPAVVEAIIAKERPDAVLATLGGQTALNTAIALYENGVLEKYGTELIGADVEAIKLGEDRQLFKGVVERCGAESARSHLCHSMEEVLAGAADLGYPVVVRPSFTMGGLGSGFAYDEADLRRIAGQGLHHSPVTEVLLEESILGWKEYELELMRDRADNVVVVCSIENFDPMGVHTGDSITVAPAMTLTDREYQRMRDIGIAVIREVGVDTGGCNIQFAVNPEDGRIIVIEMNPRVSRSSALASKATGFPIAKIAARLAVGYTLDEIPNDITSSTPASFEPTLDYVVVKVPRFAFEKFPAADPTLTTTMKSVGEAMALGRNFTEALQKALRSTEKRGATFSWAGEPGDRADLLRRAAQPTDERIGLVMQAIRAGATPEELFESTRIDPWFLDQMFLLDEIAGEVRDSDELTPELLRHAKRHGFSDAQIGELRHLPEDVVRGVRHALGIRPVYKTVDTCAAEFAASTPYHYSSYDEEDETRPREKAAIVILGSGPNRIGQGVEFDYSCVHASFALRDAGYETVMVNCNPETVSTDYDTSDRLYFEPLTLEDVLEVVHAEMRCGPVAGVIVQLGGQTPLGLAAKLEQAGVPIIGTSPQAIDLAEERGAFGQVLERAGLVAPKHGTASSFPGAKAIAAGIGYPVLVRPSYVLGGRGMQIVYDEASLEEYMRTATEVSPERPVLVDRFLDDAIEIDVDALFDGEEMYLGGIMEHIEEAGIHSGDSACVIPPPTLGNAELARVRAATEAIARGVGVRGLLNVQFALAADVLYVLEANPRASRTVPFVSKATGVALAKAAARLMAGTSIRDLRAEGLLPGRGDGGLLPADSPVSVKEAVLPFARFRTAEGVVVDSLLGPEMRSTGEVMGIDVDFPTAFGKSQTAAYGGLPTAGTAFISVADRDKRAMIFPIKRLADLGFTLVATEGTAQVLRRNGITSTVVRKHSEGTSEDGELTIVGRIGAGEIAMVVNTPSGNQARADGYEIRAAATAVGSPIITTIQELSAAVQAIEAAIVQERNGGGVNVASLQEHTARLNAAWEGRA

SEQ ID NO: 39717 - protein, 154 aa, Oryza sativa
  misc_feature (62)..(62): Xaa can be any naturally occurring amino acid
  misc_feature (82)..(82): Xaa can be any naturally occurring amino acid
  unsure (1)..(154): unsure at all Xaa locations
MRASSLFAESVFTTSAAAGRRRCPRLAAVPVTLFFSTGRGSPAMAEEAQQPRGVKVGGIHDXPAGRENDLTTVELARFAPVXVAEHNSKANAMLELERVVKVRQQVVGGFMHYLTVEVKEPGGANKLYEAKVWERAWENFKQLQDFKPLDDATA

SEQ ID NO: 39718 - protein, 501 aa, Arabidopsis thaliana
MENGKCNGATTVKLPEIKFTKLFINGQFIDAASGKTFETIDPRNGEVIATIAEGDKEDVDLAVNAARYAFDHGPWPRMTGFERAKLINKFADLIEENIEELAKLDAVDGGKLFQLGKYADIPATAGHFRYNAGAADKIHGETLKMTRQSLFGYTLKEPIGVVGNIIPWNFPSIMFATKVAPAMAAGCTMVVKPAEQTSLSALFYAHLSKEAGIPDGVLNIVTGFGSTAGAAIASHMDVDKVSFTGSTDVGRKIMQAAAASNLKKVSLELGGKSPLLIFNDADIDKAADLALLGCFYNKGEICVASSRVFVQEGIYDKVVEKLVEKAKDWTVGDPFDSTARQGPQVDKRQFEKILSYIEHGKNEGATLLTGGKAIGDKGYFIQPTIFADVTEDMKIYQDEIFGPVMSLMKFKTVEEGIKCANNTKYGLAAGILSQDIDLINTVSRSIKAGIIWVNCYFGFDLDCPYGGYKMSGNCRESGMDALDNYLQTKSVVMPLHNSPWM

SEQ ID NO: 39719 - protein, 110 aa, Xanthobacter autotrophicus Py2
MAHQLSAGFVPIRKKGKLPHQTVRMAYALEYGEDEIEMHVDAVMPGERVLLVDDLVATGGTATGAVKLLQTCGAMVEAACFIVDLPDLGGADKLRRAGVSVRTLVSFSGH

SEQ ID NO: 39720 - protein, 628 aa, Oryza sativa (japonica cultivar-group)
MAMKSLKLPKTAVLPGFGGIARPQDVQDRSANFTCSRPRAASVTDQSTAEPAKPRQNKHTVDPSAPEFLPLPSFEECFPRSTKESREIVHEESGHVLKIPFRRIHLTGDEKHFDTYDTSGPQNISPRIGLPKIRKEWIDRREKLGGPRYTQMYYAKQGIITEEMLYCATRENLSPEFVRSEVARGRAIIPSNKRHLELEPMIVGRNFLVKVNANIGNSAVVSSIEEEVHKLQWATMWGADTVMDLSTGRHIHETREWILRNSSVPIGTVPIYQALEKVNGIAENLSWEVFRDTLIEQAEQGVDYFTIHAGVLLRYIPLTAKRMTGIVSRGGSIHAKWCLTYHKENFAYEHWDEILDICNQYDVALSIGDGLRPGSIYDANDSAQFAELLTQGELTRRAWAKDVQVMNEGPGHIPMHKIPENMEKQLEWCNEAPFYTLGPLTTDIAPGYDHITSAIGAANIGALGTALLCYVTPKEHLGLPNRDDVKTGVISYKISAHAADLAKGHPYAQAWDDTLSKARFEFRWLDQFALSLDPVTAMSFHDETLPSEGAKVAHFCSMCGPKFCSMKITEDIRKYADEHGYGTVEEAVIQGMNAMSAEFSAARKTISGEQHGEAGGEIYVPESYTARK

SEQ ID NO: 39721 - protein, 399 aa, Triticum aestivum
MLTCIACSRQLGGGVPPLHEPPEDEDVVDAGAGVGGAATPSTRQAIKALTAQIKDMALKASGAYRHCKPCAGSSAGASGRHHPYHHRGGSGFRGSDASDRFHYAYRRAAGGGSSGEATPSMSARTDFPAGDEEEEEEEDGMSSGGGGGGKEDNAKEWVAQVEPGVLITFVSLPQGGNDLKRIRFSREMFNKWQAQRWWAENYDKVMELYNVQRFNHQSVPLPTTPKSEDESSKEDSPVTPPLDKERVPRSLQRPTSGGGAMGYSSSDSLEHHSNHYSNGLHHHHGHQCYDSVGLASTPKLSSISGAKTETSSMDASMRTSSSPEEVDRSGELSVSISNASDQEREWVEEDQPGVYITIRALPGGIRELRRVRFSREKFSEMHARLWWEENRARIHEQYL

SEQ ID NO: 39722 - protein, 304 aa, Prochlorococcus marinus str. MIT 9312
MHEFLPYAWFEGKCIPFKEAKISIATHALHYGTAAFGGMRAIPNPTNKEEFLLFRTDKHIKRLSQSAKLLLTEISEEYIFKALEEVIKRNKPEKPIYIRPFVYTSDLGIAPRLHNIETDFFIYCIELGDYLSPDGVSCRMSSWTRQEDRSLPLRGKISGAYITSSLAKTEASLSGFDEALLLNSSGKVSEASGMNLFIVRNGDLITPGVDQDILEGITRASVIELAKSFGINVIERPVDKTELLIADEVFLTGTAAKITPVKKIESTELNVERPIMNKLKSKLIEITEGRSQDYDNWVTRISLI

SEQ ID NO: 39723 - protein, 129 aa, Glycine max
MELARPASSRRKLKDLLLQSDNRLCADCNAPDPKWASANIGVFICLKCCGVHRSLGTHISKVLSVTLDDWSEDEIDAMMEVGGNASANSIYEAYIPEGYTKPGPDAGHEQRSKFIRSKYELQEFLKPSL

SEQ ID NO: 39724 - protein, 288 aa, Shigella flexneri 2a str. 301
MDVTAKYELIGLMAYPIRHSLSPEMQNKALEKAGLPFTYMAFEVDNDSFPGAIEGLKALKMRGTGVSMPNKQLACEYVDELTPAAKLVGAINTIVNDDGYLRGYNTDGTGHIRAIKESGFDIKGKTMVLLGAGGASTAIGAQGAIEGLKEIKLFNRRDEFFDKALAFAQRVNENTDCVVTDTDLADQQAFAEALASADILTNGTKVGMKPFENESLVNDISLLHPGLLVTECVYNPHMTKLLQQAQQAGCKTIDGYGMLLWQGAEQFTLWTGKDFPLEYVKQVMGFGA

SEQ ID NO: 39725 - protein, 252 aa, Shigella flexneri 2a str. 301
MKTVTVKDLVIGAGAPKIIVSLMAKDIARVKSEALAYREADFDILEWRVDHFADLSNVESVMAAAKILRETMPEKPLLFTFRSAKEGGEQAISTEAYIALNRAAIDSGLVDMIDLELFTGDDQVKETVAYAHAHDVKVVMSNHDFHKTPEAEEIIARLRKMQSFDADIPKIALMPQSTSDVLTLLAATLEMQEQYADRPIITMSMAKTGVISRLVGEVFGSAATFGAVKKASAPGQISVNDLRTVLTILHQA

SEQ ID NO: 39726 - protein, 292 aa, Magnaporthe grisea 70-15
MFNLRRLFVAAALFLGVMLSFTQTVAAVRGPKITHKVFFDMEHDGEPMGRIVMGLYGKTVPKTVENFRALATGEKGFGYKDSTFHRVIKDFMIQGGDFTKHDGTGGKSIYGDRFPDENFKLKHTKRGVLSMANAGQDTNGSQFFITTATTSWLDGRHVVFGEVLEGYDIVQKIEGVDKSPSDKPIKTVKIANSGELPVPEEAIYGFAEWASGVNDEPVDTPSPVADAKITHADKPATGAAATNEKIAESNEWSALQNAVFFGIIVGCIALYVRWTRTRDSKHRGLGYEKTLA

SEQ ID NO: 39727 - protein, 384 aa, Coprinopsis cinerea okayama7#130
MSQPGPAQAQAQAKKHGHAASVAQPAPRKVRFNVGTQYQVLDVVGEGAYGIVCSAVHRPSGRKVAIKKIAPFEHSMFCLRTLRELKLLKFLSEAGVSENIISILDIIKPPSLEAFKEVYLIQELMETDMHRVIRTQDLSDDHAQYFIYQTLRALKALHSADVIHRDLKPSNLLLNANCDLKVCDFGLARSVKTAEPSGTETGFMTEYVATRWYRAPEIMLTFKQYTKAIDVWSVGCILAEMLSGKPLFPGRDYHHQLTLILDVLGTPTLDEFYAITTRRSRDYIRALPFRKRKPFSQLFPNANPLAVDFLTRTLTFDPKKRITVEDALAHPYLEAYHDPDDEPVAPPLDPEFFEFDLHKDDISREQLKELLYEEIMSFKPAPIT

SEQ ID NO: 39728 - protein, 444 aa, Hibiscus cannabinus
NWLQVGDDLNHRNLTDLTKKFGDIFLLRMGQRNLVVVSSPELAKEVLHTQGVEFGSRTRNVVFDIFTGKGQDMVFTVYGEHWRKMRRIMTVPFFTNKVVQQYRHGWEAEAASVVEDVRKNPEAATNGIVLRRRLQLMMYNNMYRIMFDRRFESEDDPLFVKLKALNGERSRLAQSFEYNYGDFIPILRPFLRGYLKLCKEVKEMRLQLFKDYFLEERKKLASTTRSDNNALKCAIDHILDAQQKGEINEDNVLYIVENINVAAIETTLWSIEWGIAELVNHPRIQQKLRDEIDTVLGPGVQVTEPDTHKLPYLQAVVKETLRLRMAIPLLVPHMNLHDAKLAGYDIPAESKILVNAWWLANNPAHWKNPEEFRPERFFEEESKVEANGNDFRYLPFGVGRRSCPGIILALPILGITLGRMVQNFELLPPNGQSKIDTTEKGGQF

SEQ ID NO: 39729 - protein, 497 aa, Ashbya gossypii ATCC 10895
MSELFEEINVPETGFTYLQPLGLFIDNEFVAPMGGSQLQTTNPANGELIATFYAAGAADVDAAVAAARRAYEERWRHTSAQERGALLARLAELVDEEREVLAGIETLDSGKPYHTNALADLDQVAYVTRYYAGGADKMHQGDAFALSHTKQAYTLEVPYGVVAQIVPWNYPLAMASWKAQGCLAAGNCVVIKPSENTSLSLLYFASLVRRAGFPPGVFNVLPGLGPEVGQRLAEHKGVDKIAFTGSTAVGQKVMAAAAMSNLKDVTLECGGKSPAVIFADADLDSAVNYVAAGIFYNSGQNCTANSRIYVQEAVYDAFLDKFRAHVRSTYSFGSGLFSKDCNMGPVISKTQYDRVMGYINHGINEKLAYEQFGSVPEKGYYIPPTIFLDVPQSSRLCREEIFGPVAVVAKFKDYDEAIRYANDTNYGLASCVFTENIRVAHRFVRDVQSGTVWVNSSNDEEVGVPFGGFKMSGIGRELGKAGLQTYLQTKAVHLNFA

SEQ ID NO: 39730 - protein, 741 aa, Arabidopsis thaliana
MASTSSLALSQALLARAISHHGSDQRGSLPAFSGLKSTGSRASASSRRRIAQSMTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPDDVKSHWSRHTPEGATLESDWSAKFAAYEKKYPEEASELKSIITGELPAGWEKALPTYTPESPGDATRNLSQQCLNALAKVVPGFLGGSADLASSNMTLLKAFGDFQKATPEERNVRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPHLPGTSIEGVEKGGYTISDDSSGNKPDVILIGTGSELEIAAQAAEVLRKDGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 39731 - protein, 341 aa, Triticum aestivum
MSSSSSTPAFPPQEGDAETNEELYGQFTELASSWPCSGGLSRAKLLYRHEKGWYSTLPPMVGAMVADARFAARPSDIVVATMPKSGTTWMKALLYSTVHRREHTPGGPGHPFNSLGPHDCVRHLEYQLYTRNRVPDLDGLPDPRLLATHVPLASLPRSVAASGCRIVYVCRDPKDTLVSTWTFVNKFRAEDGLEPISVETAADYFCDGVSASGPYWDHVLGYWRAHLANPERVLFFRYEEMSRDPAAHVRRLAEFVGRPFSAEEEEDGAVDAVVKLCSFEHMTGLEATKSGKTELVLGAVENSSFFRRGLVGDWENHLSPETARRIDAITEAKFRGFGLSV

SEQ ID NO: 39732 - protein, 363 aa, Glycine max
MTQQNVVVSDTKSGVSLTVFSTTQKPPAAPGGYISIPRRRVLKNLEINGGQRINAWVESMRASSPTHHKSTPSLSQEHNSWILHHPSALDMFDQIIDASKGKQIVMFLDYDGTLSPIVDDPDRAFMSDSMRKTVRKLARCFPTAIVTGRCKDKVYNFVRLAELYYAGSHGMDIKGPTRSSKYNKDSKAEAILCQPASDFLPMIDEVYQQLVEKTKSTPGALVENNKFCLSVHFRCVDEKKWSELARQVKSVLKEYPKLRLTQGRKVLEIRPTIKWDKGKALEFLLESLGLANCSDVFPVYIGDDRSDEDAFKKLRDKGQGFGILVSKFPKDTSASYSLQEPNEVMNFLQRLVEWKHVSLRARS

SEQ ID NO: 39733 - protein, 511 aa, Prochlorococcus marinus str. MIT 9312
MTFVITTPLYYVNDKPHLGSVYTTIICDSIARYKRLVGEDVIFITGVDEHGLKIQRTANEKGIEPKSHCDEISEVFNINWKNWNISFDKFIRTSSKNHEFVVNEFYERVKSSDDIYMGVQKGWYCVGCEEFKDNPENSSTYKCPIHQKNLEWKNEENLFFRLSKYQKEIEKIINEPSFIEPIERKNEIINFVSRGLKDFSISRTNVSWGIPVPGYDNHTFYVWFDALLGYVSAISSDTSDNSLERSINGGWPADVHLIGKDILRFHAVYWPAMLISANMKVPKKVFGHGFLTREGQKMGKSLGNVLDPDLLLSKYGNDPVRWYLIKDISLGNDGDFQHKRFVDIINNDLANTIGNLLNRTSSMSRKWFGNKVPNNENIINENKLENYAKISVKNYIHNFDIYKLDLAANEVLSLAINTNLYLNDNQPWMLIKEIDNLPLVKEIIYNVLESTRIIGLLLIPILPELSTKINEQLGSIYRKEIPWKQQLKWGLLVSNSSLPKPSPIINKLEYE

SEQ ID NO: 39734 - protein, 221 aa, Hordeum vulgare subsp. vulgare
MDTVAAWPQFEGQDYMTVWPEEQEYRTVWSEPPKRRAGRIKLQETRHPVYRGVRRRGKVGQWVCELRVPVSRGYSRLWLGTFANPEMAARAHDSAALALSGHDACLNFADSAWRMMPVHATGSFRLAPAQEIKDAVAVALEVFQGQHPADACTAEGSTTPITSSDLSGLDDEHWIGGMDAGSYYASLAQGMLMEPPAAGGWREDDGEHDDGFSTSTSLWSY

SEQ ID NO: 39735 - protein, 232 aa, Brassica napus
  misc_feature (222)..(222): Xaa can be any naturally occurring amino acid
  unsure (1)..(232): unsure at all Xaa locations
LLKEHVMDAVDHDGLVADRSNTGRWTAAWFIIGVEVAERFAYYGIASNLISYLTGPLGQSTAVAAANVNAWTGISSLLPVLGAFVADAFLGRYRTIIIASLIYVLGMGLLTLSALLVPISENKEVVSASPSSLLNVLFFFSLYLVAIGQSGHKPCVQAFGADQFDEKDPREQRDRSSFFNWWYLSMSAGICLAIVVVVYIQEAVGWALGLGIPCVFMVISLXLFVVGRRSYR

SEQ ID NO: 39736 - protein, 277 aa, Bacillus cereus ATCC 14579
MKQLYGVIGNPIGHSLSPVMHNDAFEHLNMDAHYHAFLVEEELLGEAVRGLKALGISGFNVTTPHKVAIMEYLDEIDPLARKIGAVNTVVHKDGRLIGYNTDGIGFVRALQSISNEPLQGKRILLLGSGGASRAIYFSLADVGVKEIDVANRTVDKAKELIAARTADVNSVALSLEKATEEQGNYDIIIQTTTIGMHPHVEHTPLQICSLKKGTIVSDIIYNPFETKILCEAKEQGAIIQNGIDMFVYQGALAFEMWTGRTPNIERMKQLVIEKLGG

SEQ ID NO: 39737 - protein, 430 aa, Cryptococcus neoformans var. neoformans JEC21
MNYVQLEKLGEGTYATVYKGRSRTTSEIVALKEIHLDAEEGTPSTAIREISLMKELKHVNIVRLHDVVHTESKLVLIFEYCEQDLKRYMDIHGDRGALDLNTVKSFTHQLLQGIAFCHDHRVLHRDLKPQNLLINKRGELKIGDFGLARAFGVPVNTFSNEVVTLWYRAPDVLLGSRTYSTSIDIWSVGCIFAEMITGYPLFRGRDNADQLVQIMKIVGTPSDATIAQIKLNSPEIQIKSPLAKHAKQPFQAIIPRAPRDAISLLEHLLQFEPTRRYDAHQAMAHQYFTSGPIAPPTLHENNPAVSSASSLALPPRVAARASQASAAVQAQQAAQAQAQAQAQAQAQAQAAQNAQMMAQQQQQQQQQQQQQQQYEMMMGQQNMQGYYDPQAAAQMQAHQQAQAQAHAAQMQQMAQQGYYMNPNGQHGHHH

SEQ ID NO: 39738 - protein, 556 aa, Eubacterium acidaminophilum
MKTDVQIAQEAKMLPIMEVAKQIGLGEDDIELYGKYKAKISLDVYKRLADKPDGKLVLVTAINPTPAGEGKTTTNVGLSMGLNKIGKKTITALNEPSLGPCFGVKGGAAGGGYAQVVPMDDINLHFTGDIHAITTAHNLLAALMDNHIKQGNALGIDINKITWKRVLDMNDRALRDIVIGLGGTANGIPRQDGFDITVASEIMAIMCLATSLSDLKDRLSRMIVGYTSRRLAVTADSLTLRGALALLLKDALKPNLVQTLENTPAIIHGGPFANIAHGCNSVTTTKTALKIADYVVTEAGFGADLGAEKFFDIKCRFADLKPDVAVIVATVRALKNHGGVAKANLGAENMKALEDGFGNLERHIENVHKFGVPAVVAINAFPTDTEKELKFVEDACRKLGADVVLSEVWAKGGEGGVELAKKVVEVTEKGAAKFKPLYPAEMPLKQKIETIAKEIYRADGVEFSAKASKELDKFEKLGFGNLPICVAKTQYSFSDNPNLKGAPKGFTVSVSNARISAGAGFIVVLTGDIMTMPGLPKVPAANHMDVLESGEIVGLF

SEQ ID NO: 39739 - protein, 356 aa, Synechococcus sp. WH 7805
MPKVLALETSCDESAAAVVEQRADRLMVLSHRIASQVEEHAQWGGVVPEIASRRHVEALPHLIGAVLDDAGQAVADMDAVAATVTPGLVGALMVGSVTGRTLAALHGKPFMGVHHLEAHLASVRLASSPPEPPYLVLLVSGGHTELILVGIDGGLQRLGRSHDDAAGEAFDKVARLLGLAYPGGPAIQMAAREGDPKRFSLPKGRVSRPEGGFYPYDFSFSGLKTAMLRQVESLRAQSDVLPLEDLAASFEQVVVDVLVERSLRCCLDRGLSTLVMVGGVAANVRLREQMERRGREHGVCVHLAPLEFCTDNAAMVGAAALGRLQSGWGASSIRLGVSARWPLERGGDLFTQDPQF

SEQ ID NO: 39740 - protein, 346 aa, Acidobacteria bacterium Ellin345
MERLGQPAYRSRQLWQGLYRDRIASLDQFTTLPIPLREELKSSGWAIAFPFVQKRFTSTDGTVRYLLQFSDGQSVETVWMPEGDGGEQGDGSEDGPSYDRATICVSSQVGCAVDCQFCMTALLGLLRNLSAGEIVGQILAVLKDENVDVEKSRINLVFMGQGEPFLNFDNFVKAVTLLAEAVGIPESRMTVSTSGIVPRIVDFGQLAIRPKLAISLNASNDESRRELMPITKKWTLEKLMSAAREFPLRNRERMTFEYVLLGGVNDSEQNAREVVQLLRGLRAKVNLIAWNPGPEIPFSTPDPQHVEAFQQILIDAGIPTFIRKPRGRDIFAACGQLKRTELVTLS

SEQ ID NO: 39741 - protein, 475 aa, Synechococcus sp. WH 5701
MTTIADPATSPEAISVADHDRFDLVVIGAGSGGLAAAKRAASHGARVAVIEGHRVGGTCVIRGCVPKKLLVYGSAYRHLLADAASYGWSVGQTHCDTSQLLAAVRAEVDRLNGLHIGFLESAGVELVKGWGRFLDAHHIEVGVAEGKGSSDRSRRLLRGERVLIAVGGRPHRPSFPGAELGWVSDDMFLLERLPQRVLIVGGGFIACEFACILRGLGVEVDQFVRGDHLLRGFDRELSAAVHEGMEADGITIHMAQTLSAIAGEPGELIATTCQGRQERCGGVLLATGRQPYLAGLDLAAAGVGVDGGSITVDADQRTNVPHIFAVGDVTDRINLTPVAVDEGRAFADSVYGGQARQVNHDLVASAVFSQPELASVGLSEEQALARFGPDGVRLYRARFRSMAQALPKRGPRCLLKLVVEVASGRVLGCHMVGEHAAEIIQMAAIAIGMGATKADFDRTMALHPTVAEEFVTMPQ

SEQ ID NO: 39742 - protein, 627 aa, Listeria monocytogenes str. 4b H7858
MAYALWSRVLNTNPKNSHWFNRDRFVLSAGHGSMLLYSLLHLSGFKLELEDLKNFRQWESKTPGHPEYRYTDGVDATTGPLGQGIAMAVGMAMAERHLEAKYNKDGFPVVDHYTYALCGDGDLMEGVASEAASYAGHQQLGRLVVLYDSNDISLDGDLDKSFSENVKQRFEAYGWEHLLVKDGNDTAEILAAIEKAKQNTSQPTMIEVKTVIGFGAPNAGTSKVHGAPLGDEGILEAKKAYGWNYEEKFFVPEEVTARFKETIGERGEKAETAWNELFASYKAEYPELAKQLEDSLNNKLPADWDEDLPVYDDSKALASRASSGEVINALAGKIPTIFGGSADLAGSNNTTIKTDGEFTKATPAERNIWFGVREFAMGAALNGMALHGGLQVYGGTFFVFSDYVRAAIRLSAIQHLPVTYVMTHDSIAVGEDGPTHEPIEQLASLRAMPGLSVIRPADGNEVVEAWKLAITSTSTPHVLVLTRQGLPTLPNSAKLTAEGVKKGAYVISPAKGDVPEAIILASGSEVNLAIEAQKELQAQGTDVSVVSVPSFDLFEQQSAEYKESVLPNAVRKRVAVEMGASFGWERYVGLDGKVIGIDKFGASAPGETVIKNYGFTVENVVNTVKSL

SEQ ID NO: 39743 - protein, 568 aa, Clarkia gracilis
MASPALISETEAWKDLKAHLEGIKRTHLRELMGDTERCQSMMVEFDNIFLDYSRQQASPDTINKLYNLADAAHLKQKIDRMYNGDHINITENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDTINAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEGFNFSTKTLLTRYLEATSDVPADPSTLLPNI

SEQ ID NO: 39744 - protein, 820 aa, Zea mays
  misc_feature (334)..(334): Xaa can be any naturally occurring amino acid
  unsure (1)..(820): unsure at all Xaa locations
SKTRLVTHSTRTHYLIGQSQTNWAPSPPLPLPMAQQLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLCLFAPGDLKADRVTEEVPLDPLLNRTGNVWHVFIHGDQLHGMLYGYRFDGVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINXCSLGCSMQWKLENVGVALLSVVYMRMSVCEKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTKFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 39745 - protein, 782 aa, Coccidioides immitis RS
MEIICRLLAGVRSGGEFCNHYHISLNLEITIAGVYEASPNQPASAGPDRSNSASSPHSALDVSTTTNPPSPRYSAAELLSLLRYPPEPTTRRSHLRRRREPSTERADIQGGTSRSSGLGNSRGGRIPPEGSSEQAQGQEQDDRPLSKRRRLENDNMKPDGGASASSTNGFSPASNGTGSSPFRKSITSNAISGRSSNSYSQAQPQTNGSTEPSLPRTYYGHDREEVTRILIQSLYDLGYSEAAATLSRESKYELESPAVAALRTSVLEGQWLEAETILLSSFFEGVENVADGKHAVGQPRHQGLVLAEGADRNEMLFSLRQQKFLELLENRDLAAALMVLRQELTPLNHDIARLHSLSSLLMCPPENLRVQAGLEDSVIDSRRKLLAELSKSISPSVMIPGHRLATLLDQVKQNQINRCLYHNTAEPPSLYSNHMCDRSQFPTQVTLELNQHTNEVWYLEFSHDGTKLATTSSDRSVIIYDTRTFGVIHKLTDHGGPVAFATWSPDDTKLISCSQDCKARLWDVETGRCLLTIDHHREPVTSAAWAPDSESFVTCSLDNKSQLCLWSVHGDPLYTWAGSSRIRDCAISPDGRRLIAISTDRRIHVYNFPTREEEYSMRLDLDLTCINISSDSRYMLVNMSEGEVQLLDIETKDVVRQYSGQKQGNFIIRSTFGGAAENFVVSGSEDSRIYIWHKENCMLVETLEGHAKGCVNAVAWNPKDPGVFASAGDDRKVKIPFYKRKRGPQKGSPNTRIPKSTSWITYAYFYDSSFHMRDIIGAHGLG

SEQ ID NO: 39746 - protein, 282 aa, Methanocaldococcus jannaschii DSM 2661
MINAKTKVIGLIGHPVEHSFSPIMHNAAFKDKGLNYVYVAFDVLPENLKYVIDGAKALGIVGFNVTIPHKIEIMKYLDEIDKDAQLIGAVNTIKIEDGKAIGYNTDGIGARMALEEEIGRVKDKNIVIYGAGGAARAVAFELAKDNNIIIANRTVEKAEALAKEIAEKLNKKFGEEVKFSGLDVDLDGVDIIINATPIGMYPNIDVEPIVKAEKLREDMVVMDLIYNPLETVLLKEAKKVNAKTINGLGMLIYQGAVAFKIWTGVEPNIEVMKNAIIDKITK

SEQ ID NO: 39747 - protein, 623 aa, Gibberella zeae PH-1
MADAPNSGDELYPIAVLIDELKHDDVLLRLNAIHRLSTIALALGAERTREELIPFLDESVEDEDEVLVALSEELGGFVEYVGGSQWGHVLLSPLENLAAIEEPVVRDKAVESLNKICSELSPQQVEEYFIPLTIRLAKADWFTSKVSGCGLFTTPYNKVSPPVQEQLRQQFGLLVHDETPMVRRQAATNLAKFVKEMPATIVVDEMIPLFQHLAQDDQDSVRLLTVEVLISIAEAVPKEQQASHGVLLTALRNLIEDKSWRVRYMIADRFEKIAKAVDEEVVSRDLVPAFVKLLKDNEAEVRTAIAGQIPGFCALVDRNVLLNDIMGSIEDLVSDTSQHVRAALGTQISGLAPILGKQETIDHLLPMFLQMLKDEFPEVRLHIISKLELVNQVIGIDLLSQSLLPAIVQLAEDKQWRVRLAIIEYIPLLASQLGVQFFDEKLSNLCMGWLGDTVFSIREAATHNLKKLTEVFGVEWASEAIIPKVMAMGNHPNYLYRMTTCFAISTLASVVSMDVIAKSILPMLDKLVSDDIPNIRFNVAKTYRVLISVLRRLPDEGTLYDLEKQGSEITPSPRGSELIQERVVPNLEKLQKDDDVDVRYFATTAAAEISGPIAGGEPMNTSP

SEQ ID NO: 39748 - protein, 958 aa, Ashbya gossypii ATCC 10895
MTMEVPLINGTNSVVVTAYSREQYAQCMQFYSAMLRLETLTKGENETVLTNKAVSVRVKYEEDKSRDQEARERREALAAAATTHDWRGEASTVVFSTVDVAKVRQTLGLCQAYPSELAPLEVYTLDPQGNVVGFTQTKNAISTFTNVPSVVGPRHARDSMTVSSAGSSTDLRSFGLDTTAHYPSLPKKSVAGDRKAIAVMTSGGDAPGMNANVRAIVRSVIFKGCRAFTVMEGYEGLVRGGPEYIKECKWEDVRGWSTEGGTNIGTARCMAFRERSGRLLGAQHLIEAGVDALIVCGGDGSLTGADLFRSEWPSLIQELLETGKITQAQYDRYRHLNICGTVGSIDNDMSTTDATIGAYSSLDRICQAIDYLEATAKSHSRAFVVEVMGRNCGWLALMAGIATSADYILIPEKPASSREWQDQMCDIVSTHRSRGKRTTIVIVAEGAIAADLTPITPKNVHQVLVDRLGLDTRITTLGHVQRGGSAVAFDRILATLQGVEAVNAVLESTPDTPSPLIVLNENKIMRKPLMESVALTKSVADAIQAKDFKKAMGLRDPEFVEHLNNFMAINSADHDEPKLRGEKRLNIAIVNIGAPAGGINSAVYSMANYCLSQGHKPFAIYNGWTGLARHESVRTLNWKDMLGWQSRGGSELGTNRTVPEDADIGMIAYYFQKYKFDGLVIVGGFEAFVSLHQLERARENYPAFRIPMVLIPATLSNNVPGTEYSLGSDTALNALMEYCDVVKQSAASTRARVFVVDVQGGNSGYLATHAALAVGAQVSYVPEEGISLEQLSQDIETLRESFEKAHGKGKHGKLILKSTNASKVFTTAVLADVITAEAKGDFDAKSAVPGHVQQGGLPSPIDRTRGTRLAVRAIGFIEAKQDVIREARENEEAFDCADKAVSHTAAVLGITGSQLKFTSIRQLYDLETEFSKRMPKVIHWEPTRAIADHLEGRKRVTV

SEQ ID NO: 39749 - protein, 609 aa, Gibberella zeae PH-1
MPTISVDKYKLYEALGQKFTTEEFEDLCFEFGIELDEDTENDERPIVNGEQEPPQLKIEIPANRYDMLCFEGIVSNLNVFRGKTEPPKYRLVDPSSGKLESITVKPEAEQVRPYVSGAILRNIKFDKSRYESFIALQDKLHQNLARNRTLVSIGTHDYDTIKGPFTYEALPPKDIKFTPLNQTKEMDSAELMSFYENDKHLGRFLHIIRDSPVYPAIYDSNRVVCSLPPIINGDHSKITLDTTNVFIEITATDLTKLDIVTDIMVTMFSMYCSEPFTVEPVQINSDHNNQTRITPNLKPRVAEVEIDYLNSCTGLNESPESLCKLLSKMSYTSTPSSKDANILEVAIPPTRADVLHQCDVMEDLAVCYGYNNLPRTAPSRSATVGAPLPVNKLSDIIRIETAVAGWSEVMPLILCSHDENFAWLNRKDDGNTVVRLANPKTAEYQVVRSSLLPGLLKTIRENKGHSVPMKIFEVSDVVFKDETQERKARNERHFAAAWYGRTSGFEVVHGLLDRILLMLRTSFLTHEEGLSGKSIDFEVKENPSKPDGYWIEELDDATFFAGHAASVYLRLGGKERRVGEFGILHPSVLEKFDLKYPVSTLEINLEVFL

SEQ ID NO: 39750 - protein, 304 aa, Oryza sativa (japonica cultivar-group)
MAAPSSLASSHLSRLADLRRAGVAAAAPAHPQQLRLGCSRRRAQRVVAMAGSGKFFVGGNWKCNGTKDSVSKLVTELNAATLEPDVDVVVAPPFIYIDQVKNSLTDRIEVSAQNVWIGKGGAYTGEISAEQLVDIGCQWVILGHSERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKGPDFATIINSVTSKKVAA

SEQ ID NO: 39751 - protein, 356 aa, Glycine max
MNSTPANLESSLSVPSVQELAFQRPEKVPARYIRDQDGDGIIATYPSHPSLRVPFIDMAKLVNADTHQKEELRKLHLACKDWGVFQLVNHGLSNSSLKNMGNQVKRFFELPLQEKKRWAQRPGTLEGYGQAFVTSEDQKLDWNDMIFLKCLPIQNRKLDLWPQNPPEFRETLERYSEEIREVTMSVVKFLTMSLGIQDKEISESFREGLYDIRMNCYPPCPEPERVLGIAPHADNSGITLLLDCADFPGLQFLKDKKWVNVEPIEGAIVVNIGQIIEVMSNGIYKAPEHRAVVNKLKERFSIVTFCYPSPHMDIGPADKLTGEGKVAVFKKLTHAEYFRKFFNRDLDESFIDSLRV

SEQ ID NO: 39752 - protein, 339 aa, Cryptococcus neoformans var. neoformans JEC21
MVVKVGINGFGRIGRIVLRNAIEHGDLEVVAVNDPFIDLDYMVYMFKYDSTHGRFKGSVEVKDGKLYINNKAIAVFGEKDPANIKWGEAGAEYVVESTGVFTTTEKAGVHLKGGAKKVVISAPSADAPMFVCGVNLDAYKPEYQIVSNASCTTNCLAPLAKVIHDNFTIIEGLMTTVHATTATQKTVDGPSHKDWRGGRGAAANIIPSSTGAAKAVGKVIPSLNGKLTGMSFRVPTSDVSVVDLVCRIEKGASYEEIKNVIKKASESPELKGILGYTEDAVVSTDFIGSTESSIFDAQAGIALNANFVKLVSWYDNEYGYSRRVCDLISYIAGVDAKAQ

SEQ ID NO: 39753 - protein, 548 aa, Oryza sativa
MEIVDGASPPLHPWSLLLYALGALAALWWAWRALDRFWLRPRRLGRALRSQGLRGTDYRFPSGYLKEFARLLAAALAAPMPPLSHDVASRALPFELAAIKQHAAYTHAPANVRDQTEVAWNAGNVCVTWFGPEVRVIVSDPKLFREILANKNGRFGKQKSILWVQNLLADGLTSHQGEKWVAHRRIMNHAFHLEKLKRMLPAFAACSSELISRWQDSVGADGAQEIDVWPEFQNLTGDVISRSAFGSSFSEGRRIFQLQSEQARNVMKMAKALYFPGYRFLPTELNRRTKANAREVRELLKGIITKRESAMKDGHAVNDDLLGLLLETNIKESQEAGSSKPTMTTKDIIEELKLLYFAGSDTTAVLLTWTMVLLSMHPEWQDRAREEVLRVFGKNSPDFEGINHLKVVTMILHEVLRLYPPILLLGREAYEETELGGVTYPPGVTFALPIAGIHHDPDVWGEDVGEFKPERFAEGVSRASKDSPALVPFSWGPRICVGQNFALLEAKMALSMILQRFSFGLSPSYTHAPFPIPTLQPQHGAQIKLTKL

SEQ ID NO: 39754 - protein, 1202 aa, Arabidopsis thaliana
METIGDIWFTRSRSENRRIHQIGDLSYWLLQSVSHEEDRVIENNEGLPPALLGSCNDLARQPHASPGFVNLLTSQQEVHTLETNPCDDVPIFSTQCTDSPSLEEHVPKVKRERMKWSAKEDMVLVSSWLNTSKDAVIGNEQKANTFWSRIAAYYDASPQLNGLRKRMQGNIKQRWAKINDGVCKFVGSYEAASREKSSGQNDNDVISLAHEIFNNDYGYKFPLEHAWRVLRHDQKWCSQASVMSKRRKCDKAAQPSTSQPPSHGVEEAMSRPIGVKAAKAKAKKTVTKTTTVEDKGNAMLEIQSIWEIKQKDWELRQKDREQEKEDFEKKDRLSKTTLLESLIAKKEPLTDNEVWFGQNHMQIISPFQFGFQLYSLRPVPDITRRSINRPSQPSLTIGMELHVLIMVGEWIYKEEGWKFEAEKGSFGRCVRIIDTTTYTDLASPICDVFSYKFSEWNPIISYWMPGKMSDMIASNRPPVYIENQISLDTFMLIRNGDPSVNLFVSFYPIGNGGHTETEVTNVDAAHNFYEDINVDEEDDIDEGDEDEYEDEDNEEDEDMDVHDDDTDGESRGSTLDPTVDDSEGSGEDYDYNKWGDMIVEQYGNGHVEEGVVNDTQQTVEPPGELTRLLASCTSTGTHVPHVEPTGVLVDCTPTSALSPTCQHGLYQCTYTRVCAEETRCEGELVEHTDDIAENVTGDDGIVVLEGVSASGLNIESDDRLVTTGEAYKVYKGFSTLHNAENELLDTDAAPVFDDLANVRVDETEVELSTSGYDSIHVCKIETRKDYRKHATYKLLGEVMKNRYSSSQGGPRAVDLPQLVLNGLNVRISYSTAWRAREVAVNSIRGDDMASYRFLPTYLYLLQLANPGTICHLHSTPEDKGRQRFKYVFVSLSASIKGWKCMRKVVVVDGTQLVGRYKGCLLIACAQDGNFQIFPLAFGVVDGETDASWIWFFEKLSEIVPDTDDLMIVSDRHSSIYKGVSVVYPATKAYRIRDFEKYFEELRGRSPGCAKYLEDVGFEHWTRAYCKGERYNIMTSNNSEAMNNVLSKAKAYPIVYMLEFIREVIMRWFAARQKKVSKCNSLVTPEVDERFLQDLPASGKFSVMMSGPWSYQVTSKTGEHFHVVLDECTCTCLRYTILRIPCENALAAAIHFGINPKVVVGLWYSLQVFSDSFQEPVLPIPDPKDVVIPQELSDLILIPPRSR

SEQ ID NO: 39755 - protein, 630 aa, Cryptococcus neoformans var. neoformans JEC21
MVDTQYAFRAQKTAGVADAPAWEVSNRIPAETVGSKCYAYSPNGEWLAYAMNNCVEIIPSHSSSPTPVTLQQANIVALKFSPMSSYLFTFERPVKTESGEMYKNAKAWDVKNGEIVGGWYQKTMEDWEPIITPNETHLLRAGPSDLAIFSPPFAPRPSTRLKIEGIRGIFISDPSALPATSTNSRPIPAYHEPAVAIWIGEKKGAPASLGLWSLSSLMGKNALQANGNGDIQTETRDMPPTTARKAFYKADKLTVKWNNAGTMALFLAQSDVDNSGKSYYGETNLYLVGLDGTFDGLVELDKEGPIYDFAWSPISREFTVCYGYMPARTQMFDLKAKPVYSFGENPRNTLVYQPQGKLLLSAGFGNLAGGIDIWDVSTRNKVAEFKASNASHCEWSPCGRYVLTATLSPRLRVDNGVKIWWCNGQLLHIQPVEELYQASFAPQRVTEIGSFPAIVPKAPEANPSVAAYRPKGETDGVAAKPAGAYRPPGARNRPEGENASASFGSSRGKPGVRTVPGAGGRQPPGSAPGASTGAGGDDKKKRQRKRGGKDKEEEKKDEAPTQEAVKPEVKEEAGEDAVAKKIRNLMKKLKAIDELKTKLAAGEILEKTQLKKIESEAQVKSEIKALGGNV

SEQ ID NO: 39756 - protein, 741 aa, Oryza sativa (japonica cultivar-group)
MVRSGSVRRTAASSSPAAAAVPTAFTASPGDYRLLEEVGYGANAVVYRAVFLPSNRTVAVKCLDLDRVNSNLDDIRKEAQTMSLIDHPNVIRAYCSFVVDHNLWVIMPFMSEGSCLHLMKVAYPDGFEEPVIASILKETLKALEYLHRQGHIHRDVKAGNILMDSPGIVKLGDFGVSACMFDRGDRQRSRNTFVGTPCWMAPEVLQPGAGYNFKADIWSFGITALELAHGHAPFSKYPPMKVLLMTLQNAPPGLDYDRDKRFSKSFKEMVAMCLVKDQTKRPTAEKLLKHSFFKNAKPPELTVKSILTDLPPLWDRVKALQLKDAAQLALKKMPSSEQEALSMSEYQRGVSAWNFDIEDLKAQASLIHDDDPPEIKEDVDNDRINEADKEPFSGNHFGQPKILSGKHFSEQTCVTAVSPGGNMHETSRGLVSEPGDADSERKVDGYRKQGSENESLPSTSKHDSEGQNSSSEVKQKERTCSGPILCSGVHNKSITESSRIFDREAAVKLASDKQKSCTKRTTNLSGPLALPTRASANSLSAPIRSSGGYVGSLGDKSKRSVVEIKGRFSVTSENVDLAKVQEVPTSGISRKLQEGSSLRKSASVGHWPVDAKPMSNSHQRKELCNGSVSASVLIPHLRNLVQQTTFQQDLITNLLSSLQQNEKADATQYRLGNMDGDTEVETSISEGERSLLVKIFELQSRMISLTDELITTKLQHVQLQEELKILYCHEEIIDTREVDNA

SEQ ID NO: 39757 - protein, 164 aa, Synechococcus sp. WH 7805
MAADPNDTSAKESATATTDGAVENNGADTAVAESTKESSPTVSTVRLKPAELIREFETAQLKTDLPEIYVGDTVRVGVRISEGNKERVQPYEGVVIAKRHGGLNQTITVRRIFQGIGVERVFMLHSPQVASIKVERRGKVRRAKLFYLRERVGKATRVKQRFDR

SEQ ID NO: 39758 - protein, 474 aa, Hypocrea jecorina
MALNLTSSARALRSFKPYTRAALLANAARCYSTAEPDLKTTLKSVIPEKRELLKKVKAHGSKVIGEVKVENTIGGMRGLKAMVWEGSVLDPNEGIRFHGRTIKDCQKELPKGKTGTEMLPEAMFWLLLTGQVPSVNQVRQFSRELASQTQIPAFVNRMLDDFPKDLHPMTQFAIAVSALNYESKFAKAYEKGLAKADYWEPTFDDSISLLAKLPTIAAKIYQNSYRGGGALPAEVDLEQDWSYNFAAMLGKGGKENEDFQDLLRLYLALHGDHEGGNVSAHATHLVGSALSDPFLSYSAGLQGLAGPLHGLAAQEVLRWILQMKEAIPANYTEQDVHDYLWSTLNSGRVVPGYGHAVLRKPDPRFEALMDYAASRPAIAKDPVFQLVEKNSRIAPEVLKKHGKTKNPYPNVDSSSGVLFHHYGFHETLYYTATFGVSRGLGPLAQLIWDRALGLPIERPKSINLEGILKQVESS

SEQ ID NO: 39759 - protein, 155 aa, Kineococcus radiotolerans SRS30216
MAASCHPRRAAPRGGGETMTGVSSSPPPATGPATVPPLDPALAARLKRTDTGLVCAVVQQHDTREVLMVAWMDDEALASTLATGRATYYSRSRRSLWRKGDTSGHVQWVKRVSLDCDGDALLVEVDQVGAACHTGDRTCFDASPLPVRVGSRAEA

SEQ ID NO: 39760 - protein, 438 aa, Methanocaldococcus jannaschii DSM 2661
MKIMFLGNDTVEIKDGRFFIDGYDAIELAEKFGTPLYVMSEEQIKINYNRYIEAFKRWEEETGKEFIVAYAYKANANLAITRLLAKLGCGADVVSGGELYIAKLSNVPSKKIVFNGNCKTKEEIIMGIEANIRAFNVDSISELILINETAKELGETANVAFRINPNVNPKTHPKISTGLKKNKFGLDVESGIAMKAIKMALEMEYVNVVGVHCHIGSQLTDISPFIEETRKVMDFVVELKEEGIEIEDVNLGGGLGIPYYKDKQIPTQKDLADAIINTMLKYKDKVEMPNLILEPGRSLVATAGYLLGKVHHIKETPVTKWVMIDAGMNDMMRPAMYEAYHHIINCKVKNEKEVVSIAGGLCESSDVFGRDRELDKVEVGDVLAIFDVGAYGISMANNYNARGRPRMVLTSKKGVFLIRERETYADLIAKDIVPPHLL

SEQ ID NO: 39761 - protein, 583 aa, Oryza sativa (japonica cultivar-group)
MAARRAASSLLSRGLIARPSAASSTGDSAILGAGSARGFLPGSLHRFSAAPAAAATAAATEEPIQPPVDVKYTKLLINGNFVDAASGKTFATVDPRTGDVIARVAEGDAEDVNRAVAAARRAFDEGPWPRMTAYERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFRFATLEFPRIPSDRDRLSTGIYTNTLRAMCSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 39762 - protein, 408 aa, Methanocaldococcus jannaschii DSM 2661
MDAIILCAGKGERLRPLTENRPKPMIPIAGKPILQHIIEKVEDLVDNIYLIVKYKKEKIVDYFKNHPKIKFLEQGEIDGTGQAVLTAKDYVDDEFLVINGDIIFEDDLEEFLKYKYAVAVKEVKNPENFGVVVLDDENNIIELQEKPENPKSNLINAGIYKFDKKIFELIEKTKISERGERELTDAIKHLIKEEKVKGIKLNGYWNDVGRPWDILEANKYLLDKINTDIKGKIEENVVIKGEVIIEEGAIVKANSVIEGPAIIKKGAVVGPLAYIRPYTVLMENTFVGNSSEVKASIIMKNTKIPHLSYVGDSIIGENCNFGCNTITANLRFDDKPVKVNIKSKRVESVRKLGVIMGDNVKTGIQVSFMPGVKVGSNCWIGASCLIDRDIESNTFVYKRDELIFRKLK

SEQ ID NO: 39763 - protein, 100 aa, Triticum aestivum
  misc_feature (39)..(39): Xaa can be any naturally occurring amino acid
  misc_feature (68)..(68): Xaa can be any naturally occurring amino acid
  misc_feature (70)..(70): Xaa can be any naturally occurring amino acid
  misc_feature (74)..(74): Xaa can be any naturally occurring amino acid
  misc_feature (79)..(79): Xaa can be any naturally occurring amino acid
  misc_feature (85)..(85): Xaa can be any naturally occurring amino acid
  misc_feature (88)..(88): Xaa can be any naturally occurring amino acid
  misc_feature (90)..(90): Xaa can be any naturally occurring amino acid
  misc_feature (96)..(97): Xaa can be any naturally occurring amino acid
  unsure (1)..(100): unsure at all Xaa locations
SSATTAAPFQGLKSTAGLPVSRRSCSAGLSSVSNGGRIXRCMQVWPIEGIKKFETLSYLPPLSKEALXKXVDYXIRSSXVPASNXTKXGXSSGEQXXSPR

SEQ ID NO: 39764 - protein, 543 aa, Zea mays
MEEAHLTPATPSPFFPLAGPHKYIALLLVVLSWILVQRWSLRKQKGPRSWPVIGATVEQLRNYHRMHDWLVGYLSRHRTVTVDMPFTSYTYIADPVNVEHVLKTNFTNYPKGIVYRSYMDVLLGDGIFNADGELWRKQRKTASFEFASKNLRDFSAIVFREYSLKLSGILSQASKAGKVVDMQELYMRMTLDSICKVGFGVEIGTLSPDLPENSFAQAFDAANIIITLRFIDPLWRIKRFFHVGSEALLAQSIKLVDEFTYSVIRRRKAEIVEVRASGKQEKMKHDILSRFIELGEAGDDGGGFGDDKSLRDVVLNFVIAGRDTTATTLSWFTHMAMSHPDVAEKLRRELCAFEAERAREEGVTLVLCGGADADDKAFAARVAQFAGLLTYDSLGKLVYLHACVTETLRLYPAVPQDPKGILEDDVLPDGTKVRAGGMVTYVPYSMGRMEYNWGPDAASFRPERWINEDGAFRNASPFKFTAFQAGPRICLGKDSAYLQMKMALAILFRFYSFRLLEGHPVQYRMMTILSMAHGLKVRVSRAV

SEQ ID NO: 39765 - protein, 373 aa, Oryza sativa
MGGNPAMRAGLALVVVVVAVVVGDVGAALPRFAEAPDYRNGEGCPAAVAGAGVCDPGLVHIAMTLDAHYLRGSMAAIYSLLKHASCPESIFFHFLAAADGGEGCGGGVGELRTAVAASFPSLRFEIYPFRADAVTGLISASVRAALEAPLNYARNYLADLLPKCVPRAIYLDSDVLAVDDVRRLWETRLPAAAVVAAPEYCHANFSRYFTETFWSDPQLGDRVFAGRRRAPCYFNTGVMVIDLRRWRVGNYRRRIEVWMELQKEKRIYELGSLPPFLLVFAGEVEAVDHRWNQHGLGGDNVLGSCRPLHKGPVSLMHWSGKGKPWDRLDAGKPCPLDHTWKSYDLYIAEGDSSSASAPFALSSSALPAAAFSW

SEQ ID NO: 39766 - protein, 559 aa, Cryptococcus neoformans var. neoformans JEC21
MSSMSTADQQVWKKVLAAKNKNMSLTQIEASFPTMSKKAVMSSVTTLLKLRLLSQVKGKGDDKAMVYHAQTPEEAKQKATLTQEQSIILSIIRSAGNRGIASAQITRTIGTDTMPISMLRKVLKTLESEGHIKQFKPVNAPTSVYYILAHLKLPEEISGGVWFDDNKEYDQGLVETICAVLLNRVRTATYVDDKKRSQEAKSLVPNALNTSSKYYSLLTPMALRTYVNKLGVTSATLSVKNVMECMRALELDGLVEVVKPVGGVHLQEESDDESTARSSKRRKVESDSEDEDRDKEREKAKMKAKEKAKMKKRREREKERERKEKERERKRKEKEKERERRKKEKEKERKRKEKERGKKKKKVYGSDNEDSDDVLLSINDDGKKKRSRSLSISSVSSISSSSSSSSESHSDSDSGSSISSVASSQLDTSSIPFRPSAAATASASTPAQIIPGGLSGGLTDLTDTAIIYRATSRISIPLGQTQAPCGKCPVFHFCEEDGPVNPTGCEYYGEWLGDSVGGWEKEALRKMRPGWADNEDDKEKEKTREAEVNGNGDVVMEDY

SEQ ID NO: 39767 - protein, 555 aa, Euglena gracilis
MAYQSFTNQTKKVEGNSPLWAVAAGAFAGLCVVLLANQSATSLHSSVAVPTTPIVAQNTVTSYQAPLAHNAQVTQLKSQVSSDKSLEVSTAANSSVLVGVSGGLLLIAGMFFNILKKPSKQALPLPAPLQSVSVPASSQMVRLVTGMADAHTSVALMAVTAEKKKAVGIRSPVFNETCDQTGITLSRFMLEVARANPDLQELESVFASIQTACKTIAKLVKRSAIDGMTGLQAGGGAVNVQGEEQKKLDVITNDVLKRALKFTGRMGVIASEEEDVPVEVDNTMDESYGKDVLVEESGGRYISVFDPLDGSSNVDAGIPVGTIFGIFEEDDDCKLADNFFDDKTDISEAMKGCLRSTLKPGNSLVAAGYALYSSATHFVFTLGAGVNGFTLDESIGEFILTHPNIKIPPRGKIYSINEANRDIWDAPVQDFIQGLASGNNRGKKVYTSRYIGSMVGDVHRTLLYGGVFGYPADTRSPNGKLRLLYEAAPMSFLIEQAGGKSTTGLVRVMDIPPKSVHQRVPLMLGGADEMDELIELYNAKADAALKKSQLDRLAV

SEQ ID NO: 39768 - protein, 450 aa, Salmonella enterica subsp. enterica serovar Typhi str. CT18
MTKHYDYIAIGGGSGGIASINRAAMYGQKCALIEAKELGGTCVNVGCVPKKVMWHAAQIREAIHLYGPDYGFDTTINQFDWSKLIASRTAYIDRIHTSYDNVLGKNNVDVIKGFARFVDAKTIEVNGETITADHILIATGGRPSHPSIPGVEYGIDSDGFFALSALPERVAVVGAGYIAVELAGVINALGAKTHLFVRKHAPLRSFDPMISETLVEVMNAEGPQLHTHAVPKAVVKNADGSLTLELEDGRSETVDCLIWAIGREPSTDNINLAAAGVKTNEKGYIIVDKWQNTNVEGIYAVGDNTGAIELTPVAVAAGRRLSERLFNNKPDEHLDYSNIPTVVFSHPPIGTVGLSEPQAREQYGDEQVKVYKSSFTAMYTAVTTHRQPCRMKLVCVGPEEKIVGIHGIGFGMDEMLQGFAVALKMGATKKDFDNTVAIHPTASEEFVTMR

SEQ ID NO: 39769 - protein, 457 aa, Oryza sativa (japonica cultivar-group)
MEVFYYLVFGGLAAVVAGLELGKSAKDRVTTSQAFNSFKNNYVLVYSLMMSGDWLQGPYVYYLYSQYGFDKGDIGRLFIAGFGSSMLFGTIVGSLADKQGRKRACITYCISYILSCITKHSPEYKILMIGRVLGGIATSLLFSAFESWLVAEHNKRGFDSQWLSITFSKAIFLGNGLVAIVSGLFANLLADNLGFGPVAPFDAAACFLAIGMAIIMSSWSENYGDPSESKDLMSQFKVAAKAIASDEKIALLGAIQSLFEGSMYTFVFLWTPALSPNEEDIPHGFIFATFMLSSMLGSSIAARLLARKLKVEGYMQIVFTISAFTLFLPVVTNILVPTSSVKGGSISFGGTLQLLGFCTFEACVGIFWPSIMKMRSQYIPEEARSTIMNFFRIPLNLFVCVVLYNVNAFPITVMFGMCSIFLFMAAILQRRLMVVSDLHKSSTKAQEMVDEDEPLNP

SEQ ID NO: 39770 - protein, 134 aa, Triticum aestivum
  misc_feature (76)..(76): Xaa can be any naturally occurring amino acid
  misc_feature (88)..(88): Xaa can be any naturally occurring amino acid
  misc_feature (94)..(94): Xaa can be any naturally occurring amino acid
  misc_feature (109)..(110): Xaa can be any naturally occurring amino acid
  misc_feature (114)..(114): Xaa can be any naturally occurring amino acid
  unsure (1)..(134): unsure at all Xaa locations
MAPTVMASSATSVAPFQGLKSTAGLPISRRSSSAGLSSVSNGGRIRCMQVWPIEGIKKFETLSYLPPLSTEALLKXKVDYLIRSKWVXCLEFSXVGFRLPVSTISFPPXXYDGXDYWDKCGKLAFFRVRPTTKV

SEQ ID NO: 39771 - protein, 304 aa, Debaryomyces hansenii CBS767
MQSELLDSSYGKGNVKFLKVKKNPHNSKEQDVLEANVQVLLKGNFDVSYTKADNAPIVPTDTVKNTILIEAKTTNVWPIERFAAHLAKHFTEKYAHVSGIEVSIVQSKWTKYEVDGKIHPHSFKHEGPETRRTFLTYCRSNKKLTITSSIKDLTVLKSTGSMFYGYNVCDYTTLKPTKDRILSTDVDASWTYDPKQVTSLDQVLTQADKGLFDSTYDSARKVTLDLFALENSASVQATMYNMSHKILELVPEVGTVSYALPNKHYILFNLEWKGIKQNDELFYPSPDPNGLIKSTVGRKTQSKL

SEQ ID NO: 39772 - protein, 788 aa, Medicago truncatula
MACIPHILSPLSHSTTLANLINITNFEIHNRTSIIISPNSRPKKKKKKIFAIGNRVGVDTETAVIEIEKRQLQLSKGHPSPYGATPQEDGVNFAINSLNSLSATLCFFTLSDFKNNKVTEYITLDPLVNKTGCVWHVFLKGDFKDMLYAYKFDGKFSPQQGHYYDSSRILIDPYAKAVISRGEFGEVGPDGNCWPQMAGMVPFDNEEFDWEGDLPLKYPQKDLIIYEMHVRGFTKHESSKAEFPGTYLGVVEKLDHLKELGVNCIELMPCHEFNELEYYSYNAIQGDYRVNFWGYSTINYFSPMIRYSSAGIQNCGRDGINEMKLLIKEAHKRGIEVIMDVVFNHTAEGNEKGPIISFRGVDNSVYYMVAPKGEFYNYSGCGNTFNCNHPVVRKFIVDCLRYWVTEMHVDGFRFDLASIMTRSSSLWNGVNVFGAPIEGDFLTTGTPLSSPPLIDMISIDPILRGVKLIAEAWDAGGLYQVGTFPHWGIWSEWNGKYRDTVRQFIKGTDGFAGAFAECICGSPNLYQGGRKPWNSINLVCAHDGFTLADLVTYNNKHNLPNGEDNNDGENHNSSWNCGEEGEFVSASVKKMRKRQMRNFFLSLMVSQGVPMIFMGDEYGHTKGGNNNTYCHDNYLNYFRWDKKEESSSDFFRFCRLLTKFRQECESLGLDDFPTSERLQWHGHFPVTPDWSESSRFVAFTLMDLVKGEVYVAFNTSHLPFTITLPERPGYRWEPLVDTSKKAPYDFLTPDLPGRDIAIQQYAQFLDANMYPMLSYSSIILLRTPDVNA

SEQ ID NO: 39773 - protein, 446 aa, Staphylococcus aureus subsp. aureus Mu50
MPKRTFTKEDIRKFAEEENVRYLRLQFTDILGTIKNVEVPVSQLEKVLDNEMMFDGSSIEGFVRIEESDMYLHPDLDTWVIFPWTAGQGKVARLICDVYKTDGTPFEGDPRANLKRVLKEMEDLGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPNTEMGLTETAYQFTAGVLKNARGFTAVCNPLVNSYKRLVPGYEAPCYIAWSGKNRSPLIRVPSSRGLSTRIEVRSVDPAANPYMALAAILEAGLDGIKNKLKVPEPVNQNIYEMNREEREAVGIQDLPSTLYTALKAMRENEVIKKALGNHIYNQFINSKSIEWDYYRTQVSEWERDQYMKQY

SEQ ID NO: 39774 - protein, 396 aa, Listeria monocytogenes str. 4b H7858
MAKKVVTDLDLKDKKVLVRVDFNVPMKDGKITNDNRIVAALPTIEYILEQNGKAILFSHLGKVKTEEDKEGKSLRPVAARLSELLGKEVKFVPTTRGPELEKAIDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 39775 - protein, 214 aa, Synechococcus sp. WH 5701
MDQLRFDGAGLIPAIAQDWLDGAVLMLAWMNQESIKRTLATGEVHYWSRSRAELWHKGATSGHLQRLKGLRYDCDSDVLLLTVEQVGDVACHTGRRSCFFTAAPPQASGTPELPDPPTDACTELARQIKDRRDHPVEGSYTNRLLEGGDNRILKKIGEESAEFVMACKDDEADGIAGEAADLIFHLQVALAQHGVEWRRVLEVLAARRGAPRRS

SEQ ID NO: 39776 - protein, 232 aa, Lachancea kluyveri
MTEPAQKKQKQTVQERKAFISRITNETKIQIAISLNGGYIQIKDSILPAKKDDDVASQATQSQVIDIHTGVGFLDHMIHALAKHSGWSLIVECIGDLHIDDHHTTEDCGIALGQAFKEAMGAVRGVKRFGTGFAPLDEALSRAVVDLSNRPFAVIDLGLKREMIGDLSTEMIPHFLESFAEAARITLHVDCLRGFNDHHRSESAFKALAVAIREAISSNGTNDVPSTKGVLM

SEQ ID NO: 39777 - protein, 314 aa, Prochlorococcus marinus str. MIT 9211
MVSSVIGPSAPLRRPVSASKALAASTKLQIQTPINNKNKLKPLGKFERRWGTIIFMFAIHALTIFALQPKFWSVQAVSALLVMYWVTACLGVTLGYHRLLSHRSFQVPRWLERFFATCGALSCQHGPIDWVGLHRHHHTFSDTDADHHNSNKGFWWSHMGWMFEDVPALGTVPRFTGDLVKDPYYLFLNQHFLLLQIPLGAFLFWIGTISEVGGWSMVLWGIPLRLVVVYHVTWLVNSATHCWGSVAYESGDRSRNNRWVAALTFGEGWHNNHHAFPSSAKQGLQKGQIDLTWEHIRFLKRLGLARKIRLPMTF

SEQ ID NO: 39778 - protein, 303 aa, Brassica oleracea
MTSVKVSNVSLGATERDLKEFFSFSGDILYLEMHSETERSKLAYVTFKDLQGAETAVLLSGATIVDSSVIVTMAPDYQLSPEALASLEPKEDSSKSPRASVFRKAEDVVSSMLAKGFILGKDAIAKAKSVDEKHQLTSTASARVASLDKKIGFTDKINTGTVVVGEKVREVDHKYQVSEKTKSAIAAAEQTVSNAGSAIMKNRYVLTGATWVTGAFSKVAKAAEEVGQIAKEKVGLAEEEDKRKVVDEFARVHLSESPKAAAASSEGEESKLSESPEAKKASEHQEPPQVQQAPPPPVAPAQP

SEQ ID NO: 39779 - protein, 437 aa, Kluyveromyces lactis NRRL Y-1140
MPISKVYARSVYDSRGNPTVEVELTTEKGTFRSIVPSGASTGVHEALELRDGDKSKWLGKGVLTAVSNVNNIIAPALVKANVDVTNQQQVDDLLLSLDGTANKSKLGANAILGVSLAASKAGAAAKNVPLYQHLADLAGAKTQPFVLPVPFLNVLNGGSHAGGALALQEFMIAPTGAETFAEALRMGSEVYHNLKSLTKKRYGASAGNVGDEGGVAPNIQTAEEALDLIVDAIKAAGYEGKIDIGLDCASSEFYKDGKYDLDFKNPESDPSKWLSGPQLADLYHELVKKYPIVSIEDPFAEDDWEAWSHFYKTAGVQIVADDLTVTNPVRIATAIEKKAADALLLKVNQIGSLSESIKAANDSFAANWGVMVSHRSGETEDTFIADLVVGLRTGQIKTGAPARSERLAKLNQLLRIEEELGSNAIFAGKKFHNGNQL

SEQ ID NO: 39780 - protein, 548 aa, Methanocaldococcus jannaschii DSM 2661
MPTINVKKADLERLVNMPLEDEFIEEKFPMMGVEVEGIFEEDGEKIIQFSINPNRPDYLSAEGLARGFRGIIGIETGLKKYDIESSDVKLYVENVETRPYIAMALVKGVIVDDYVLESIINLQEKLHWVMGRDRKKVAIGIHDADKVKPPFYYKEVSGDGIKFVPLNSDEEMTPREILEKHEKGIKYAHLIKDDKFPIILDSEGDVLSMPPIINGELTRVTTETRNLLIDVTGTDKYAVEKTLNIIVTALAERKYGKIHAVEVIKDNQSTIYPNLKEDVLETTSEYINKVLGANLTPGTIINYLRRCRLDAQFVDNKIKVFIPAYRVDIFGEIDIAEEVAIAYGYNKFSGEYPIIGTIGELNQLEKKCDFIREIMVGFGFYEVINLMLSNDEVLFKKMRIEDNNYIEVLKPASIEHRIVRKSILPLLMETLRINKHKELPQKIFEIGDCVVIDENAETKSRVVKKIAGVIVDNETNFNEIKSYVEGLLRELKIEYELDNFEHPSFIKGRCAKILKDGKIIGYFGEIHPEVITNFELEFPVVGFELEIE

SEQ ID NO: 39781 - protein, 540 aa, Populus trichocarpa x Populus deltoides
MDAIMNSQEEFIFRSKLPDIYIPKNLPLHSYVLENLSKYSSKPCLINGANGDVYTYADVELTARRVASGLNKIGIQQGDVIMLFLPSSPEFVLAFLGASHRGAIVTAANPFSTPAELAKHAKPPRTKLLITQACYYDKVKDFARESDVKVMCVDSAPDGCLHFSELTQADENEVPQVDFSPDDVVALPYSSGTTGLPKGVMLTHKGLITSVAQQVDGDNPNLYFHSEDVILCVLPMFHIYALNSIMLCGLRVGASILIMPKFDIGTLLGLIEKYKVSIAPVVPPVMLAIAKSPDFDKHDLSSLRMIKSGGAPLGKELEDTVRAKFPQARLGQGYGMTEAGPVLAMCLAFAKEPFDIKPGACGTVVRNAEMKIVDPETGASLRRNQPGEICIRGDQIMKGYLNDPEATSRTIDKEGWLHTGDIGYIDDDDELFIVDRLKELIKYKGFQVAPAELEALLLAHPQISDAAVVGMKDEDAGEVPVAFVVKSEKSQATEDEIKQYISKQVIFYKRIKRVFFIEAIPKAPSGKILRKNLRETLPGI

SEQ ID NO: 39782 - protein, 250 aa, Flavobacteria bacterium BBFL7
MRKNIVAGNWKMNCDLSLTQNLIGDLKKGLKADYNCELMIAPSFPCLYPAFNSTLDTPIEVVAQNVCEQDKGAYTGEVSIDMLQSVGVKTVIIGHSERRDIYSETDELLAAKTIAAVENGMRVIFCCGEHLEQRKAGNHVSTVTAQIEKGLFQLNASQMEQIVIAYEPVWAIGTGETASPEQAQDMHADIRSFIQAKYGDMTARHTSILYGGSVKPSNAAEIFAKPDVDGGLVGGASLDAKSFLAIADAF

SEQ ID NO: 39783 - protein, 449 aa, Brassica napus
MSEQTKKRFITSDDLKKHNQPGDLWISIQGKVYDVSHWVKSHPGGEAAILNLAGQDVTDAFIAYHPGTAWRHLENLHNGYHVKDHHVSDVSRDYRRLAAEFSKRGLFDKKGHVTLYTLTCVAAMLAAVVYGVVACTSIWAHLISAVLLGLLWIQSAYVGHDSGHYNVTSTKPCNKLVQLLSGNCITGISIAWWKWTHNAHHISCNSLDHDPDLQHIPVLAVSNKFFKSMTSRFYGRKLTFDPLARFLISYQHWSFYPIMCVGRINLFIQTLLLLFSRRYVPDRALNIAGILVFWTWFPLLVSFLPNWQERIIFVFLSMAVTAIQHVQFCLNHFAADVYTGPPNGNDWFEKQTAGTLDISCRSYMDWFFGGLQFQLEHHLFPRLPRCHLRGVSPVVQELCKKHNLPYRSLSWWEANVWTLRTLRKAAVQARDVTNPVLENLLWEALNTHG

SEQ ID NO: 39784 - protein, 438 aa, Synechococcus sp. WH 7805
MASAPVTAPTLNTTRSQELFSAAQALMPGGVSSPVRAFRSVGGQPIVFDRVKGPYAWDVDGNKYIDYIGSWGPAICGHAHPEVISALQEAIEKGTSFGAPCALENTLAEMVIDAVPSVEMVRFVNSGTEACMAVLRLMRAFTGRDKVIKFEGCYHGHADMFLVKAGSGVATLGLPDSPGVPRSTTANTLTAPYNDLEAVKQLFAENPDAISGVILEPIVGNAGFIQPEPGFLEGLRELTKEHGALLVFDEVMTGFRISYGGAQAHFGVTPDLTTMGKVIGGGLPVGAYGGRREIMEMVAPAGPMYQAGTLSGNPLAMTAGIKTLELLRQPGTYEKLTTATEQLITGIKEAASAAGMPITGGSVSAMFGFFLCEGPVRNFEEAKATDAERFGKLHRAMLQRGVYLAPSAFEAGFTSLAHSDGDIEATLQAFRESFADIA

SEQ ID NO: 39785 - protein, 665 aa, Magnaporthe grisea 70-15
MAARKLQQEVDKCFKKVAEGVAEFESIYEKIEQSSNISQKEKYEDQLKREIKKLQRLRDQIKTWAASNDIKDKAPLLENRRKIETQMERFKAVEKAMKTKAYSKEGLSAAAKLDPKEQAKAEASEFLGNMIDTLELQIEALEAEAEQIQATVKKGKIQGAKAERMANIEQIIERHKWHQGKLELIRRSLENGGVDTEQVTDIEENIRYYVSDGMQDDFMDDDTLYDDLALGEEEDAYGMNQDNDKGSSQDAQSVHEDSLEDTRPTPPAPVAKPRAAAVEATVAAGRRPSTQMKSPLPTLATLHTPLPTISNGSSSSAGMKPAPAPTRPAGEGLKYASAAAAAAASDKNNVGIAPLPPPPGAAPVSTISPQAKASAANSPIVMAAQPAVSAASQPQTQPPATAASPVKIENAKPASSRSTGKAPATSNASASESSEAAGKASSSKSRKGALGEASNQSSATSSHTNGVTNGVKSKAKGKSGKGQPQVQAQEEPAEEESIYHLPASLQDLVDSYEMSKKRPAQANSTSTLRAMSHSQANLPDLTDAEAPSSYQPEVRVQSSSEYPQELLPIFSDVRLYNRLDTDTLFYIFYYKQGTYQQYLAAKALKEQSWRFHKQYQTWFQRHEEPKNITEEFEQGTYRFFDYESTWMNRRKADFKFAYKFLEDEV

SEQ ID NO: 39786 - protein, 126 aa, Salmonella enterica subsp. enterica serovar Typhi str. CT18
MKEIIFTETAPAAIGSYSQGNAMGNLIFTSGQLPINADSGKIETDDIQEQTRQSLLNLLAVVKMAGGDTDTVLKTTCFLSDMADFAAFNDVYASFFKINPPARSCFAVKTLPMGARVEIEAVAFRQ

SEQ ID NO: 39787 - protein, 357 aa, Oryza sativa (indica cultivar-group)
MPSSAAAAADGGDIEEVDRLKKRIRTLEMEETKLNQHMERVIRGIEANEAYLVGMVLRIMEKGPEDETAEDDCDVGFHLQRKIIFRPIAGVVYPSKLKPGDLIGVDSTSNEHYCGIGGLEKQIEELVEAVVLPIIHKNCFQRLGIHPPKGVLLYGPPGTGKTLVAHAFASQTNATFLKLTGPQLAVKLIGEGARLVRDAFQLAKEKAPCIIFIDEIDAIGSNHFDSGDREVQQTIVELLNQLDGVGSYESIKVIAATNRPEVLDPAFLRSGRLDQKIEFPHPSEQARVRILEIHSRKMDKNPDVNFEELACCTDDFNGAQLKAVCFEASMLAFHRDATEVRHEDFVRAIAQVKDGNY

SEQ ID NO: 39788 - protein, 586 aa, Cryptococcus neoformans var. neoformans JEC21
MRATHIENRDNNSLENKHIDHIEGVENGKGSQEPPSPSGFGGHLIDENLVHVEGEDKVTWYLCFLISASAIAGFLFGYDTGVVGVALPLVGTDLGGSELNSSQQEIITAGTTIGAIFGSAILGGWGDRLGRKMAILISDVFFTAGAVIIASSYSVPQIIVGRIILGIGVGGAAVIAPLFITETAPTAVRGRCIGVNAFFIPFGQVVADSIGAGVQNMRGGWRLLFAMGAVPSLLQLLLFHYLPESPRILIVKGDIDRARSVFQRIYPTATREMVDYKLRVAQEYVAATTALQSGTTFWERMKKVWKTGSYRRSIIAVSVLQAAGQFCGFNTLLYYAGTLFGLLGLSNPALGGLIPAGTNAVFVLIGMSTVDKVGRRGLLLIGVPVLLLGLVWNIVGFYYMCKPTGGFLDTSYSYDTTNVGIVIGGIVFYVAGFGLTYSHLVWYQAEYLALEVRSMGSGVATTVCWIANLIVSVSYLSELETMTPSGTYGFYLSLSVIAFVFIVFCFPETKQLSIDETSLLFENDWGVKRSVQMRKERHETRKRFKDAELAEAATAHFEARKQKSTSISPAELSKFMAGLKGGKRKP

SEQ ID NO: 39789 - protein, 298 aa, Ostreococcus tauri
MSTVDVPILNLESPSGEQIKIIEAAAAQFGFFRVDIASVSNVFGVDVERAVADAFRVSRTFFGRDASRKDELRARPGCGYTAFGSETLDARGSSTGDAKEGFYVARTGTPWPADDDEFRDVSERYYAMMFRLGRVLLGLFASVLGCDRAFFDEHWDGEHSCVLRYLRYPRGAASDEKSGAFACGAHSDYGAITILATDETPGLQIYDRESRRWKGVAPRTDTFIVNVGDLLERWSNKKLVSTRHRVMTSGERERYSIPFFFEPRKDSVITPVCDDGEEPMFAPKQFGEYLQERYTETY

SEQ ID NO: 39790 - protein, 104 aa, Brassica napus
MMLRGRVMRLASRHLGSHGFSTEIFVSRLSFYTTEEEFKKVFSPFGAIEEVRLVRDNQTGRLKGFGFVRYSSQEEAQKAIKAMDGRILRGRLIFAEMAKEHGTV

SEQ ID NO: 39791 - protein, 257 aa, Brassica oleracea
MGREGETTIGDVAPATPRRCSLSFWEVTTASGVVLGFLVGLLCVYLTMPQSDYSFLKLPRNLQDLQILRDNLEIYTSDYTVQVLVGYCLVYVFMQTFMIPGTVFMSLLAGALFGVIKGMALVVSTATAGASSCFFLSKLIGRPLIFSLWPDKLIFFQDQVARRKDGLLNYMLFLRLTPTLPNTFINVASPIVDVPYHIFFLATFIGLIPAAYVTVRAGIALGELKSLGNLYDFSSMATLFLIGVLSVTPTLISKKKV

SEQ ID NO: 39792 - protein, 334 aa, Staphylococcus aureus subsp. aureus MSSA476
MMQNKQILFNKIPEGMPQEDTFKIEETDTPKLESDGVLVQTLYISVDPYMRGRMTKADSYVQPFEIGKPIVSHVVAKVIDSTLADYKKGDVVVGMLPWRIINHVQADQITKVPTTDVPLDLYLSVLGMPGQTAYHGLLDIGQPKAGDTVVVSAASGAVGSVVGQIAKIKGCRVVGIAGGDKKVNYLTGTLGFDAGIDYKKEDFAEALAQAVPDGIDVYFENVGGTVGDEVFKHLNRFARVPVCGAISSYNHPEADIGPRIQGTLIKKQVMMRGFLVSEFANAFKEASEQLATWVQEGKIQSQVTIEDGFENAPHAFKNLFTGDNFGKQVIKVTE

SEQ ID NO: 39793 - protein, 120 aa, Listeria monocytogenes str. 4b H7858
MEIKDLQDYVAIVNDWPKKGIVFKDITPLMNDGEAYRFATDKIVEYAKELKIDIIVGPEARGFIIGCPVAYALGIGFAPVRKPGKLPRETIEMEYDLEYGTNKLSMHSDAIKTGQRVLIT

SEQ ID NO: 39794 - protein, 163 aa, Synechococcus sp. WH 5701
MARFSGLFDDEAFLALVDRFERQLAKALSILLCVVLVAATSQLIFRVWQEFFNPNTGWLGNDLIKILGDVLTVLIALEVLQNVTAYLRHHVVQIELVLLTALTAVARKVIVLQPGAEDKPLLLVGLGITVVSLSAGYWLVRSSTLMEKASRRGRAKVFREPDQ

SEQ ID NO: 39795 - protein, 129 aa, Sinorhizobium meliloti 1021
MSIKRYGAEQVGAGGKTLPFARAVEAGGWLHVSGQVAMENGEIIGGNIVAQTHKAIGNLLAILKEAGYGVEHVVRVGVWLDDPRDFWSFNRIYQDYFGAHPPARACVQSSMMVDCKVEIDCVAYKPKDA

SEQ ID NO: 39796 - protein, 218 aa, Streptococcus pyogenes SSI-1
MLMIKGIIFDMDGVLFDTEPFYLRRREDFFKTKGIPIDHLNSKDFIGGNLQELWKELLGKNRDDAIVKAITTDYDAYKQAHKPPYQKLLITEVNSCLEQLKKQGIKLAVASNSKRQDVLLALETTQIKDYFEIILAREDVSRGKPYPDIYNKAVQKLGLQKKQLLVVEDSQKGIAAAKAANLTVFAITDYRYGIDQSQADHKIDHLGQLCVKIGCFGS

SEQ ID NO: 39797 - protein, 299 aa, Triticum aestivum
  misc_feature (165)..(165): Xaa can be any naturally occurring amino acid
  misc_feature (198)..(198): Xaa can be any naturally occurring amino acid
  unsure (1)..(299): unsure at all Xaa locations
MNHGQQLPYHLSNTVIGYLNLLTLLASIPIIGAGLWLAHAASAAPGPTCQSALQAPLLAVGFVAFLVSLPGFVGARYHVSWALWLYLLAVLLLVLFLLGATVFGLAVTAGGGGRTVPGRPYREYRMRDYSPWLRSHVSADRYWRTALACVASSRACPPVAGWTPXDYMRRDLTPVQSGCCKPPTSCVYGGDGLTGHGXAVVAVQDEDCFRWQNDPAVLCYGCDSCRAGVMEQLRRHWHNVTIVNAVLLLLLIAVCSCGCCAFRNARRAEYAYGGRMSKIHPRWDYFWSRWWRGHREQIY

SEQ ID NO: 39798 - protein, 438 aa, Ashbya gossypii ATCC 10895
MDYRGGKRSSISFGSYQRPMEQFQNAGGGIYQRQSPMLYHPRSLEVGAPHAYCADLPSPQFAVDWDACDRVAIGSYKEDAFNKLTVLQATPDLSHWDSVAQASVIYPLSKIQWMPKGTGKLATCSDSLRIRSVEEQLHEQLNLSLVKYGKSLGEVSNGRMLGQLPPVTSFDWNALDTNLILFSSIDTTCTVWDLQASNYVKTQLIAHDSEVFDAKFLTQSSNLFASCGGDGSVRVFDLRCLAHSTIIYEPQQQVQGQTPSQTQVHTLAAHEQDGQLQKNSQSSALSSSASSSLGALDNCALLRLEPSPFDPNILATIQQDSNVVIILDMRYPGSPMLLLEGHAAPVNQLKWHPSKPNVLATCGDDCQILYWDLLELLSASQVWTGLTQQRWSTTSTVRTLETPQMSYTAQYEVNNFVWRPSGDWIGYTAGKRFYNIRM

SEQ ID NO: 39799 - protein, 71 aa, Zea mays
AAARATSPPSRTVAATHSLSFIDMNARVGRNVSITNKEGVQEADRPDEGYYIRSGIVVVLKNATIKDGTVI

SEQ ID NO: 39800 - protein, 137 aa, Brassica napus
MDHREAEKQIVTVAEAAAKIDPCHLMDHLVKALREVWRPKERLSRYTDYFAEALSGVSFPWVKMFKDAPLSTLIDVPLSHIPQSVYRTALNWLEMPPVKLEDFSAFVLRAFDQILVDLEAQQGGGDDSKSQVGMFVA

SEQ ID NO: 39801 - protein, 195 aa, Gibberella zeae PH-1
MAVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVRHHCPGVPCLIVGTQVDLRDDPSVREKLSKQKMQPVRREDGERMAKDLGAVKYVECSALTQYKLKDVFDEAIVAALEPPAPKKKSHKCLVL

SEQ ID NO: 39802 - protein, 287 aa, Craterostigma plantagineum
MEAKEEDVRLGANKFSERNPIGTAAQTHDDKDYTEPPPAPLFEPGELSSWSFYRAGIAEFMATFLFLYITILTVMGVNRAPNKCASVGIQGIAWAFGGMIFALVYCTAGISGGHINPAVTFGLFLARKLSLTRAVFYMVMQCLGAICGAGVVKGFYKPTYNLEGGGANVVANGYTKGDGLGAEILGTFVLVYTVFSATDAKRSARDSHVPILAPLPIGFAVFLVHLATIPITGTGINPARSLGAAIIYNHDRAWHDHWVFWVGPFIGAALAALYHVVVIRAIPFKSK

SEQ ID NO: 39803 - protein, 356 aa, Arabidopsis thaliana
MKNGLIIINCIILTIGTCGGPLLTRLYFTNGGKRIWFMSFLSTAGFPIILIPLLVSFLSRRRSNRNPNNAENKRKTKLFLMETPLFIASIVIGLLTGLDNYLYSYGLAYLPVSTSSLIIGTQLAFNALFAFLLVKQKFTPFSINAVVLLTVGIGILALHSDGDKPAKESKKEYVVGFLMTVVAALLYAFILPLVELTYKKARQEITFPLVLEIQMVMCLAATFFCVIGMFIVGDFKVIAREAREFKIGGSVFYYALIVITGIIWQGFFLGAIGIVFCASSLASGVLISVLLPVTEVFAVVCFREKFQAEKGVSLLLSLWGFVSYFYGEFKSGKKVVDKPQPPETELPILPVSDYVA

SEQ ID NO: 39804 - protein, 288 aa, Craterostigma plantagineum
MAENREEDVRLGANKYRETQPIGTSAQTDKDYKEPPPAPLFEPGELKSWSFYRAGIAEFVATFLFLYITILTVMGVSRAPNKCASVGIQGIAWAFGGMIFALVYCTAGISGGHINPAVTFGLFLARKLSLTRAIFYMIMQCLGAICGAGVVKGFQVGPYQRLGGGANTVAHGYTKGAGLGAEIIGTFVLVYTVFSATDAKRSARDSHVPILAPLPIGFAVFLVHLATIPITGTGINPARSLGAAIIYNKDHAWDDHWVFWVGPFIGAALAAVYHQIVIRAIPFKSGRA

SEQ ID NO: 39805 - protein, 587 aa, Candidatus Desulfococcus oleovorans Hxd3
MAYDATKMADWQISEEAEKNMPMPEEWCEKLGLEKEEMLAMGRLSKLDFLKIIKRLEAKPDGKYIEVTAITPTPLGEGKSTTSLGLMEGLGARGKSVGGALRQPSGGPTMNVKGTAAGGGNSLLIPMTEFSLGLTGDINDIMNAHNLGMVAMTARMQHERNYNDEQLQRLTGMRRLDIDPTRVEMGWIIDFCAQALRNIVIGLGGRTDGYTMQSKFGIAVGSELMAILAVATDLADLKERINNITVAFDKSGKPVTCRDLEVGNAMAAFMRNTINPTLMSTAEYQPCLVHAGPFANIAVGQSSIIADRVGLKLWDYHVTESGFAADIGFEKFWNVKCRFSGLKPHVSVLTATIRALKMHGGGPKVVAGKALDDAYTKENLALVEKGVENMVHMIGVIRKSGINPVVCVNRFYTDTDAEVAIVKKAAEAAGARCAESKHWEKGGEGALEFADAVIDACEEGNDFDFLYPLEMKLRDRVDKIAREVYGADGVDWSPEATAKAEMLENDPKYADFATMMVKTHLSLTHDPVKKGVPKGWRLPIRDVLIYSGAKFLCPCAGTISLMPGTGSNPAFRRIDVDPATGKVSGLF

SEQ ID NO: 39806 - protein, 321 aa, Flavobacteria bacterium BBFL7
MDTENNILEVAKRTIRIESAAVKNLENSLDSAFAKAVNHIHTAQGRVIITGIGKSAIIAMKIVATMNSTGTPAIFMHAADAIHGDLGIIQKNDVVICISKSGNTPEIKVLVPLIKNFENKLIAITSHQDSFLGKEADFVLHAPIEEEACPNGLAPTTSTTAQLVVGDALAICLLELKGFTDKDFARYHPGGALGKKLYLRVQELIDQNAKPQVTSNSTLRDVIVNISENRLGMTVVVDETKLIGIITDGDLRRMLSTGKNIDSLTAADIMTTSPKTIDADDMAVQAREVMEEYNVSQLVAVNKDGYAGVVHIHDLIREGIL

SEQ ID NO: 39807 - protein, 241 aa, Prochlorococcus marinus str. MIT 9312
MRKSVIAGNWKMHMTCAEAKSYLEEFIPLIKNIRDDRKVVIAPPFTAISTFSKHSDFDYLDISSQNIHWEDEGAFTAEISPKMLIEHGVSYAIVGHSEPRKYFSESDEQINKRAVFAQCSGLTPIVCVGETLEQRERGEADRVITRQVEQGLENTDPSNLIVAYEPIWAIGTGKTCEAKDANNICSLIRKLIGFDDVIIQYGGSVKPNNIDEIMSMSDIDGVLVGGASLDPNSFARIANYQ

SEQ ID NO: 39808 - protein, 1098 aa, Prochlorococcus marinus str. MIT 9312
MPQRGDLKKILILGSGPIVIGQACEFDYSGTQACKALRKAGYEIILINSNPASIMTDPEVASKTYIEPLTPEIISQIILREKPDAILPTMGGQTALNLAVKLSESDFLKKNNVELIGADLKAINKAEDRKLFKESMEKINVNVCPSGIASNLAEAKEVQKKINSYPLIIRPAFTLGGVGGGIAFNLEEFIELCTTGLEESPRDQILIEKSLIGWKEFELEVMRDTADNVVIVCSIENLDPMGVHTGDSITVAPAQTLTDKEYQRLRDMSLKIIREVGVETGGSNIQFAINPSNGEVIVIEMNPRVSRSSALASKATGFPIAKIAALLSVGYTLDEIINDITKKTPACFEPSIDYVVTKIPRFAFEKFKGSSNTLTTSMKSVGESMAIGRSFEESFQKALRSLEVGIFGWECDSLDEFKNENHINNSLRTPTSERILIVKKAMQIGKTNSYIQEVTNLDSWFIEKLRNIFNFENEFLKEKGLIDLDRDLMLNAKQLGFSDQQIAKLTKSDFFEVRKYRKDLNIIPIYKTVDTCSAEFSSSTPYHYSTYEESFINLNSEIFDSEISDNNKSKKIMILGGGPNRIGQGIEFDYCCCHASYQASTSGYKTIMVNSNPETVSTDYDTSDILYFEPVTLEDVLNIIEAENPYGLIVQFGGQTPLKLSLPLFEWLKTDEGLKTGTKILGTSPISIDIAEDREEFTNILEELSIRQPLNGIARNQDEAQKVAKNIGFPLVVRPSYVLGGRAMEIVKDENELSRYISEAVKVSPDHPILLDQYLNNAIEIDVDALCDSEGSVVIAGLMEHVEPAGIHSGDSACCLPSISLSESTIDNVKTWTKLIAQKLNVVGLINLQFAVTNLNNKENKLFILEANPRASRTVPFVSKAIGKPVAKLATQLMQGLTLEDINFTKEFSPKFQAVKEAVLPFKRFPGSDTLLGPEMRSTGEVMGLAKDFGIAYAKSELAAGNGVPSEGVAFLSTNDLDKKNLEEIARELLILGFKLIATKGTAAYLVDLGINVEKVLKVHEGRPNIEDLIRSGLVQLIINTPIGSQALHDDAYLRRAALEYNIPTFTTIPGAKAAIKAIKALQSNKINTYSLQEIHED

SEQ ID NO: 39809 - protein, 156 aa, Brassica napus
MSFREKMPTSPKSPLRRRRSSWTGSWLNHPTTSFKEVVSAVIQAQSPRSTSKPQTFDFDFDFSKVDRTLSLPDSLLLRILQKLPDSQNSNNDVSLVCKRWLSLQGRRLRTLKLLDYDFLLSEKLVSRFPKLTSIDLSNACMNPNPNPNPPRISSAT

SEQ ID NO: 39810 - protein, 112 aa, Zea mays
MDAAAAAAAQMERHSSAAAQMERHSSAAAFVEGGVQDGCDDTCSICLETFSDSDPSAVTSCKHEFHLQCILEWCQRSSQCPMCWQAISMKDPTRYKFCSATPPTTTHASVVR

SEQ ID NO: 39811 - protein, 523 aa, Ricinus communis
MPAVGGIPPSGGNRKVYPGNLTLYVTVTCVVAAMGGLIFGYDIGISGGVTSMDSFLKKFFPSVYRKKKADESSNQYCQYDSQTLTMFTSSLYLAALIASLVASTITRKFGRKLSMLFGGVLFCAGAIINGAAKAVWMLILGRILLGFGIGFANQSVPLYLSEMAPYKYRGALNIGFQLSITIGILVANVLNYFFAKIKGGWGWRLSLGGAMVPALIITVGSLVLPDTPNSMIERGQHEEARAHLKRVRGVEDVDEEFTDLVHASEDSKKVEHPWRNLLQRKYRPHLSMAIAIPFFQQLTGINVIMFYAPVLFDTIGFGSDAALMSAVITGLVNVFATMVSIYGVDKWGRRFLFLEGGVQMLICQAIVAACIGAKFGVDGAPGDLPQWYAVVVVLFICIYVSGFAWSWGPLGWLVPSEIFPLEIRSAAQSVNVSVNMFFTFVVAQVFLIMLCHLKFGLFIFFSFFVLIMSIFVYYFLPETKGIPIEEMGQVWKQHWYWSRYVVDEDYPNGGLEMGKEGRIPKNV

SEQ ID NO: 39812 - protein, 484 aa, Staphylococcus aureus subsp. aureus Mu50
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQN

SEQ ID NO: 39813 - protein, 302 aa, Prochlorococcus marinus str. MIT 9211
MSSAAHLSPKPFGRLLTAMVTPFDSDGKVDYAIAGRLARYLVDEGSDGIVVCGTTGESPTLSWSEQHQLLETVKSSVGKAVKVLAGTGSNSTAEAIEATVKAAELGADGALVVVPYYNKPPQEGLEIHFRSIANAAPDLPLMLYNIPGRTGSSIHPATVKRLMNCPNIISYKAASGTTSEVTDLRMQCGSQLAVYSGDDGLLLPMMSVGAVGVVSVASHIVGSRIKAMIDAYSTGQVNIALAYHEQLQPLFRALFATTNPIPVKAALEAIGWQVGSPRRPLSPLKKQMKEDLIDIIKSLRQI

SEQ ID NO: 39814 - protein, 594 aa, Zea mays
  misc_feature (106)..(106): Xaa can be any naturally occurring amino acid
  misc_feature (131)..(131): Xaa can be any naturally occurring amino acid
  unsure (1)..(594): unsure at all Xaa locations
MASTASLQRFLPASPHVSSRRRAGRARAAVSIPSSSPPATRDNEVPAEPLEPRVEARERGYWSLKERCRTGLNPHEKVKLEKEPMALFMDGGVRDLAKIPMDVIDXAAKLTKDDVNVRLKWLGLFHRRKHXYGRFMMRLKLPNGVTTSEQTRYLASVIEAYGADGCADVTTRQNWQIRGVTLPDVPAILDGLRAVGLTSLQSGMDNVRNPVGNPLAGVDPHEIVDTRPYTNLLSSYITSNSQGNPAITNLPRKWNVCVIGSHDLYEHPHINDLAYMPAVKDGEFGFNLLVGGFISPKRWAEALPLDAWVAGDDVVPVCKAILEAYRDLGSRGNRQKTRMMWLIDELGMEVFRSEVEKRMPNGVLERAAPEDLVDKRWERRDYLGVHPQKQEGLSYVGLHVPVGRLQAADMFELARLADEYGTGELRLTVEQNIVLPNVSNERLDALLAEPLLQEQRLSPRPSMLLRGLVACTGNQFCGQAIIETKARALQVAREVEKRVAVPRPVRMHWTGCPNSCGQVQVADIGFMGCLTKDSDGKIVEAADIFVGGRVGSDSHLADVYRKSVPCKDLVPIVADLLVERFGAVPREREEEDEE

SEQ ID NO: 39815 - protein, 241 aa, Trichodesmium erythraeum IMS101
MRKTIIAGNWKMYKTQLEAKEFLEGLMSQLTKTPEEREVVLCTPFTALDFMSKILHGSLIRLGAQNVHWEDEGAYTGEISGLMLKDVGVSYVIVGHSERRQYFGETDETVNMRLKAAQKHGLTPILCVGETKQQRDSGETESHIFSQLANDLVDVDQENLVIAYEPIWAIGTGDTCEAKEANRVIGLIRGKLNNSNVTIQYGGSVKPNNVDDIMAQEEIDGALVGGASLNPESFSRLVNYQ

SEQ ID NO: 39816 - protein, 332 aa, Triticum aestivum
MGNCKSSSRARLGKAHVVPDSEWRMQDFGKTHVPDLEWRINDFSSLLETGAKSAKSDAFHCSGYNWYLQVSPMHKEIGSETPYVALCLKISQASMVPGHTVHVVFELSIYNHTKGMYCGCKDTYNFHFKNTYSKEQCLIPLQELLKSSAFLVDDSCVFGVEILKIDVSSPEKKAVVVQKKDTTVQNLFVQKKGFVKGTYTWNMNNFLELDLDHFVRSPTFEVGGHKWYIRIYPRGDKYSTDCLSLYLFLDASDELHLKSKKVVVMTLSILDQKNGKRLTATSGLLVFTGGHGWGWADFLGLMKLKDPSGGYVVGSSCIVKADLTIVGSSNDG

SEQ ID NO: 39817 - protein, 688 aa, Coccidioides immitis RS
MKGFRQRVHEQLSRAKDSNKSSKKKDSSSSSTPATAPASTPSGQGPSPTNSGHGTPNSSTTALNETKGKATAPTDNAGHPQMTIHHNAHVVPNPVPAPQHYPPQQPHAGMHPGQMSANGPGTPSRQVQQIAPSVIISPSAPHIPPPGAAETMPGDLQPPKIGQKSHAFDRLHTTPRDVPEGIRTPKRQHSSRFDISDQRQRDLEKLPGFHEVPPNRRQDLFMQKIEQCNIIFDFNDPTGDMKSKEIKRLALHELLDYVANNRSVITDPMYPKVVEMFAKNLFRPIPPPVNPQGDTFDPEEDEPVLEVAWPHIQVVYEFFLRFIESQDFNTNVAKAYIDQHFVLQLLELFDSEDPRERDFLKTTLHRIYGKFLNLRSYIRKSIGNVFFQFMYETERFNGIAELLEILGSIINGFALPLKPEHKTFLTRALIPLHKVKSLSMYHPQLAYCIVQFLEKDSTLTEEVVLGLLRFWPKTNSTKEVMFLNEVEDIFEVMDPREFAKVQEPLFHQLAKSVSSPHFQVAERALYFWNNEYFCNLVGDNVETILPIMFPSLYENSQGHWNRTIHSMVYTAMKMFMEINPQLFDDCSHEYRELQESAPAREQSRKAKWEKLEELVKAQKNKDHATLRSNKPFAKLPSHPEDPELIAQDNRQRLNALKLQDEAETTKDSNQHRLPEREGQHSVSGSHVG

SEQ ID NO: 39818 - protein, 592 aa, Candida albicans SC5314
MSDEKTTATYESHTKQDSMSSTSSQSIEQISSPTKSEPKKKSWFKMKNLFEKVEDRPTPPQVYNYRIYMTAIMASAAAIIIGYDGGFIGGTVALDSFKNEFGLDKSAHSSFIISNVISVFHAGCFFGALFSYPFSFYLGRRIPLIFAAFLITAGSGIMLAANSSVGLGPIYAGRVMAGVAVGFSTNLTVVYISEIAPPAIRGQLTSSYEIGWRVGDLVGFWINYGVDSHIPEGKRQWYIPFAIQLIPSGLFLLGSIFMKESPRWLMQVGRYDEAIKNLTWFRQLPEDDEYIVYEVNQVKESIEEQKQKIGLGIMDPFYEVFFNNKLVLRRLLITMTIYVVCNFLGIQSINYYSPILFQGLGVKGTNASLFSTGMFGVVKFICTFIYILFIVDTVGRRKAFMASSTVCSLCFWYIGAYLKLNDPTKPGVSAGPGGKAAIAMMYIWIASFILAWSGGPFVVGSEVFDQNIRSFVQAINAAMSWVPIFIMSRFTTNMIRAMDYGIYFFFAALAVATIPFLFFCLPETKGIALEDMDRLFSPELPAWRAHDILMKRVQHETEEVFHENHKHGLFEAVDNKPVSENVEDILVNKEEK

SEQ ID NO: 39819 - protein, 260 aa, Brassica oleracea
MKRKSRVGETRLSLPKSISPSSDSLSTATHVAIKYTDDFIPNLSRIPHESIPSLSPTSFSADFNLKASEMPPFSSQQSEATSQPQDTPVERMVRRKWTSGDDEVLISAWLNTSKDAVVGNEQKWHRINDQMNKFCAAFAAAERQITSGQSDNDVLKVAHEIFYSDQGHKFTLEHVCAHVGEVSSQSSMRPEGIKAAKASRNGSKGKAIEDYKSILELKMEDLARKEKLSKLAILDTLLAKKDPLSESEETVKNKLLAELF

SEQ ID NO: 39820 - protein, 899 aa, Gibberella zeae PH-1
MSGAPRNDTYPYAFASTSASSSSQTPNSDDRDELDFLDDNASNDSGRGRSRDRNHVLGEDPLQGNLSAPMTFKRRQGPSLWSAPSRLLSAITGSRSNASSRGASPAVFPGSNTSPRAEPVVFNEATKDGAPHDWYVEGPGRRVGYEDLTAIDWIFEYTKERQRLRMLYSSASGVIGPLRRLIDASQVWIVLLLTGMLVGAVAAGINVTTDWLGDLKEGYCSSGPEGGHFYLNKAFCCYGYDHNSKCEGWKSWGDAVGVHSKGGKWFVEYLFFVSLAMLFAYVSAVLVQEYAIYAKHSGIPEIKTVLGGFVIRRFLGFWTLVTKSLGLSLAVASGMWLGKEGPLIHVACCCANVFTKLFRNINDNEARKREVLSAAAASGVSVAFGSPIGGVLFSLETLSYYFPDKTMWQSFVCAMTAAVVLQAFDPFRSGKLVLYQVHYSIGWHGFELLPYAILGVLGGIHGGLFIKLNMAIARWKKANRWIPGPFIQVLIVAFFTALINYPNFYMKLQTTELVSNLFSECSQVLDDPIGLCRTGAASAKTIVLLVFASVLGFFLAAVTFGLQIPAGIILPSMAIGALTGRAVGIIMEIWVTNHPGFFLFGSCEPDIPCVTPGTYAIVGAAASLAGVTRLTVSIVVIMFELTGALTYVLPIMIAVMISKWVGDAFSRRGIYESWIHFNEYPFLDNSENNDAIPDIPASQVMTRIEDLVVLTATGHTISSLTTILEMHPYRGFPVISDPREAILLGYISRAELAYNLSAATQAPRSLPPETETFFSHQPMADPRTTLDLRPWMDQTPLTRFSHTSLHLVATYFQKLGLRYLLFSDRGVLQGLLTKKDVWYVLNGAEETRRTMGLASTGAGHETGVADRTPDDIGGGESSGLLRGDGADDGDSIQGEEPML

SEQ ID NO: 39821 - protein, 336 aa, Glycine max
  misc_feature (159)..(159): Xaa can be any naturally occurring amino acid
  misc_feature (248)..(248): Xaa can be any naturally occurring amino acid
  misc_feature (289)..(289): Xaa can be any naturally occurring amino acid
  unsure (1)..(336): unsure at all Xaa locations
HASVAFGVSTATFPNLNRCRGVAYASLSNKASTTSLGVRVTEGEGNLPKLVLTSPAGRCVILYKTIFPSLHNTTMCVRWLNLWVCSEAEIYLFGGCITSWKVPSGKDLLFVRPDAVFNGNKPISGGVPHCFPQFGPGPIQQHGFARNMDWTVVDSENTXGNPDASVRLREDDRRGTVWDFSFHALFKVTLNAKSLATELTVKNTDNKAFSFSTTLHTYFQASVSNASVKGLKGCKTLNKDPDPKNPVXGKEEREVVTFPGFVDCAYLDASSELQLDNGLGDLISIKNTXSDAVLWNPYLQMEACYKDFVCVENAKIGSVQLEPEQTWTAVQHLSIA

SEQ ID NO: 39822 - protein, 455 aa, Rhodococcus sp. RHA1
MSDAFDLVVIGSGPGGYVSAIRGAQLGLRTAVVEGNALGGRCLNYACIPAKAVLRAADVLDEVRHASQFGIHVGTPRVSFDEVRARRDEVVASLTGGVRGLLKKNGVEVKHGWARLAGDGAVTVDGETVHGRAIVLATGSVARPLPGLDFHGRVIGTEQAWALDALPDTIAVVGAGASGVELASAYARLGSKVRLIEASDRILPAEDADISAIVHAKLRRQGIAISTGVTVSDTEQSTDAVSFTVDGRTEQTTWLVVAAGRSPDTDSLALDTAGVELDDRGLIRVDERLRTTAPGIWAIGDLVRGPALAHKASEEGIIAAEDAAEHIPEPLLHNLIPRATFCSPSVASVGLTEEQARQQGYEVVVGTARYGAVGAGTVLGERDGLVKLVGDAKYGELLGAHIVGAKATELIQELVTARALEAGLPEIATIIHGHPTLSEAVSEAARDAQGWMIHG

SEQ ID NO: 39823 - protein, 603 aa, Cryptococcus neoformans var. neoformans JEC21
MMLPRLPRRTVSAGSLAIVEGKGLFSFRPGAKLPRVFSTSIRQVPRQEKSKFTIWARRLAILGAGGGVVYIYDKEVNASALTRSLRTGYIGILCTLDYKINFAPSKADEIEALHTRVANRLRWVIDINQGLYLKLGQALGLQAALLPKPYREAFGHVFDRAPAVSYDEVVGVFIKDLGVKPEDIFQEFSRDPFASASVAQVHKAILKPGVGDERPGKIVAVKVQKPAIEKQMEWDLFSYRSLMWLSEKLFDMPMYFVAKYVSNQMRFETSFIHEASNARRCAEFLERTTELRGDVYVPRVYGKDEGCQESDRVMIMEWIDGCRLNDKEQLENWGLNLREVMDLAISTMSAMTFSWGFVHCDPHPGNILVRPHPTKKGKPQIVLIDHGLYIELPQQFREDYCRLWRSLFVIDIPTIESIAKKWGIALDPNLFASAILLRPFQVRKDKSRPKNDPKPTEEDKYQQQLELKRRLKTMLENERLIPRELIFLSRCQRMMQANNQILGSPSSRINLTAKWASIGYTRSLTNSRSLHNVGLTMWLRDRWDTFVFRFTLSIVNIAFWLTTLRQKLIPREKGSWEDRIQAQFEAMAKEEFGIEIDDQVFLG

SEQ ID NO: 39824 - protein, 422 aa, Rhodococcus sp. RHA1
MSIDITLPQLGVEMKSALLAEWVRKDGDEVDGGEVIAIIETDKVSYEIEAPTAGVLHTAADVDQEYKVGARLGAVSASRKEYLAVARGTDTHPDPPTSGTETTVQPERRVEQPPASTAAAERSTNGIVLATPLARRVAADAGMDISTIEGSGRRGQIRRRDVEAAQAQDPAAQDEPHPVSEPVDSPQPSDSPNHEQGKPLSAMRRTIADRMQQSLQTTAQLTDVREVEVSALVELRNRLAAKAERIGFKVSFTDLFLKATALALREVPELNVTVQADRIIEHDHVHLGMAVSVPDGLIVPVVRDADQLSLRAIHQRSEEAALAARERKVTAADLTGGTFTVTNIGSYGSHFGTPVLNLPQVAILATGAILDRPVVRDGEVRAGKVVHLSLTVDHRIIDGELAGRFHNTMAALLAEPDRLLVG

SEQ ID NO: 39825 - protein, 714 aa, Oryza sativa (indica cultivar-group)
MATATQAPTSPAAASGRGSVLPLLRGRPSTRVRLAVGRRPQTALRAQPPGAAEVVEQSVNTIRFLAVDSVEKAKSGHPGLPMGCAPLGHVLFDEFLRFNPKNPYWFDRDRFILSAGHGCMLQYALLHLAGYDSVTMDDLKAFRQWGSRTPGHPENFETPGVEVTTGPLGQGFANAVGLALAEKHLAARFNKPDLKIVDHHTYVILGDGCQMEGVSNEASSLAGHWGLGKLIAFYDDNHISIDGSTGIAFTEDALARYEALGWHTIWVKNGNTGYDDIRAAIKEAKAVKDKPTLIKVTTTIGYGSPNKANTYSVHGSALGTKEVEATKNNLSWHHEPFHVPDEVKRHWSHHIDEGASLEAEWNKKIVEYEKKYRQEAAELKSIISGELPSGWDNSLPKYTPENPADATRNLSQQCLNALAKAIPGFLGGSADLATSNMTLLKMFGDFQKDTPEERNIRFGVREHAMGAISNGIALHSPGLIPYCATFFVFTDYMRAAIRLSALCGSRVIFVMTHDSIGLGEDGPTHQPVEQLFSLRAMPNILMLRPADGNETSGAYKIAVLNRQRPSVLALSRQKLQQLKGTSVEGVAKGGYIISDNSSGNKPDIILIGTGSELEIVEKAADELRKDGKTVRVVSLVCWELFEEQSEKYKESVFPSEVTSRISVEAGVTFGWEKYIGEKGKAIGVDRFGSSAPAGKIYKELGLTVENVIATAKSL

SEQ ID NO: 39826 - protein, 331 aa, Rhodococcus sp. RHA1
MNASAAPGQTLAMRWAINQALDEELERDPSVCLIGQDIGRAGGTFGLTRGLFDKYGAMRVRDSPISEEGMADLALGAAIAGCRPVLEIMFMDFLTLTMDALVNQAAKTYYLSNGAIAAPMVVRTLAGAGVRVGAHHSQSLESWFTHVPGLKVAYPSTPSDAKGMLKAAIRDDNPVIFVENKSLLGYKGAAPAEGDHVVPLGKAEVKRAGTDVTVVAYGRMVHVVLDAAEQLAKEGIDVEVVDPRTLMPLDTDTILASVAKTSRLAIVHEATGPSGFGAEIAARVADEGLYYLDAPIKRIAGAFYPIPTGEAEDLLFPDVARVVDSVRDLMA

SEQ ID NO: 39827 - protein, 344 aa, Rhodococcus sp. RHA1
MTTTSKKRPPAQQNPAADATVTERSDADLLSTYRLMVLAREFEEQLGAIFAAGKLGGWFHSCIGHEATGAAAAALMRETDHLVPYHRSRVSILGKGMTARDLAMEIMGRATAPSRGRAGETHINYAPARIYGTTGVLGANIPIAAGVAYGVQQRGLDEVVVCGFGEGTSNRGAFHEALNMAAIWDLPVIFICENNLYAEFSSSRDQMRCADVADRAAGYGIPGVVVDGNDPGAVYTTLAAAFERARGGGGPTLVEAKTYRLNGHYEGDPQSYRDKAEVAEWAERDPVTCYRARLLQQQNVTEEQLHTAEREAADEIRTAMTEALNAPPAGKDDIFGDIYAGGPL

SEQ ID NO: 39828 - protein, 331 aa, Glycine max
MGKQSTPQFSALNCIDLSNPDINQSVNLLKEACLDSGFFYVVNHGISQEFMDEVFAQSKKFFSLPHNEKMKTLRNEQHRGYTPVLDELLDPENQVHGDYKEGYYIGVEKGEDDPQSKKPFYGPNNWPAPDVLPGWRETMEKFHQETLEVGKAVAKMIALALDLDANYFDRPEILGEPIAILRLLHYEGQVSDPSKGLYGAGAHTDFGLITLLATDDVPGLQICKDRDAKPQKWEDVAPLKGAFIVNLGDMLERWSNCVFKSTLHRVLGNGQGRYSIAYFLEPSLDCLVECLPTCKSDSNPPKYPPILCHDYMTQRYKDTHADLNIYKKQQA

SEQ ID NO: 39829 - protein, 304 aa, Prochlorococcus marinus subsp. marinus str. CCMP1375
MHDFLPYAWFKGKCVPFDEAKISIATHALHYGTAAFGGMRAIPDPSDNGNFLLFRADKHAKRLSQSAKLLLTELSERYILQSIETWLKANKPSKPIYIRPFVYTSDLGIAPRLHNIETDFFIYGLELGDYLSPEGVSCRISSWKRQEDCSLPLRGKISGAYITSSLAKTEAVLTGFDEALLLNSQGKVSEASGMNLFIVRDGNLITPGTDQDILEGITRASVIEIANYLGINVIERPVDKTELFIADEVFLTGTAAKITPIKQIESTLLNTELPIMNKLRDYLISITENKEDKFSNWITSIKIS

SEQ ID NO: 39830 - protein, 550 aa, Cryptococcus neoformans var. neoformans JEC21
MGGGAPAGGDFEALLTQRQNEGWRGLFKNGRALGLACFASLGGVLYGYNQGVFGQVQVMYNFEQRYTATLTNPDTKGLLTSILELAAFVGALMAGPLSDRYSRKYSISAWCVVFMMGTAIQTGANSNVACIYAGRWFAGMGVGALSMLVPMFNAELAPPGIRGSLVALQQLAITFGILISYWIGYGTNYIGGTGAGQTTAAWRIPLGLQLIPGVVLCVGACFLPFSPRWLMLRGREEECLTNLARLRSSTEEAPEIQYEFRALQAERLVEREAAKERYGQEDVNFRVTMLEYKRLFTTRPLLHRLMLGAGAQALQQWTGINAIIYYAPTIFAQIGLTGSGASGTISLLATGIVGVVNFVFTIPAVLFVDNFGRRPLLAWGEANMAISHAIIAAIVAEFGDSFDSNKKAGNAAVFFIYWYIANFAVTWGPLAWVVSAEVFPLDMRAKGMSISSGVNWLMNFTVAMVTPHMIDNIGYKTYIVFMCFCVVGFLYSIFILPELKGLSLEEVDRVFHDESGAEDRARRERVAAQIGLDKVAEQIQHKEKVNDSEA

SEQ ID NO: 39831 - protein, 488 aa, Cryptococcus neoformans var. neoformans JEC21
MGGGAPAGGDFEALLTQRQNEGWRGLFKNGRALGLACFASLGGVLYGYNQGVFGQVQVMYNFEQRYTATLTNPDTKGLLTSILELAAFVGALMAGPLSDRYSRKYSISAWCVVFMMGTAIQTGANSNVACIYAGRWFAGMGVGALSMLVPMFNAELAPPGIRGSLVALQQLAITFGILISYWIGYGTNYIGGTGAGQTTAAWRIPLGLQLIPGVVLCVGACFLPFSPRWLMLRGREEECLTNLARLRSSTEEAPEIQYEFRALQAERLVEREAAKERYGQEDVNFRVTMLEYKRLFTTRPLLHRLMLGAGAQALQQWTGINAIIYYAPTIFAQIGLTGSGASGTISLLATGIVGVVNFVFTIPAVLFVDNFGRRPLLAWGEANMAISHAIIAAIVAEFGDSFDSNKKAGNAAVFFIYWYIANFAVTWGPLAWVVSAEVFPLDMRAKGMSISSGVNWLVSLLQRVSFRVALIIAVDELHCRYGHPSHDR

SEQ ID NO: 39832 - protein, 443 aa, Silicibacter pomeroyi DSS-3
MSHLFYQGRGRKPVLDQARGVYMWDKDGKRYLDGSSGAMVCNIGHSNPNVLAAMQRQMEKSTFGYRLHFETEASEKLASKLAALAPGGLDKVFFVSGGSEAVESALKLARQYMNATGQGSRWKVISRQPSYHGSTLGALAVTGYTPLSAPFEPMLRQMPKIPAPRAYLDGRDPRDPASGHHYANMLASAIEAEGPETVAAFIVEPVGGASTGALVPPAGYMERIREICDRYGILMIADEVMTGAGRTGRFLGSDHWNARPDIIVMSKGLGAGYVPLGAMIADARLVEPVLDAGGFAHGYTYAGNPLACAAGLAVVEEIEGQALCANADRMGERLLARLRGLMQKHEVIGDVRGMGLLTAFELMSDRDSKAPLPKGLNAYQRLVDIAYDKGLIVYSRRTRDGIEGDHILVCPPLIVTDDHLDEIIEGLDAALSQFADEIAGTAG

SEQ ID NO: 39833 - protein, 310 aa, Zea mays
  misc_feature (194)..(194): Xaa can be any naturally occurring amino acid
  misc_feature (211)..(211): Xaa can be any naturally occurring amino acid
  misc_feature (262)..(262): Xaa can be any naturally occurring amino acid
  misc_feature (267)..(267): Xaa can be any naturally occurring amino acid
  misc_feature (296)..(296): Xaa can be any naturally occurring amino acid
  unsure (1)..(310): unsure at all Xaa locations
NTRDPRVRAPLRPHSPAGRPAPNFDVIVVGAGIMGSCTAHAAASRGARVLLLERFDLLHPLGSSHGDSRIIRDAYAQPRYLRMVRLARRLWAAAEAEAGYRVLTPTPHLSMGPRSSASLAAAIANIGAEEVDEDDLHRRWGGAFALTVPGPVDAWVTALSDHCGVLTATNAVALFQSLPVAKCALVLDNPVVVXALKGCPSPTAAGSLVRXSGCEAFPWSQVALFSGASWGGHTFWLPGRWPSPSGRSHPFHLFWRLEPASXHPVSXSPGSPVLSLPGIPTCSGAPSLDLPRLSSXPWLCGAACQPRQPK

SEQ ID NO: 39834 - protein, 546 aa, Cryptococcus neoformans var. neoformans JEC21
MPVFSTLINSTESYQRRFDQMARAVLVYWVLKYVLLDGFRHIKARGLCGTANEIRNKIKSLVVRIMLAFPSNRAKLNSELAKTRAELKEKLAPSQYPDGVRLTTVRTLPETGRGREWLESEWENLKKLEKADVDNGRVSGAVYHGGDELNAVINEAMAKFVVTNPLHPDVFPGVRKMESEIVSMCLNLFNGPNGAGTTTSGGTESILMSVKTHRDWARVTKGITRPEMVIPSSAHAAFWKASEYFNIKLHVIPVNQKTRKAEVAAMKRAINPNTIMIVGSAPNFPDGAIDPIPELGALAKRRNVGLHVDCCLGSFIMPFLEKAGFSEGIDPFDFRVPGVTSISCDTHKYAFCPKGTSVIMYRSSELRRFQYYVITDWAGGVYASPSMAGSRPGSVLAGAWAVLNHIGADGYTSSCRQIISAARYLTSSLRTLFPDDLYVLGDPKGPVVAFNSKTINIYAVGDVMSKKGWHLSALGGDGGLHMAFTRLSAKSVDKLIEDLGDALKEVKASPQGAGGDMVALYGLGQTSAGPHVVGKLAETFLDTLYE

SEQ ID NO: 39835 - protein, 662 aa, Staphylococcus aureus subsp. aureus Mu50
MFNEKDQLAVDTLRALSIDTIEKANSGHPGLPMGAAPMAYTLWTRHLNFNPQSKDYFNRDRFVLSAGHGSALLYSLLHVSGSLELEELKQFRQWGSKTPGHPEYRHTDGVEVTTGPLGQGFAMSVGLALAEDHLAGKFNKEGYNVVDHYTYVLASDGDLMEGISHEAASFAGHNKLSKLVVLYDSNDISLDGELNKAFSENTKARFEAYGWNYLLVKDGNDLEEIDKAITTAKSQEGPTIIEVKTTIGFGSPNKAGTNGVHGAPLGEVERKLTFENYGLDPEKRFNVSEEVYEIFQNTMLKRANEDESQWNSLLEKYAETYPELAEEFKLAISGKLPKNYKDELPRFELGHNGASRADSGTVIQAISKTVPSFFGGSADLAGSNKSNVNDATDYSSETPEGKNVWFGVREFAMGAAVNGMAAHGGLHPYGATFFVFSDYLKPALRLSSIMGLNATFIFTHDSIAVGEDGPTHEPIEQLAGLRAIPNMNVIRPADGNETRVAWEVALESESTPTSLVLTRQNLPVLDVPEDVVEEGVRKGAYTVYGSEETPEFLLLASGSEVSLAVEAAKDLEKQGKSVRVVSMPNWNAFEQQSEEYKESVIPSSVTKRVAIEMASPLGWHKYVGTAGKVIAIDGFGASAPGDLVVEKYGFTKENILNQVMSL

SEQ ID NO: 39836 - protein, 348 aa, Staphylococcus aureus subsp. aureus COL
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFVNIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDAADELEQHIYSMIEHGQTTADLGGKLNTTDIFEILSQKLNH

SEQ ID NO: 39837 - protein, 409 aa, Gibberella zeae PH-1
MLSRALRLPRAVPMRTKLAAPAYTAVRSVTTDAASASLSHSVPKADDEPFSVNLSDESFETYELDPPPYTLEVTKKELKDMYREMVVTRQMEMAADRLYKEKKIRGFCHLSTGQEAVAVGIEHAITKEDDIITAYRCHGYALLRGASVRSIIGELLGRREGISYGKGGSMHMFAKGFYGGNGIVGAQVPVGAGLAFAHKYNNNKNASIILYGDGASNQGQVFEAFNMAKLWNLPALFGCENNKYGMGTAAARSSALTDYYKRGQYIPGLKVNGMDVLAVKAAVKYGKEYTAADKGPLVLEYVTYRYGGHSMSDPGTTYRTREEIQRMRSTNDPIAGLKQKILDWEITTEEELKKIDKEARAHVNEEVAAAEAMAAPEAKPEILFEDIYVRGSEPEYIRGRIPEENHYFQ

SEQ ID NO: 39838 - protein, 112 aa, Triticum aestivum
AWSRPRYINFSGIRMVFVSCHLAAHEHKVEKRNSECRHISHSLFSKNDIHYAKSADITVWLGGLNYRLEGISSMPARKMIEENRQSKLRDRDQLLQEAEKGQVFNGYLPGRP

SEQ ID NO: 39839 - protein, 491 aa, Sinorhizobium meliloti 1021
MALTPALTRHIRRPKIFASLDEVTRSSGQPAGPVFDVSNPSTGELLATLPDMGIDDARTAIDAAALAQPLWAGKPAKDRSIILRRWHDLIVEHADDLAAILTAEMGKPVGEAKGEVLHAASYVEWYAEEAKRVYGETFPAPANDRRMLVIKQPVGVVGTITPWNFPASMVARKISPALAAGCTIVLKPAEQTPLVAGAMFVLAEKAGFPEGVLNLLYASEGAPIGRELCGNPKVRKISFTGSTEVGRLLMRQCSDQIKKVSLELGGNAPFIVFDDADIDEAVDGAVQAKFRNAGQTCVSANRIYVQSAVHDAFAEKFVTRVRELTVGDGFAPDVAIGPMIDAHAIDKIEAHVADAVAKGAQVRSGGSRIGTTGTFFEPTVLTGISHDMRIAQEETFGPIAPIIRFETAEQVVAEANDTIYGLAAYFYAENLKRVWHVAEALEYGMVGINTGRMSSEAAPFGGIKQSGIGREGSRHGLEDYLEMKYLCMGNI

SEQ ID NO: 39840 - protein, 336 aa, Thermoplasma acidophilum DSM 1728
MTLDLNKLRFGSELIKRGFSAMTKGGVIMDVTTADQAKIAEAAGAVAVMALERVPADIRAAGGVARMADPMKIKEIMDAVSIPVMAKVRIGHISEAYVLEKIGVDMLDESEVLTPADPFFHLYKKNLTVPVVSGARNLPEAVRRIFEGAAMIRTKGEAGTGNIIEAVRHIRKVNEEISVLKRMSDEQLRAVASNISASYFVLREEASKDLMGVEGKLSYDSAYAGMGRSRIEREILAILRQIRRMGRLPVVNFAAGGVATPADGALMMELGADGVFVGSGIFKSPNPEKMARSIVEAVENYRDYDVVEKASEGLQGMPGVDIESIPKDMRLQERGW

SEQ ID NO: 39841 - protein, 575 aa, Magnetospirillum magnetotacticum MS-1
MRDGLGVSRGIAIGTVYLHDAGTITVPELRIPAARLDAECARFNEAAANAGHQVEQLQDKAGRLGGSAGEELGYLLDAYRQMLHGSRLVRGVEARIRNDRINAEAAVQQEINEIVRGFEAMDDSYLAARVADIKDIGRRLLRALTNTAYRPFTALPKNAVIVAEEMTPADTALLDPALVAGLATVVGGSEGHTAIMARSLGLPSVLGMAELLVGVKGGEQIIVDGTSGLVVINPRPETLAFYRKERAAFLKARRILGRLKDVPAVTRDAARITLQANMELPGEVGAVLESGAEGIGLLRSEFLYMNRDDVPSEDEQYLILKDVVERMGGRPVTVRTFDAGGDKLAPALGCTIGPNPSLGLRAIRLGLARQDLLEAQLAAILRASAHGPVRILIPMIATVGELRATREVMNRVIRRLRKSGVALPDPLPKLGAMIEIPGAALSADSIAWHADFFAIGTNDLVQYTLAIDRSDEAVAHLYNPLHPAVLRLIQFTAQAAHRANIPVSVCGEMAGDPRYAPLLLGLGLRDLSMTTSNLPVVKSRIRALELAAAEGLARTIMEQTDSGRIGQLLDAFLAR

SEQ ID NO: 39842 - protein, 175 aa, Oryza sativa (indica cultivar-group)
MASSSSAQETGRWSLAGATALVTGGSKGIGRAIVEELASFGATVHTCARNEATLNSCLEEWSAKKLSITSSVCDVSARADREALAGRVAAIFDGKLDILVNNVGFLFLKPAVNVTPEELSRVMAGNLESCFHQSQLMHPLLKTSGKGNVVNISGISTVTGFPSLPICAFCAAKGS

SEQ ID NO: 39843 - protein, 247 aa, Triticum aestivum
  misc_feature (219)..(219): Xaa can be any naturally occurring amino acid
  unsure (1)..(247): unsure at all Xaa locations
MADYEQEQEMELEALQAILMDDIKEIDPSESGIDTNSRCFEILLSPQDDDFDEAAHVPVQMALVFAHTEKYPDEPPLVNIKSVRGIKPDDLTSLKEKLDQEATENLGMAMIYTLLDSAKEWLTEKYGQNAGDEEPDETEEPAEEVIIPHGEAVTVESFMAWRERFEAELALQRAKLMPESALTAPKEKKLSGRQYFESGRHITKGAGTVAEEDEEEEEXIEFDDDFEDDEEDMLEHFLAEQTGKSSA

SEQ ID NO: 39844 - protein, 129 aa, Rickettsiella grylli
MSNLIQIIETEQMQSKQDIPDFRAGDTIAVKIKVKEGTRERLQSFEGVVIARRSRGFNSTFTVRKISHGEGVERVFPLYSPLTVSIEIKRRGDVRKAKLYHLRHLRGKAARIKEKLITAINSKEEKKIP

SEQ ID NO: 39845 - protein, 427 aa, Methanococcoides burtonii DSM 6242
MSIVEDAKAGKITEAMKVVANVEGLEPEFIMRGIAAGRIVIPTSPYRDVKLCGIGEGLTTKVNASIGASSDIIDEDMEVAKAKAAEAAGADTLMELGTGGDFLGIRKKVCDAISLSVGSVPLYQAFIGAAKRDGSIIHMTEDDLWNATEQQAKLGTNFMAIHTGINNIVLDRLKAHGRYGGICSRGGAFMTTWMLHNEKENPLYAEFDYLCEILKEHEVVLSTGNGMRAGAIHDATDRAQVQELIINSECAQKAHDKYNLQVIVEGPGHVPLDEVEMNVKLMKSMSGHKPFYMLGPLVTDISPGRDHIVTAIGAATSASHGCDFLCYVTPAEHLALPNIEDVIEGVQTSKIAAHVGDMVKLGKRDQDLAMGRARRDLDWKKMFSLALDPELARKIRTERSSADEDACTMCGDFCAVKIVNQNYNLAK

SEQ ID NO: 39846 - protein, 467 aa, Sphingopyxis macrogoltabida
MKEYPNLYIGGQWVSPHSDNMSTVINPSTEEVCAKIASGDKADVDAAVRAAREAFDSFSQSSRESRVKLLRDVVAGIQSRADEFAEAINQEMGAPLWWAQQAQVPAGIAHFATAADVLEKFKFVEAKGTTHLRREAIGVCGMITPWNWPLNQVACKIAAALAVGCTVVLKPAEQTPLDSILLAEVIDAAGAPPGVFNLVTGSGSVVGSALSDHPEVDMVSFTGSTRAGAMVAKAAADSIKRVSQELGGKSVNLVLPDADLQESVVRAVRSLMSNAGQTCSAGSRLLVPADRQEEAIAIAKQTAESIPVALSADADAPAIGPISTQRQYEQVKKLIGVGIDEGATLVTGGVESPSGATKGFFVKPTIFANVNNAMAIAQEEIFGPVLVIIAYEDVDQAVQIANDSPYGLSGYVQGPHEQAVEVASRIRTGQVFINNAHADFNAPFGGFKQSGNGREWGEVGFDEFLEY

SEQ ID NO: 39847 - protein, 756 aa, Ustilago maydis 521
MADVVRRPSSQADSGSGSRSYSQSPQKKNGLHRSDSLSSPTKKASISNGQPKKSSSVSSLPSSPSKEERKKLAKEILASGGDQLRHTLKQRGMLHALLSEPVKFIKSNQKQGQDYTTLGLTPVNDPDFAAVQKRKQEQKQHALLLHTDSPKINGNTHTSDSDLSVEAQSSPSKSGKARSRDLYPYKLSLRFPGKVRGVATGLSNYGNTCYMNSVMQSLIHTPPLAFALLTQDLDALHGELGGKPNVAFDAVAAMQTFAKGSLMGSKPTNAPRDFNRNLKAFARPLRQGRQEDAHEYLRFLLEALQQGCLSRASKSLKPDDPIRATSFVQKIFGGKLRSRVTCHKCGHNSDTFDPFMDLSLDVRKGINSLTDAFRAFVAKDQLTGSEKYKCDKCKRKVDATKQFTIETAPPALTVHLKRFSPFGGKISRQVAFDEKLNIAPYLSVNHGPVRYKLYAVVHHYGSGPNSGHYVASVRSPFGKWTRMDDSHVSEMGSSGPLGDQSAYILFYLKEKDDALEKAIAAVTPVKSGNKRKAVQESEVGSDSEEDDGAAIATAAVAALPPTKVPRSASNPANEDVSDSETSSSPPNQLNGTSEKLDLMLSSRPTSAASFYGSAASFRVSSNPFTVRSAAASGLDEELGTAVDRDEYESLVGSSTSDVIAASASAARRRTNAEADSESEEDSFAALSKKEKRKHKKAAQVIHAAKHSRGIPASPYASALTSLSSLSAKEQKKKKSKRDRDRQKPMGGFAGRMKPKY

SEQ ID NO: 39848 - protein, 534 aa, Neurospora crassa
MATAPAATQTASNATFRDKEKPIAVRSSNIVAARAAVADAVRTSLGPRGMDKMIMTGKGETIITNDGSTMLKSMSVMHPTAKMLVQLSHAQDVEAGDGTTSVVVLCGSLLGAADRLLGKGIHPSVISEAFQRAAAAAVDVLHDMSQPISLTDTASLLQAANTSLSSKIVSQYSNLLGPMAVNAVTKTIDLKTAENVDLKNIRIIKKVGGTIEDSELVDGLVLTQPVIKSAGGPVRMEKARIGLIQFQLSPPKPDMENTISVNDYRQMDKIVKEERTYLLNMVKKIKKAKCNVLFIQKSILRDAVNDLSLHFLQRLGILAVKDIERDEVEFICKSTGCKPIADIDSFTEDKLGSADLVEEVNSSGSRMVKVTGTKSAGKTVSVVVRGANSLILDEAERSLHDALCVIRCLVKKKALIAGGGAAEIEIASQLAKQSRALSGTEAICWKAFADAMEVIPTTLAENAGLNSIKVVTDLRHRHENGEKNAGVSIKSGGVNPNIAKENVLQPLLVSTSAIELAAETVKMILRIDDIALSR

SEQ ID NO: 39849 - protein, 412 aa, Solanum lycopersicum
MNALAATNRNFKLAARLLGLDSKLELSLLIPFREIKVECTIPKDDGTLASFVGFRVQHDNARGPMKGGIRYHPEVDPDEVNALAQLMTWKTAVANIPYGGAKGGIGCSPSDLSISELERLTRVFTQKIHDLIGIHTDVPAPDMGTNPQTMAWILDEYSKFHGYSPAVVTGKPVDLGGSLGRDAATGRGALFATEALLNEHGKSVAGQRFVIQGFGNVGSWAAKLIHEQGGKVVAVSDITGAIKNEKGIDIESLFKHVKETRGVKGFHDAHPIDANSILVEDCDVLIPAALGGVINKDNHKLKIKAKYIIEAANHPTDPEADEILSKKGVTILPDIYANSGGVTVSYFEWVQNIQGFMWDEKKVNDELKTYMTRGFKDVKDMCKTHNCDLRMGAFTLGVNRVARATVLRGWEA

SEQ ID NO: 39850 - protein, 676 aa, Ostreococcus tauri
MRAHGSRAASASSRIAADATAVVTTSSALCARANASLGASARRMRAMYSTMSTTTAERTRNVAVIAHVDHGKTTLMDALMKRASGGASSDERAMDSRSLEKERGITISAKYTSLHFELEGSGGYVVNAVDTPGHADFGGEVERALDMVDGCLLLIDPSEGVMAQTKFVLRKALKKGLKPIVVFNKVDRDGVTEASCAKVETEVFDLMAALGANDEQLDFPVAYASARAGAASSISVNDAQRQIIENRASVDAILRLVCDRVPPPSGDANEPFSMLVSMIDRDPFLGRVVTGRVVNGSLKVGDRINALKLADGSVRETARVQKIFTSKSLSRVEIDRCVSGDIVTIAGFSGATVTDTLCDVSVVDPLASTPIDPPTLRMMFSVNDSSLAGKEGKQLTERQIEERLRAEAETDVALRVEPQAGRGIEVQGRGELHLGVLIETMRREGFELSVSPPTVIYATDEDGRKTEPLEELILEVDANDVGTVIEAVTHRKGELSDMEPNAGEEGRTRLVFVAPSRGLIGFRQDFINATRGTGLMQRAFHSYGAARGKMDKVRKGMLISTTSGVTTTYALGALEPRGTLFVGPAEEVYEGMIIGEHSRENNLEVNPTKEKKLTNVRADGKDDTVRLTPPKAINLEEAIGYVAEDELIEVTPKVIRLRKAETSSSMRRRNSRHASA

SEQ ID NO: 39851 - protein, 446 aa, Synechocystis sp. PCC 6803
MISARQLAFLILRDINRRDSYTDVAIDRALQKHPLSPPDRRFCTELVYGVVRRQRTLDCLIEQLGDRPIGKQPPDLRRIVQLGLYQLRYLDQVPASAAVNTGVDLAKANGLKGLSKVVNGMLRRYQRAEEQGKNILDQEKISLGEQYSFPDWLMELFEQTWGKAETESLCAYFNQNPSLDLRINPLKTSRVEVAQSLAELNLTTTAMAGLPQGLRLGGKTGAITQLPGFAEGWWTVQDASAQWVAQILNPQPEETIFDVCAAPGGKTTHIAELMGDQGQIYAGDRHGWRLQKLAVTQQRLGLTSIKIWEGDLTQPGVKPPVELVDRALLDVPCSGLGTLHRNPDLRWRQTPATIATLLPLQQALLKAIAPLVKSGGTLVYSTCTLNPAENEAQIERFLQDHEDWRSEPFEWTSPQGQTNSVTSGMLTILPHHHHQDGFFIANLKKA

SEQ ID NO: 39852 - protein, 440 aa, Rickettsiella grylli
MTQSAEVTTKDVSSPTAILTVNDVPPIHLPVCKGTLGPEVIDVTQLAKVNRFTYDPGFLSTASCASKITFIDGEKGILLYRGYPICQLAEKSDFIEVAYLLLHGELPNQAQKISFNGAINQHTMVHEQLRHFFHGFRRDAHPMAIMLGVVGALSAFYHDLLDIHNKAHRELAALRLIAKMPTLAAMSYKYATGLPFMYPLNHLSYTENFMHMMFGVPTEASAPNPLLARALDKIFILHADHEQNASTSTVRLAGSTGANPYACISAGIAALWGRAHGGANEACLNMLHEIREISRIKHYIEKAKDPNDSFRLMGFGHRVYKNYDPRAAVMKKTCHDVLEETDQKEVPLFKLALTLEKIALEDPYFIERKLYPNVDFYSGITLSALGIPTNMFTVIFALARTVGWISQWEEMMSDPKLRIARPRQLYVGSPKRNYKPIEKR

SEQ ID NO: 39853 - protein, 165 aa, Polaromonas sp. JS666
MSTVASVKDFVSSFMLTELFKGMALTGKYMFSRKITVQFPEEKTPLSPRFRGLHALRRYDNGEERCIACKLCEAVCPALAITIESEVRDDGSRRTSRYDIDLTKCIFCGFCEEACPVDAIVETHIFEYHGEKRGDLYFTKEMLLAVGDRYEAEIAANKAADAKYR

SEQ ID NO: 39854 - protein, 451 aa, Arabidopsis thaliana
MKALCDRFVPQQCSSSSKSDTHDKSPLVSDSGPSDNKSKFTLWSNVFTSSSSVSQPYRESSTSGHKQVCTTRNGWTAFVKRVSMASGAIRRFQERVLGPNRTGLPSTTSDVWLLGVCYKISADENSGETDTGTVLAALQLDFSSKILMTYRKGFEPFRDTTYTSDVNWGCMIRSSQMLFAQLPEQEYLETLEPFGDSEPSAFSIHNLIIAGASYGLAAGSWVGPYAICRAWESLACKKRKQTDSKNQTLPMAVHIVSGSEDGERGGAPILCIEDATKSCLEFSKGQSEWTPIILLVPLVLGLDSVNPRYIPSLVATFTFPQSVGILGGKPGASTYIVGVQEDKGFYLDPHEVQQVVTVNKETPDVDTSSYHCNVLRYVPLESLDPSLALGFYCRDKDDFDDFCLRALKLAEESNGAPLFTVTQTHTAINQSNYGFADDDSEDEREDDWQML

SEQ ID NO: 39855 - protein, 299 aa, Kineococcus radiotolerans SRS30216
MTNTADRAVTVTSAVLRDWPLPPPGTGKESRGRTIVVGGSTRTPGAVLLAAESALRCGAGKLQVATTRSTAPAMGVAVPEALVLPLPETGGGGIDPACAAEGGELVDLVRNAHAALLGVGAVDEPDVRALLEQLVPGLGNVVVLDALGLAPVTADVTFLHHLQGSAVLTPNLAELAIVLGAEPEEVEADVASAAVELARRSRCAVAAGGGESWIAAPDGRLWRDSSGGAGLGVSGSGDVLSGIVTGLCARGADPVQAAVWACHLHGRAGDRLASSVGRLGFLARELPAQVPAVLAEIEV

SEQ ID NO: 39856 - protein, 338 aa, Prochlorococcus marinus str. MIT 9211
MNSPKVICVGEALVDRLGPCGGDPAVDKPVQDCLGGAPANVACGLARLGIDAAFIGCLGDDSIGAEFRRLFMSRDVNIAGLQIHPELPSRVVLVRRDLSGERTFEGFEGDHRKGYADQHLGLTQLKETLPALFQEASWLLLGTILLASKSSKEAVLWMVDQAKKYSLSIAIDINWRPTFWDPNSSPDSPPSREIKLAIHDLLKHADLLKLAKEEAVWFFNSHTPTEISNSLPKKPSVIITDGSRPINWVLGESVGHMKTSVPRKVVDTTGAGDSFTAGIISQLLQTPLSQGDLLNPKEIVRFAAACGALVCEGAGAIEPQPIYGQVKEFLSLDVGEKS

SEQ ID NO: 39857 - protein, 380 aa, Thermoplasma acidophilum DSM 1728
MVRLSKDLQFPIRDSFDRNAFSVNFPIYATTAYRSPEGDHFRYSRENNPTVEELARQISLLEGSQLAACFSSGMGSISTVFLSLLKPGDGLVLPMDVFGRTYLFAKDFLSRFGINVSITDPGTDKVIEAIGDKTRMIFVESLSNPVLRVYDIKRLSDSAKQNNALLVVDDTIITPVGQRAIDHGADIVVNSLSKFIGGHNAAIGGSSSGSSEFIKNIDSDRRSLGSSMDPFSAFLFLQGMKTLKIRIERSSRSAQIIAEHLSTLDHVERVYYPGLTENDYHDLALRTLKNYGSVVSFVLDDGVDASKFMSSLERIIPANTMGSVETLISNPYSMSHRNLSDKERARIGVVPGLMRLSVGIEEISDIMDDIENAIKKSLKS

SEQ ID NO: 39858 - protein, 1290 aa, Spiroplasma citri
MTLMEFTIQGNKFNNKNLLLNLYFLTNPKSKFTDDDVKNLRLKDITTVQGLDTFLKHNICIADFFVSLINDQAKIKKDKKGSEKKLYDILIRFKSITLLDQMLDSNLSLTILGDIDPEIGIVNVKNIFLTAMEKEKQEFETLATGVVLEVADNFRLDEAKLRTIFDSNVMANMKFLTSSFAEEKERWLQYLRFQEQNLEYKRNNSCLYLKRKLTEYIKIPKTVPIGEKMHDTRFLAHNFWYVDKKNFTNKNLTIGNLFEEIIIVELELLLDNLNKYSILKKLNNLSLANLQINRTYQKDVPLTLFSFNFSESYVQDGADIYDLAVNIPETKMQQKDNYDFKKELIKIYMIENDIKQESDIDHETIKVTINQLEQYQIVNCFYEIKNEDEISFNELNKIIPPYGYLTYIGKGDSTLLRRSNVILDKISKNDVANPYLINYIFNIEDIKLKTQSNLITEKQLTFASNNLNGNQQKAIAKALNSQDIFLLQGPPGTGKTEFIAELVYQYAKLGKKVLISSQNHVAIDNVLTRLVKTPLLVPLRLTGEAVRKKNRFNDFNPDKLIFNNYRFIYAHLLRQYLTKWTGIGNDYENQKYELQKLKANAKMLEKEINDYNHYTQKLNTLVAEREIIINQKLQYQTDDRKLTININNIRNLLDFLGNINWDGIVTSTPDLVQLFNKHFGKLLQAKFGFQIDESYSLIETYKKLLTITTDNKALKDKEIELAELKQVSQELRDDDWMERLTVVQSEILELKNQFTLKQENIVFQKEQEAFKNDLEQLLQQYEEQSAIIQNKISEINENKYEQEISYLEIETGTLNYKINALKVEVENIVNSINTIFNLNLVVKDISGTINEIDKEINKIEHDLNFMFQEKATKFNFVNNMITFLNKNYKISDFLTQENIETNHFTSAMERDTISYANQFLQDSVNVVAMTATSNQSYAQSKNKILRDYNISDIDIKKFAFDVVIIDEVSKLTPMEIFMPLVYGKTVILVGDYRQLPPIMPYQEEDVALINEIYEENYSYHNFLELVTNSLFKKIISKCDDSVKEILVNHYRSHEDIMRIVNFFYENQLQLGDKTNQNNEKQHYITVENKEGLKIFDSNKAIYWIDSSKDKTNMNFVYEQGESGSTSLFNWLEIDLTIKALELIEAGYNNLTVKLKKQPKVAVISFYSLHVKKLRKAINSLKFKNIKVEVSTVDDYQGRETEIVIVNTVRNPHKQLSANKEFIKKYERLNVAFSRAKNMLIIIGAVSFFTNIDVEIPTIANPNITKTIKAYYEILRIIDSYGLVWRAKDLL

SEQ ID NO: 39859 - protein, 137 aa, Capsicum chinense
MAKSLALFLLFNILFFTVVSACNTCPGPKPKPKPKPKPTPKPCPPPPSKEGGKCPTDALKLGVCANVLNGLLNVTLGKPPVEPCCSLIENLVDLEAAVCLCTALKANILGIKLNLPISLNLLLNVCSKKAPKGFTCP

SEQ ID NO: 39860 - protein, 146 aa, Phaseolus vulgaris
MGAFTEKQEALVNSSWEAFKGNIPQYSVVFYTSILEKAPAAKNLFSFLANGVDPTNPKLTAHAESLFGLVRDSAAQLRANGAVVADAALGSIHSQKALNDSQFLVVKEALLKTLKEAVGDKWTDELSTALELAYDEFAAGIKKAYA

SEQ ID NO: 39861 - protein, 507 aa, Prochlorococcus marinus subsp. marinus str. CCMP1375
MTITITTPLYYVNDKPHLGSTYTTIACDAFARYKKLNGNNVVFITGVDEHGQKIERTAKANNISPSDHCSKIASQYEMLWKKWSISNDKFIRTTSSQHKTLVEKFFHRVDQNGDIRLGRQQGWYCVGCEEYKDDPPGAKDPICSTHKMPLEWRDEENLFFCLSKYQTKIENLISQPNFVQPISRRNEIINFVSKGLKDFSISRVNISWGIPVPGFKGHTFYVWFDALLGYLSGLQTKGEVELDELNNYGWPADVHVIGKDILRFHAVYWPAMLMSAGLDLPHRVFGHGFLTREGNKMGKSLGNVLDPELLLDKYGEDPVRWYLLSDIKFGQDGDFQEKRFIDLTNNDLANTIGNLLNRTSSMSRKWFSNCVPNIHKENENNELKLLASKTISDVINYYEQLSFKEACKAILDLASSSNLYLNDNEPWKLIKQNSERELVSYHLYNVLESCRIVATLIAPVLPNLSRKILNQLGFFDSLQSWEHQLVWGVLEKGQELPEPSPIIPRLE

SEQ ID NO: 39862 - protein, 264 aa, Triticum aestivum
  misc_feature (153)..(153): Xaa can be any naturally occurring amino acid
  misc_feature (169)..(169): Xaa can be any naturally occurring amino acid
  misc_feature (187)..(187): Xaa can be any naturally occurring amino acid
  misc_feature (199)..(199): Xaa can be any naturally occurring amino acid
  misc_feature (216)..(216): Xaa can be any naturally occurring amino acid
  misc_feature (252)..(252): Xaa can be any naturally occurring amino acid
  unsure (1)..(264): unsure at all Xaa locations
MEDERSTQSYQGGEAAEQVEVTDRGLLGNLLGKKKAEEDKEKQEELVTGMEKVSVEEPEVKKEEHEDGEKKETLFSKLHRSSSSSSSSSDEEEEEVIDDNGEVIKRKKKKGLKEKLKEKLPGHKDTEGEHVTGLPAPAAPASVQTHHDTDVVXVEKIDGDVKTEAAPAXCPEEEKKGFLEKIKEKLXPGGHKKPEDAAXVPVTHAAPAPVHAPGAXPPEEVSSPDAKEKKGLLGKIMDKLPGYHKTGEEDKXAAAAAGEHKPSA

SEQ ID NO: 39863 - protein, 554 aa, Triticum aestivum
ALLASREMLLEELKKIGGAVGKTIEDLDDADLSLGKYESLQPSKPAHPDSGKVFPVTTKGVGHLAGILHDFLERPNDVVDGTTDGMLYTLSREELLELFVTVSSQLSLLWNAFLKFHRINKTKILDYLRDIWAVDRKAEWSIWTNHSKIEIPHRYLRSMSDDPPHRQHSLLRVSGSRKFHEDPVQNSASRAELHRKSIAQMKINTRSVQDMHIYADPSRVPVVLIEQHVMVVPQHGSNKDLASSSSEQKDTIVLPKLQGESLVLKNINGKKGGRVLRAVIFVHGFQGHHLDLRLVRNQWLLLDPGAECLMSEANEDKTSGDFKEMGGRLAGEAVAFLKKKVDKLARHGGCKELKLSFVGHSIGNIIIRTALAEPALQPYLKNLYTYMSISGPHLGYWYSSNSLFNSGLWLLKKLKGAQCIHQLTFSDDQDPQNTFFYRLCKSKTLENFKNIILLSSPQDGYVPYHSARIELCPAASADNSRKGQVFTEMLNNCLDQMRAPSSETRIFMRCDVNFDQSAHGRNLNTMIGRAAHIEFLETDIYARFIMWSFPELFR

SEQ ID NO: 39864 - protein, 117 aa, Zea mays
MAMAPSAACVVSFPARPAASTAGPRAAAGAGAVHAFAGSAEGAKWWAPLLGWSGKADYLEAPAPAPAGAQDEAPRRQFVGVMTEEKARELRARMAQTESFHDAMYHSAIASRLARSS

SEQ ID NO: 39865 - protein, 426 aa, Hordeum vulgare subsp. vulgare
MAAADTSRVFLILIIALVMVIVVLLGICWRFLGPGIMRRLLRPRRCPSEVPEYFSGNMSGNLRTITYFDYVTLKKATKDFHQKNQLGRGGFGPVYLGKLDDGRKVAVKQLSVGKSGQGESEFFMEVNMITSIQHKNLVRLVGCCSEGTERLLVYEYMKNKSLDKILFAAADAPAPASAPPFLNWRTRHQIIIGIGRGLQYLHEESNLRIVHRDIKASNILLDDKFQPKISDFGLARFFPEDQTYLSTAFAGTLGYTAPEYAIRGELTVKADTYSFGVLVLEIISSRKNTDLNLPNEMQYLPEHAWRLYEQSKILELVDGRVQGGEGFEEKEVMLVCQIALLCVQPYPNSRPAMSEVVRMLTMKTDQSIPAPAKPAFLDRKNLNGDRDAASSDTATMEMMRSPAGYWMMTPSPMLEVDRPYDMSFGK

SEQ ID NO: 39866 - protein, 285 aa, Methanococcoides burtonii DSM 6242
MNDIPEVPEGIDASVDKAGAGIEEIVKISSSSIDPEFLETLRSLGVDESQIEISDDVLCEPVEIFVTLAKNGDINPWDIDIVEVTDKFLAYIEDLKIMDLRISGRTLLYASILLRMKSTGLAQEEVELDDDLLDDEMDFYDIEEYPVPKLPIRRTATRPVTLQELITELKKAEKVETRRKDRRIRRRLEVFDRVTTDDVLGIAHEEDIRGRVDTLYTSLEELFRTRDEVMFSDLVDWSGSRSERLMTYISLLFLASEKKVLLAQEELFGELFVHPPSVIELFEEE

SEQ ID NO: 39867 - protein, 476 aa, Burkholderia pseudomallei K96243
MSKEFDVVVIGAGPGGYIAAIRAAQLGKTVACIEKWKNPAGALKLGGTCLNVGCIPSKALLASSEEFENAQHHLADHGISVDGVKMDVAKMLARKDGIVEKMTGGIEFLFKKNKITWLKGHGKFTGKSDAGVQIEVSGEGETQVVTAKNVIIATGSKARHLPNVPVDNKIVADNEGALAFDSVPKKLAVIGAGVIGLELGSVWRRLGAEVTVLEALPAFLGAADEALAKEAAKLFKKQGLDIHLGVKIDGVKTGANGVSIAYTDKDGNAKTLDADRLIVSVGRVPNTDNLGLEAIGLKANERGFIDVDDHCRTAVPNVYAIGDVVRGPMLAHKAEDEGVLVAEVIDGQKPHIDYNCIPWVIYTYPEIAWVGKTEQQLKAEGREIKSGKFPFSINGRALGMNAPDGFVKMIADAKTDELLGVHVIGANASDLIAEAVVAMEFKAASEDIARICHPHPSMSEVMREAALAVDKRSLNS

SEQ ID NO: 39868 - protein, 437 aa, Clostridium thermocellum ATCC 27405
MFVSKALKVNSKNHLEIGGCDCVDLVNNFGTPLYVMDESLIRENCRIYKNALDKYYNGNGLVLYASKAFCTMAMCKIVQQEGLGLDVVSGGELYTAIKAGFPMEKVYFHGNNKTIDELELAIDNNVRRIVVDNRQELLHVNRIAAEKGKTVNISFRIKPGIDAHTHDFIRTGQIDSKFGVALENGEAMEIIGEAVKLSNVKVVGLHCHIGSQIFELAPFEEAARVMLTFIAKIKEELGIEIEELNLGGGFGIKYTQDDDPIEYDRYIKSVSEVVKSVCEDKGIKLPFIVIEPGRSIVASAGITLYRIGTIKDIKGVRKYIAVDGGMTDNPRYALYQSKYEGVIANKADAAKTEKVTIAGKCCESGDLLGKDVLLPEAEEGDILAILATGAYNYSMSSNYNRIPRPAVVLVKDGKARVIVKREDYNDIIRNDIIPEDL

SEQ ID NO: 39869 - protein, 425 aa, Burkholderia pseudomallei K96243
MAIVEVKVPQLSESVSEATMLQWKKKPGEAVAQDEILIELETDKVVLEVPAPAAGVLAQVLQNDGDTVVADQVIATIDTEAKAGAAAAAAGAADVQPAAAPVAAPAPAAQPAAAAASSTAAASPAASKLMAEKGIGAGDVAGSGRDGRITKGDVLSAGSAPKAAPAAAPAKAAAKPALPEVKVPASATTWLNDRPEQRVPMSRLRARIAERLLESQQTNAILTTFNEVNMQPVMDLRAKYKDKFEKEHGVKLGFMSFFVKAAVHALKKFPLVNASIDGNDIVYHGYFDIGIAVGSPRGLVVPILRNADQLSLAEIEKKIAEFGQKAKDGKLSIEEMTGGTFSISNGGVFGSMLSTPIINPPQSAILGVHATKERPVVENGQIVIRPINYLALSYDHRIIDGREAVLSLVAMKDALEDPARLLLDL

SEQ ID NO: 39870 - protein, 194 aa, Hordeum vulgare subsp. vulgare
MMLSSAYSTPAADELGGPPPLPPPPGADVSVIVGALTGVLLGLFLFLIYAKHCRQRGRGGARGAAGGLGLGFRASSTCDRCRSGVSLSVVDALPVVRFGDMGGAAAAAQPECAVCLGTFDPAADELLRVLPKCRHAFHADCVDTWLEAHSTCPVCRRRVGKEDAFAVIPELEAADADWYPAREAEMQIVVRRPA

SEQ ID NO: 39871 - protein, 386 aa, Ustilago maydis 521
MWVDEAKRVRGVAFERRELLKTRWSKRSTALLSGVAQPLGRVRAITSNAIVNQVKRFSVPEFTIGQNHEYEAPNTHDEFRIRDLIVDSTGNFYRPNRYTLRKSHTRDSRLTTRDWDYENREPFTIHDSRLFMISLTSRTHRHTRARIVAEFKRASWRQSQKVLDAGFDRLDSCPRTWLAHQATPLYTLSQTHLVLRCTLHPPNRGCQNVANMGQQGSQLLSDIEATSNFNSKEIQRLKKRFMKLDRDGSGSIDKDEFLQIPQIANNPLALRLIAIFDEDGGGTVDFQEFVAGLSAFSNQGSREEKLKFAFKVYDMDRDGLISNGELFLVLKMMVGNNLKDQQLQQIVDKTIMEADTNGDGKLDFDEFQAMVANTDVAKQLTLEDLF

SEQ ID NO: 39872 - protein, 170 aa, Bacillus cereus ATCC 14579
MDFKQHIAIVPDYPKEGIVFKDITPLMNDGKAYKAATDAIVEYAKERDIDVVVGPEARGFIIGCPVSYALEVGFAPVRKLGKLPREVITVDYGKEYGKDVLTIHKDAIKPGQRVLITDDLLATGGTIEATIKLVEELGGVVAGIAFLVELTYLDGRKMLDGYDVLVLEKY

SEQ ID NO: 39873 - protein, 174 aa, Glycine max
MKRAFSVDTAEDNKNNRNTKKTKLDSEEEEEHGTRGGSVYLDDNVLFEVLKHVDARSLAMAGCVSKQWQKAARDERLWELICTKQWANTGCGEQQLRSVVLALGGFRRLHALYLWPLSKPHAPSSSSSSSSWPAIPHVLRSKPRWGKDEVHLSLSLLSIRYYEKMNFLNTKKNT

SEQ ID NO: 39874 - protein, 467 aa, Sphingopyxis terrae
MKEYPNLYIGGQWVSPHSDNMSTVINPSTEEVCAKIASGDKADVDAAVRAAREAFDSFSQSSRESRVKLLRDVVAGIQSRADEFAEAINQEMGAPLWWAQQAQVPAGIAHFATAADVLEKFKFVEAKGTTHLRREAIGVCGMITPWNWPLNQVACKIAAALAVGCTVVLKPAEQTPLDSILLAEVIDAAGAPPGVFNLVTGSGSVVGSALSDHPEVDMVSFTGSTRAGAMVAKAAADSIKRVSQELGGKSVNLVLPDADLQESVVRAVRSLMSNAGQTCSAGSRLLVPADRQEEAIAIAKQTAESIPVALSADADAPAIVPISTQRQYEQVKKLIGVGIDEGATLVTGGVESPSGATKGFFVKPTIFANVNNAMAIAQEEIFGPVLVIIAYEDVDQAVQIANDSPYGLSGYVQGPHEQAVEVASRIRTGQVFINNAHADFNAPFGGFKQSGNGREWGEVGFDEFLEY

SEQ ID NO: 39875 - protein, 417 aa, Polaromonas sp. JS666
MAEIKNYTLNFGPQHPAAHGVLRLVLELDGEVIQRADPHIGLLHRATEKLAESKTYIQSLPYMDRLDYVSMMSNEQAYCLAIEKLLGVDVPIRAQYIRVMYAEITRLLNHLLWLGAHGFDCGAMNILIYCFREREALFDMYEAVSGARMHAAYFRPGGVYRDLPDTMPQYRVSKIKNAKAIAALNENRQGSLLDFIDDFVAKFPRLVDEYETLLTDNRIWKQRTVGVGVVSPERALNLGFTGPMLRGSGFAWDLRKQQPYDVYDRMDFDIPVGKTGDCYDRYLVRIEEMRQSNRIIKQCIDWLRVNPGPVITSNHKVAAPDRESMKTNMEELIHHFKLFTEGFHVPEGEAYAAVEHPKGEFGIYIVSDGANKPYRLKIRPPGFPHLAAMDEMSRGHMIADAVAVIGTMDIVFGEIDR

SEQ ID NO: 39876 - protein, 112 aa, Pseudomonas aeruginosa PAO1
MDCLFCKIVAGEVPARKFYEDEEVVAFHDIGPQAPVHFLVIPKRHIPTLEHLTEADRPLAGHILFTAQRLAREQGCEEGFRVVMNCNDLGGQTVHHIHMHVLGQRQMHWPPG

SEQ ID NO: 39877 - protein, 227 aa, Methanosarcina acetivorans C2A
MPDIKLLSEGIFEIMKDKRQLATLNLDPGKVVYGEKLISVEGAEYRTWDPRRSKLGAMVLKKFNIPLSKDSKVLYLGAASGTTVSHVSDIASEGAVYSVEFASRSMRDFIRLASRRKNIFPILADAGKPDSYAHIVEPVDLIFQDVAQPNQAEIAARNAARFLNKNGYLLLSIKARSIDTAASPKEIFKEEVKKLEQAFEPGFEILTARDLMPYHEDHLGVLAKLKE

SEQ ID NO: 39878 - protein, 335 aa, Campylobacter coli RM2228
MKNLILAIESSCDDSSIAVIDKDTLECKFHKKISQEMEHNVYGGVVPELAARLHSEALPKILEQCKGYFDKLCAIAVTNEPGLSVSLLSGISMAKTLALSLNLPLMAINHLKGHIYSLFLEEPICLDMGILLVSGGHTKVLYLKEDGKIEILARTNDDSFGESFDKVAKMMNLGYPGGVLIENLAQKAKSKNIHFNIPLKHSKELAYSFSGLKNAVRLEILKHENLDEDIKAEIAYGFENAACEHIMDKLEKIFNLYKFKTFGVVGGASANLNLRSRLQNLCEKYQSKLKLAPLKYCSDNALMIARAGVDTYKRKEFVELEEEILSPKNKNFLRM

SEQ ID NO: 39879 - protein, 206 aa, Synechocystis sp. PCC 6803
MAQTPLRIGIAGPVGSGKTALLEALCKALRQKYQLAVVTNDIYTQEDAQFLVRAEALTPDRILGVETGGCPHTAIREDASLNLAAIADLEARFMPLDMVFLESGGDNLAATFSPELVDLTLYVIDVAAGDKIPRKGGPGITKSDLLVINKIDLAPMVGADLGIMDRDAKKMRGEKPFVFTNLKTATGLSTVVDFVEHYLPTKVLAS

SEQ ID NO: 39880 - protein, 245 aa, Polaromonas sp. JS666
MNGSLAANAALLEALGEGLKDLSLPLTCEVAVCVPAPYLAQVQGLKSSRSSLSALAVGAQDVSAQASGAYTGEVSAAMLQDFGCRYVIVGHSERRQYHGESDALVADKAKAALAAGITPIVCIGETLAEREGGHTEEVVKRQLAAVIHVNGHCISEIVVAYEPVWAIGTGKTASPEEAQAVHAVLRAQLRAATDHPMRVKILYGGSMNAANAAALLSQPDIDGGLIGGASLKAPDFLKIIAAAQI

SEQ ID NO: 39881 - protein, 359 aa, Azoarcus sp. BH72
MTTPHRIAVIAGDGIGQEVMPEGLRAVQAAAAKFDIALEFTHFDWAHCDYYLQHGKMMPDDWFEQLKGFDAIFFGAVGWPDKVPDHISLWGSLLKFRRDFDQYVNLRPVRLMPGVPCPLANKKVGDIDFYVVRENTEGEYSSVGGKMYEGTERETVLQESIFTRKGVDRILKYAFELAQKRPKKHLTSATKSNGIAISMPYWDGRVKEMGKAYPEVKWDQYHIDILTARFVLSPERFDVVVASNLFGDILSDLGPACAGTIGIAPSANLNPDRTFPSLFEPVHGSAPDIYGRNIANPVAMIWSGAMMLDFLGNGDARYTAAHDAIVKAIETVLVEGPRTPDMGGTANTTEVGKAVAAAI

SEQ ID NO: 39882 - protein, 700 aa, Oryza sativa
MAMDAAPALKRKDADPPELWMGGGAAAAASGFPVSSRATKIRRLDAEVPPVVPGVCVPPAPPTQQQPVAGLGAGDVRVFGDQVPVGMAPAAAAAAAAKRKGEDAPELWLDDGGAASGFPVSSRATKIRRLDADVPPPVVPELCAPPPPPQPVAEVQMRGEEVPVIAVPAPNEERAIVLYKPDDAARNLLLGPLRPEFPLRVSPDWIHGLKSTALREASEHRALFEELAMDETSNLAMVPWVPVPSNSQEASTSAAATATTTTEMMDAEDTSMEVEQDGGSGGSHLAAAGEAPYYQWPQHCMAPPPQPPLPAFFLVLAAQWRLSRSWSENRDEILWPCQMEAERSRPYEPTAKDRIDETTPVCATHLSRLGPVNYIFARSRRELRPPFAPLLYRCCQAHHRKSCKKPMGNSKTPQPSKKSRIMLSDTDGHQLDNDEFSSESASNQMVLFNPETVAKGQDELGENHSPSLQKSANNPNRGMPSIGAFTVQCAKCFKWRLIPTKEKYEEIRECIIQEPFECERAREWRPDVTCNDPEDISQDGSRLWAIDKPNIALPPPGWERQIRIRGEGGTKFADVYYTSPTGRKLRSLVEIDRFLGPLRQDYVKKRPKIVNPNDEASVVTTKSVKPEEVSPIAWAAPSVHQEGEAGERASHADEPPEAEELELTRKRKAESPLFEEAHSNHVSDEPKTKLEDTQNGGPSA

SEQ ID NO: 39883 - protein, 389 aa, Rubrobacter xylanophilus DSM 9941
MKAVVWHGRQDVRVESVPDPELREPTDAIVRVTSTAICGSDLHLYGKLAPIMREGDILGHEPMGVVEEVGSGVEHIKPGDRVVVPFNISCGSCYFCNMQLYSQCERTRDRGRLAEAASLLGRGKGASLFGYTHVYGAVPGGQAEYLRVPQAHFGPIKVPEGPPDERFLYLSDVLPTSWQAVAYADVPEGGTLAVWGLGPIGQMCCRIALHRGAGRVIGVDAVPERLDLASRYGVETLDYSAVDRAGLAVVEMTGGRGVDAAIDAVGMEAGGSLVDAVLQATRVQLDRARALRECAASVRRGGTLSIVGVYAGPIQMFPLGDLFDMQVQLRMGQANVRRWTDEILPLLADEDPLGVEELATHRLPLEEAPRAYETFQRKQDGCIKCVLRP

SEQ ID NO: 39884 - protein, 356 aa, Glycine max
MSTKFGRLVPLVFSKRGFSTSTSIQKGGSEEGLKSLNLCSAINQALHIALDTDPRSYVFGEDVSFGGVFRCTTGLADQFGKKRVFNTPLCEQGIVGFGIGLAAMGNRAIAEIQFADYIFPAFDQIVNEAAKFRYRSGNQFNCGGLTVRAPYGAVGHGGHYHSQSPEAFFCHVPGIKVVIPRSPREAKGLLLSCIRDPNPVVFFEPKWLYRLAVEEVPEDDYMLPLSEAEVIRQGSDVTLVGWGAQLAIMEQACLDAEKEGISCELIDLKTLIPWDKETVESSVNKTGRLLVSHEAPITGGFGAEISASIVERCFSRLEAPVARICGLDTPFPLVFEPFYMPTKNKILDAIKSTVKY

SEQ ID NO: 39885 - protein, 716 aa, Kluyveromyces lactis
MESEIFLAPPAKQSKKISILVGMFVAVGGFLFGYDTGLINNISEMPYVNQKFAPNKNHFTTPQISILVSFLSLGTFIGALLAPLISDSYGRKTTMIFSTFVVFMIGNSLQVAAGSMTILVVGRVLSGMSVGLISAAVPLYQSEAAQKSVRGAIISCYQWAITWGLLVASAVSQGTYKRMDASSYQIPIGLQYIWSFLLGVGILFLPESPRYYVFKDRLDKAAKSLSFLRGVPEDDSGLLEELVEIKATYDYEMSFGKISYLDCFRSTRSRTKQRLRMLTGIALQAFQQVSGINFIFYYGVDFFNKSGVSESYLVSFVTYAVNVAFNIPGLFLVEYIGRRKLLLMGGILMTISNFIIAIVGLATDSMVANKVMIAFICLFIASFSATWGGGVWVISAELYPLGVRAKCTAICAASNWLINFICALITPYIMHIDSSVRQTSIGTKIFFVWGSLNAVGVLVVYFTVYETNGLSLEEIDELYKKSSSGINSIEWNKKIKAFPDLFQRTRPNNEGDGEADDNIHTDENYNHTISSYNGTQNNEKYPIQVQMPQFGVRNIEFLNTTGSSPQSDMTEPNFVDLGNGLGITTYQRGPPSVLTDSSEEEEEGQQQETDETEEGKSFKHQYTDARNKNRGERGSFNSNSSTSGTTRSSSHKASVQRMEEINLYMAQLMHRGGTEDLSRNTTDNTHQPISHDIMSQWNSSSQNKGPSTQTDINSNT

SEQ ID NO: 39886 - protein, 638 aa, Triticum aestivum
MSKLLAIALLLLPLINQGIYLATAWDDQDFFKYCPPSQCSQDGPEVRFPFCLESSNTSAAAAASCGCAGRSIRKLACSGRDTILFHPVLGPYNVSAIDYGRSSMKLIPLVDPCFVLQQKPVISRSSSSPRADVINYEMPRLYLWNSILVRCSREFAPGAADGIAGPVSCLSNTTNFFYLVNGYEDMSILPLDCKVVPLSDGVGGGLIPMYMFYNLMSDTLPVSFKESIERILSFAEMTVYWFNGYTCRQCEPSGGRCAFSSQRDRQFCMPGPHGSRIKVIAATSSVAAFVVLLLTVATVLYLTLKTRYNAEIHMKVEMFLKTYGTSKPTRYTFSEVKKMARRFKEKVGQGGFGSVYKGELPNGVPVAVKMLENSTGEGESFINEVATIGLIHHANIVRLLGFCSEGMRRALIYEFMPNESLEKYIFSRDSANFQHLLVPDKLVDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRNADPRIGSQDDVYLPEWIYEKVINGEELALTLEATQEEKEKVRKLALVALWCIQWNPRNRPSMTKVVNMLTGRLQNLQMPPKPFVSSENEPMP

SEQ ID NO: 39887 - protein, 708 aa, Triticum aestivum
MGNPGAFHHSITLQSFTVFFLLAVFVADYHVQGGDDGCSLFSCGHLRDISYPFRRRGDPHECGVEEYELGCTSSKATIHINTGTYYVTAINYTGSYFWVMDTNFNTSSSCPLPLWNHLPYVGRYFGGYFGRYLGGIDSVSPPGFRYLATRSYDRACFANCSRAVMNKSAYKPVACQSAKNSHVYVWVSNYTYCAVEDLEPYCGYLGEIPFGNDTDEYSSDWGQLQNASYADITQFISKGFTVQFPVDTIYRRPSTSVMLRKNINLCLNNSISYFKEQISGTSIVNCTHAIFWSEVHFLECMIGSSNDDYYYTTKLFLITATLVSAIAIHQFFFVLCRFLLAPLAVWIFLAYKYMKTRIIIDAVEKFLRIQQMIGPARYSYTDIVAVTSHFRDKLGQGGYGSVYKGVLLPGGVHVAVKMLEGNSNCNGEDFISEVSTIGRIHHVNVVRLVGFCSEEMLRALVYEYMPNGSLDKYIFSTEKSFSWEKLNEIALGIARGINYLHQGCDMQILHFDIKPHNILLDSNFVPKVADFGLAKLYPRGDSFVPLSAMRGTVGYIAPEMISRSFGVISSKSDVYSFGMLLLEMAGGRRNADPNMGSSSQAYYPSWVYDRLTQEEAGEISDVAADMHELEKKLCVVGLWCIQMRSRDRPTMSEVIEILEAGVDGLQMPSRPFFCDEGHIHVEDSYQFTSELSAVSEEELSVVSEEDNV

SEQ ID NO: 39888 - protein, 543 aa, Thermoplasma acidophilum DSM 1728
MVVIRAPLKELEGRYGREIVDLILRYSSIIGYSVDHDEELKIEFNPDRPDLFSFPTLMKQIKIFFYGEVEIRKPQIRDDAVKVTVSKGVRDIRPYFSALIAEGSSIGVHFDELINYQEILHASIGKDRSKMAIGIHDLEKTGDSIHYTTVSRNQRMQTYDGMEGTVDWIIKNHEKGIAYGRLLPGTGRSVAITDNEGNILSLPPIVNSYRSRIDEGTKKFFVDITGTDLNSVKFAHHLMSNFFSSLKYRIRTPSIDGLPSRETEIIRAFDFRIMRPARRSIERYLGEKMDSEETITHLRRMGYVAEPGYPEIAVYVPGYRVDVMGEADIIEDILKSKGIENIEEKQIFIGKFGEPLFMNKVKDLARDTMIGLGFQEVMTFVLSPASYLQEYTGGVRIQNPKSEDYSVIRDKIYPDLLDLIARNKKHSLPQRIFEIGDKIVGGKQRTALSCVIADTRSEFSTAKSYMQGFLARFTSENPVIVPQMIYGSIDGRSGSIKIGEKIIGVIGEIHPAFLERFSLAVPVSFFEIDLDEIFIANMDHLGL

SEQ ID NO: 39889 - protein, 627 aa, Triticum aestivum
  misc_feature (613)..(613): Xaa can be any naturally occurring amino acid
  unsure (1)..(627): unsure at all Xaa locations
MSKLLVIALLLLPLINHGNDLAVAWDDKDFFRYCAPSQCSQHGPEIRYPFCLKSSNTSSSCGCRESWTKLACSGQDTILLHPVLGPYSVSAMDYRRSSMKIIPLVDPCQLLQQELMISGSLSSQKVDVANDDPLGPNQLFSWSLSATLVHCSREFTPGAADSIAGPVSCLSNATHFLYLVAGYEDMSLLPLDCKVIPVSDGRSVLIQIPKYDNRQLYEDYKPQFFKESAERILSFTEMTVYWNEYSCIDCELHCGRCAFSSQRSLPFCMPGSHIKVIAATSSVAAFVVLLLTVTTALYLSLKTRYNKEIHLKVEMFLKTYGTSKPTRYTFSEVKKIARRFKEKVGQGGFGSVYKGELPNGVPVAVKMLENATGEGEVFINEVATIGLIHHANIVRLLGFCSEGMRRALIYEFMPNESLEKYIFSRDLNIFQHLLVPDKLLDIALGIARGMEYLHQGCNQRILHFDIKPHNILLDHNFNPKISDFGLAKLCARDQSIVTLTAARGTMGYIAPELYSRNFGGVSYKSDVYSFGMLVLEMVSGRRNADPSIESQNDVYLPEWIYEKVVNGEELALTLETTQEEKEKVRQLAIVALWCIQWNPRNRPSMTKVVNMLXGRFQNLQMPPKPFI

SEQ ID NO: 39890 - protein, 177 aa, Salmonella enterica subsp. enterica serovar Typhi str. CT18
MSTTNHDHHVYVLMGVSGSGKSAVASAVAHQLHAAFLDGDFLHPRCNIEKMASGEPLNDDDRKPWLQALNDAAFAMQRTNKISLIVCSALKKHYRDLLREGNPNLSFIYLKGDFDVIESRLKARKGHFFKTQMLVTQFETLQEPGADERDVLVVDIDQPLEGVVASTIEVINKGSTL

SEQ ID NO: 39891 - protein, 689 aa, Triticum aestivum
MGNPGAIHRSITLQVFTVFSLVAFFVADHVQGGDDGCPPFSCGHLRDILPPFRRRGDPLECGVEAYELGCTSSKATIQINTGTYYVTAINYPGSYFLVIDTNSDTSSSCPLPLWNHVPYSGPYEKSYLYSNGFNNLQTRSLYRACFANCSQAVMDNSSYKPVACLSAKDSHVYVWVSESVCGVEDLKPYCGYVALTPFLVTYSVDLQQLRNASYVDLTKLISKGFTVYFPVEAGDIRSVSRTINICLNRTTSYFKEQISGTSIVNWTHAIFWSEVHFLECVTDTNFGSTYTTESLLLVVTILSAIGISKFLFVLCRFLLAPLAVWIFLGYKYWKTMIIIDAVEKFLRIQQMIGPTRYSYTDIVAITSHFRDKLGQGGYGTVYKGVLLPGDVHVAVKMLEGNSNCNGEDFISEVSTIGRIHHVNVVRLVGFCSEEMRRALVYEYMPHGSLDKYIFSAEKSFSWDKLNEIALGIARGINYLHQGCDMQILHFDIKPHNILLDSNFVPKVADFGLAKLYPRGDSFVPLSAMRGTVGYIAPEMISRSFGVISSKSDVYSFGMLLLEMAGGRRNADPNAGSSSQAYYPSWVYDQLTREEAGEEISPVAADMHELEKKLCVVGLWCIQMRSSDRPTMGEVIEILEAGAGGLQMPSRPFFCDEGHIHVEDSYHFTSELTAVSEEELSAVSEEEDDV

SEQ ID NO: 39892 - protein, 390 aa, Synechococcus sp. WH 7805
MASLLDQLSAMTVVVADTGDLEAIRKFTPRDATTNPSLILAAAQIPAYQNLIDEALRSSRRLIGDTAPVEQVVREALDEISVIFGKQILKIVPGRVSTEVDARLSFDTEATIEKGRKLIRLYNDAGISNDRVLIKIASTWEGIKAAEILETEGIHCNLTLLFGFGQAVACAEAGVTLISPFVGRILDWYKADTGRDSYPGPEDPGVLSVTRIFNYFKTYGYKTEVMGASFRNIDEITELAGCDLLTISPKLLDQLRESQATLSRKLDGENPSSNETQIHVDREQFEALMKTDRMATDKLAEGIKGFSKAIETLESMLAHRLAELEGGQAFGHAVQEIFLLNDMNGDGCITRDEWLGSDAVFDALDLDHDGLLTPEDVRRGFGAALALTTA

SEQ ID NO: 39893 - protein, 654 aa, Salmonella enterica subsp. enterica serovar Typhi str. CT18
MTQLAIGEATPHGATYDGHGVNFTLFSAHAERVELCVFDSRGNERRYDLPGRRGDVWHGYLAGARPGLRYGYRVHGPWQPAQGHRFNPAKLLLDPYARQVEGELKDHPLLHGGHDEPDYRDNAAVAPKSVVISDHYDWEDDAAPRTPWGKTVIYEAHVKGLTYLHPELPQEIRGTYKALGHPVMVAYFKQLGITALELLPVAQFASEPRLQRMGLTNYWGYNPMAMFALHPAWASSPETALDEFRDAVKALHRAGIEVILDIVLNHSAELDLDGPTFSLRGIDNRSYYWIRDDGDYHNWTGCGNTLNLSHPGVVEYACECLRYWMETCHVDGFRFDLASVMGRTPTFRQDAPLFAAIKACPVLSTVKLIAEPWDIGEGGYQVGNFPPPFAEWNDHFRDAARRFWLPRNLTTGEFACRFAASSDVFKRNGRAPGASVNLLTAHDGFTLRDCVCFNQKHNEANGEENRDGTNSNYSDNHGKEGLGGPLDLMERRRDSIHALLATLLLSQGTPMLLAGDEHGHSQHGNNNAYCQDNALTWLDWQQANRGLTTFTAALIRLRQQIPALTGNSWWEEGDGNVRWLNKNAQPLSADEWQNGPKLMQILLSDRFLIAINATLEVTDIVLPEGEWRAVPPFAGEDNPVITAVWQGLCVFQRG

SEQ ID NO: 39894 - protein, 431 aa, Salmonella enterica subsp. enterica serovar Typhi str. CT18
MVSLEKNDRVMLARQLPLKSVALILAGGRGTRLKDLTNKRAKPAVHFGGKFRIIDFALSNCLNSGIRRIGVITQYQSHTLVQHIQRGWSLFSEEMNEFVDLLPAQQRMKGENWYRGTADAVTQNLDIIRCYKAEYVVILAGDHIYKQDYSRMLIDHVEKGARCTVACMPVPIKEATAFGVMAVDENDKIIDFVEKPANPPAMPGDASKSLASMGIYVFDADYLYELLAADDKDDASSHDFGKDIIPKITREGMAYAHPFPLSCVQSDPQAEPYWRDVGTLEAYWKANLDLASVTPELDMYDQNWPIRTHMESLPPAKFVQDRSGSHGMTLNSLVSGGCIISGSVVVQSVLFPRVRINSFCNIDSAVLLPEVWVGRSCRLRRCVIDRACIIPEGMVIGENAEEDARRFYRSEEGIVLVTREMLRKLQVKQER

SEQ ID NO: 39895 - protein, 275 aa, Clostridium thermocellum ATCC 27405
MELWFTEYQTPTLGITCKTKKTLHSEKTEYQELAVIETEQFGRMLLLDGIIQTTVADEFVYHEMIAHVPLFTHKNPKKALVVGGGDGGSIREIVKHPSIEKAVLCEIDRRVIEVSKEYLPEISCALDNEKVEVVVGDGIKYVKEHKNEFDVIIIDSTDPIGPAEGLFAIDFYRAVYDCLKEDGIFVAQTESPFIDKELITRIIRDVKSLFPITRLYTCAIPTYPTGYWCFTMGSKKYDPLETDIDSIPDIDTKYYCPQIHRAAFILPKFAKELIK

SEQ ID NO: 39896 - protein, 113 aa, Rickettsiella grylli
MDCIFCKIIKKEIPAEMVYHDDAMIAFRDQHPQAPIHQLIVPKKHIATLNDLSDNDTILIGHLFQTARHLAKKAGIDKSGYRTVINCNKNGGQEIFHLHIHLLGGRTFVWPPG

SEQ ID NO: 39897 - protein, 246 aa, Oryza sativa (indica cultivar-group)
MQHPGFSFCYNRIPCHYVLHPERKIVRGAIHSHPLFPSALPAGIQTADTSPSDVPAAYSGIEVAFAGRSNAGKSSALNTLTNQKSLARTSKTPGRTQLINLFEVEDGIRLVDLPGYGYAEVPEEMKRKWQRALGEYLQMRNSLKGLVVLMDIRHPLKDLDQQMIQWAVDVGTPVLVLLTKADKLASGARKAQLNMVREAVLPFMGDIQVEAFSSLKKIGVDKLRQKLDTWFNEIPPEVLPEEDIGE

SEQ ID NO: 39898 - protein, 615 aa, Oryza sativa (japonica cultivar-group)
MASISGAAAAAPSSSGASCGLRLRRDHLPRSSHFRLARPSSITDVSRLCSSSSSSPPRSLSSKQSGHADVLAHGAVDKDPIRLWNRYVEWLYQHKQLGLFVDVSRIGFTEEFLRRMEAPMGRAFAAMRELEKGAIANPDEGRMVGHYWLRNPALAPNSFLRDKIETTLERILAFASDVISAKIRPPSSPAGRFTQILSIGIGGSSLGPQFVAEALAPDNPPLMIRFIDNTDPAGIDHQIAQLGPELASTLVIVISKSGGTPETRNGLLEVQKAFRDAGLEFSKQGVAITQENSLLDNTARIEGWLARFPMFDWVGGRTSEMSAVGLLPAALQGIDIKEMLVGAAQMDEETRNTEIKENPAALLALCWYWASDGIGSKDSLLLLSRYLQQLVMESLGKEFDLDGNRVNQGLTVYGNKGSTDQHAYIQQLREGVHNFFVTFIEVLRDRPPGHEWELEPSVTCGDYLFGMLHGTRSALYANDRESITVTVQEVNPRAVGALVALYERAVGLYAYLININAYHQPGVEAGKKAAGEVLALQKRILLVLNEASCKDPAEPLTLDQIADRCHCPEEIEMIYKIIQHMAANDRALIAEGNCGSPRSIKVYLGECNVDDDMNS

SEQ ID NO: 39899 - protein, 589 aa, Synechocystis sp. PCC 6803
MSELSLAHQDYPVDDLEQLLSILPKPIQAIIAEHPQRQQLVEVVMDLGRLPEARFPGTAVYLGHEPIAKEDLQYAIDRVGLFSSDNRAGIERTLHRISAIRNRTNEIIGLTCRVGRAVFGTINLIQDLVETGESLLLLGRPGVGKTTALREIARVLADDLHKRVVIIDTSNEIAGDGDIPHPAIGRARRMQVARPELQHQVMIEAVENHMPEVIVIDEIGTELEALAARTIAERGVQLVGTAHGNRLENLIKNPTLSDLVGGIQAVTLGDEEARRRGSQKTVLERKAPPTFSMAVEMLERQKWTIHSDVALTIDNLLRGRPPVEQLRYMNEQGELQIETVEAQPQERTPQPPPYFSLGLVDDRQLRPRPTGLRSTGRMKPQAPLHANADQVRDFERLLEQSWQQWEGDDEPKIRVPGPNGEDLPVYVYPYGVGRSQLDQVIDILQLPVAVTKDVHQADAVLALRSHVKGNQKLRQMAKGIQVPIYGVKSNTIPQISRALKRILGMDEPHKAEAADLRLFTRSGSNDELEALEEARLAVEQIVIPTGQPVELLPRSPHVRKMQHELVEHYRLQSDSFGDEPNRRLRIYPA

SEQ ID NO: 39900 - protein, 336 aa, Azoarcus sp. BH72
MEATAEQLLWMYEKMVEIREYEETMAKVYLEAKLPPKIQKGLAFDIGAGPVPGEMHLAAGQEPVAVGVCAHLRRDDTVVGAHRPHHFAIAKDVDLNAMTAEMYGKATGLGRGKGGHMHLFDPAVKFSCSGIVGAGAPQACGAALAAKKLGTDAVAIAFFGEGAANQGAFHEALNLAALWKLPVVFVVEDNKYGISVEKSASTAIASNADRAAAYGMPGVLVEKNDAVAVFEAAGVAVARARRGEGPTLIEVKTDRYYGHFQGDPETYRPKGEAKELRQHDPIPTLGALLRSRDLLDDEADAALRARVSARVQAAYDFGRNSPYPEPQDALLHVFAE

SEQ ID NO: 39901 - protein, 162 aa, Penicillium marneffei
MSERKAIRSSLSDSINRIGDEPYTLGLFDTAGQEDYGRLRPLSYPLTDVFLVCFSVTSPASFENVREKWFPEVHHHCPGVPCLIVGTQTDLRDDPAVREKLAKQKMQPVRKEDGDRMAKELGAVKYVECSALTQYKLKDVFDEAIVAALEPAPKKRPKCVVL

SEQ ID NO: 39902 - protein, 345 aa, Azoarcus sp. BH72
MSTTTTTRRLTMAQAISEATAQEMARDPRVFVMGEDVGKYGGIFSATTGLLDQFGPERVMDTPISETGFMGAALGAAAEGLRPISELMFVDFFGVCFDQIYNHIAKNHYMSGGACKYPLVITTGIGGGYNDAAQHSQCLYSIFAHVPGLKVVVPSNAYDAKGLMTSAIRDDNPVVFLYHKGIMGLSWMSYFEGSTNEVPEEQYTIPFGQARVVREGSDVTIVTLSQMVQKSVLAAEKLAEEGISAEVLDLRTLVPLDRAAVLKSVKRTGRLLVADEDYLSYGLSGEIAALVAENIDTVRLKAPVRRLAVPDVPIPFSRPLENFAIPQVENIVASVRGLMTFKLDQ

SEQ ID NO: 39903 - protein, 479 aa, Prochlorococcus marinus str. MIT 9211
MKERDQSFLHPPYQSSDFGVMRASWVANRQGKSNVSQLHFARQGMITEEMAYVANRENLPESLVMEEVARGRMIIPANINHLNLEPMAIGIASKCKVNANIGASPNASDVGEELKKLELAVKYGADTVMDLSTGGVNLDEVRTAIINASPVPIGTVPVYQALESVHGSIEKLSEEDFLHIIEKHCQQGVDYQTIHAGLLIEHLPKVKGRLTGIVSRGGGILAQWMLYHHKQNPLFSRFDDICEIFKRYDCSFSLGDSLRPGCLHDASDEAQLAELKTLGQLTKRAWAHDIQVMVEGPGHVPMDQIEFNVRKQMEDCSEAPFYVLGPLVTDIAPGYDHITSAIGAAMAGWYGTAMLCYVTPKEHLGLPNPEDVREGLIAYKIAAHAADIARHRSGARDRDDELSKARYAFDWNKQFELSLDPERARQYHDETLPADIYKQAEFCSMCGPKHCPMQTKITDKDLDDLEDVIKSKDASKINL

SEQ ID NO: 39904 - protein, 669 aa, Prochlorococcus marinus str. MIT 9211
MVAAPASLDKLCINSIRMLAVDAVNKSKSGHPGLPMGCAPMGYTLWDKFLNHNPKNPKWFNRDRFVLSAGHGCMLLYALLHLTGYESVTIEDIKQFRQWGARTPGHPETFETPGVEVTAGPLGAGISNAVGLAIAESHLAAKFNKPDFSLVDHFTYVIMGDGCNQEGVASEACSLAGHLKLGKLIALYDDNHITIDGKTDVSFTEDVLKRYESYGWHVQHVSDGNTDVDAIAKAIQQAKEVTDKPSIIKITTTIGYGSPNKSDTAGVHGAPLGEEEAELTRQALGWSYGPFEVPQEAYDQLRQAIDKGAKSEAVWNELLESYRSKYPDESIEFERMLRGELPSNWDQSLPSYTPEDKGLATRKHSQICLGALGPNLPELIGGSADLTHSNYTDIQGETGSFQAESPEKRYLHFGVREHAMAAILNGIAYHGSGLIPYGGTFLVFADYMRGSMRLSALSELGVIYVLTHDSIGVGEDGPTHQPIETIPSLRAMPNMLVFRPGDGNETSGAYKLAIQNRTRPSALCLSRQGMPNQENSSIEKVSFGGYVLEDCEGTPELILIGTGSELYLCVDAAKELTKQGRKVRVVSMPCVELFEEQSSSYKEEVLPSDVRKRIVVEAAETFGWHKYIGLDGDSITMSGFGASAPGGTCMEKFGFTLENVLNTANNLLT

SEQ ID NO: 39905 - protein, 845 aa, Penicillium marneffei
MPAYELRSGGDVKNKKQSMADLKYRRLTELNSRLKEDLDRPRVKVSEAALSLINYCNNTRDFMVPSVWGQSNPSLKRHPSAPVYPRNYTGSREHLRTRSNAYGSSSSSSLEQQQQQQNNNSAGHSPVDDLTDPPFDVRGMFNVLEEGGDYSADQQQLEEKQQQQQQQQQQQQQQQQQQQQQQQQQQQQQSDFSAAPARRPPTLQSYHTSPDPRGKQILRQSASFTALNNPRMDTALPQIQDAPSNSKRNSDEGFGTKPRRKNTFSSFVNSVLGSPRNIKISAPENPVHVTHVGYDNQTGQFTGLPKDWQRMLQASGISKKEQEQHPQTMVDIMRFYERNAAGAGDEEVWHKFDNAILRQGEYPDGMSPASATSPRFPQNHEGSFENPRAAPPPPKPSQSSPVPVLSPTIVPNRVAPKPPTVGLIPSRPPPQPPVVSNRAPAARPANEPLTTPPIPENEPVFVNAPPVVPSAIQSPVQYQQQQERAMAAAQQAIIDKQLDRSRSQRQQQQPPSPAEQQITPIATPPTPQHQFAHAQAPVPQPVVQQQQQQPQQPAAAVARPRPRTRQSTAFDVRAKLQAICTPGDPTKKYYNLNKIGQGASGGVFTAYETNTNKCVAIKQMNLDLQPKKDLIINEILVMKDSKHKNIVNFLDSYLHGLDLWVVMEYMEGGSLTDVVTFNIMSEGQIAAVCRETLSGLQHLHSKGVIHRDIKSDNILLSMDGEIKLTDFGFCAQINDSQNKRNTMVGTPYWMAPEVVTRKEYGRKVDIWSLGIMAIEMIEGEPPYLTESPLRALYLIATNGTPKIKDEQNLSPVFRDFLHLALRVDPEKRASAHDLLKHPFMSICEP

SEQ ID NO: 39906 - protein, 524 aa, Mycobacterium smegmatis str. MC2 155
MSFASPFPDVTIPPVSVHDFLFAGLDDADAGRVALVDSRTGAETTYGELIGRIEEFAGALAARGIGVGDVVALLSPNSSAFAVAFHGILRAGATATTVNALFTARDIAKQLTDSKAKLLLTVNALAPQSREAAAAVGLTDDAVVLLDGESLPTGHAAPQVTFDPATHLAVLPYSSGTTANPKGVMLTHRNLVANVAQIRPLQGMRRDDRLLAVLPFFHIYGMTVLLNAALHARAQLVVMPSFDLAEFLGNIAERRCTYAYIAPPVAVALAKHPMVDSYDLSALEGIMSGAASLDAELGLAVARRLDCRVVQGYGMSELSPVSHVTPKDGGLSTVGTVAPLDSCGWTVPNSESKIVDPETGAEIEVPAEGLSETGELWFKGPNVMAGYLNNERATRETIDDDGFLHTGDLARVDATGCVYIVDRLKELIKYKGYQVPPAELEALLLTHPGIADAAVIGVQDPESGEEVPKAFVVRQPGIDLGADEVMAFVAGQVAPYKKVRQVEFIEAVPKSAAGKILRKELRTR

SEQ ID NO: 39907 - protein, 231 aa, Rubrobacter xylanophilus DSM 9941
MSPDGMERLKRAAAREAVDRYVESGMVVGLGTGTTASWAVRRIGERLLEGSLSGVRGVPTSEYTAALARECGVPLVSLSERRPELTIDGADEIAPDLSVIKGRGGALLREKIVAAASRRGVVIVADGSKQVSLLGNGPLPVEVEPFGWEATAEALAALGCEPELRRVKTQPFVTDGGHYTLDCRFPGIPDPPGLACKIKRVPGALECGLFVGLARAAVIARPEGVEVLEAA

SEQ ID NO: 39908 - protein, 252 aa, Salmonella enteritidis
MKTVTVRDLVVGEGAPKIIVSLMGKTITDVKSEALAYREADFDILEWRVDHFANVTTAESVLEAAGAIREIITDKPLLFTFRSAKEGGEQALTTGQYIALNRAAVDSGLVDMIDLELFTGDDEVKATVGYAHQHNVAVIMSNHDFHKTPAAEEIVQRLRKMQELGADIPKIAVMPQTKADVLTLLTATVEMQERYADRPIITMSMSKTGVISRLAGEVFGSAATFGAVKKASAPGQISVADLRTVLTILHQA

SEQ ID NO: 39909 - protein, 551 aa, Rhodococcus sp. RHA1
MTHIVTDTPLWKKLSDHHWEVVGTHLRELFDTDPDRGVDLIVTAADLYIDYSKHRVTRETMGLLVDLARAAGVERHREAMFTGAHINTSEDRAVLHTALRANPERELIVDGQDVVGDVHTVLRRMGEFTDRVRSGAWRGATGERIRTVVNIGIGGSDLGPAMAYRALRHYVDGPEVRFVSNIDPADLLSNLTDLDPRTTLFVVVSKTFSTLETMTNASAARRWITEALGEHAVPRHFVAVSTDEERVTAFGITARNIFGFWEWVGGRYSVGSAAGLSVMIAIGRERFTEFLGGMRAIDEHFRTTPLESNAPVILGMLGVWYSSFFGADARAVLPYAHDLARFPAYLQQLTMESNGKSVRTDGTPVGTFTGEIFWGEPGTNGQHAFHQLLHQGTHLIPVDFLGFAEPIEDLPTLDGIGSVHDVLTANLFAQSKVLAFGKNADEVAADGTPSALVPHKVMSGNRPSTTILGAKLTPSTLGQLIALYEHQVFVQGIVWGIDSFDQWGVELGKTSALELGPALWDLDGAAYVGDSSTTGLIRTYRLARGERRCLP

SEQ ID NO: 39910 - protein, 530 aa, Arabidopsis thaliana
MDDLLHQRVEQSQVTPPHDDSNIHGDFDNEATDESRSETCSVVIEGNCDMVIELGLESGSVIVENLGDSDIDVSNDFDEPDDDDFFVGRTDFGLEFRDIASSGNDIRLITVESGSDDDDGVENERELWGIDLNEEDVYVNDDDEYEDDDVSVTIPLCWDSLQLEDREVTADEFDWEEVGGGGGGGVDDEREIRSGFAQIDMNDESLISASPIISLEGLVTRERAEGSGNLGWEVLLNHTLEINFDVDNRELYIGGDHDDYVQDYDMLFEQFADAEVSVIGLPPTSKSFLNNLPVVLLEGENDDDGGLVCAVCKDEMNIGNKAVQLPCNHKYHSECIVPWLKVRNTCPVCRYELPTDDAEYEQRKTQRTTNTFGMPHNFNLLEGTPSRNNNFNSMFQQNLHDEDDVHVQDHVYNHDQYHHQQPNVVTDEEKRLRRMASNRESARRTRMRERMMKEGLQMQVKQLMAYNQFLYNKYISLLEYNHQILQENSQLKETVSSFHDQYTISYGNHEGILGNTNDFDLNQLSSYQPS

SEQ ID NO: 39911 - protein, 201 aa, Triticum aestivum
  misc_feature (5)..(5): Xaa can be any naturally occurring amino acid
  misc_feature (27)..(27): Xaa can be any naturally occurring amino acid
  misc_feature (68)..(68): Xaa can be any naturally occurring amino acid
  misc_feature (73)..(73): Xaa can be any naturally occurring amino acid
  misc_feature (144)..(144): Xaa can be any naturally occurring amino acid
  misc_feature (151)..(151): Xaa can be any naturally occurring amino acid
  unsure (1)..(201): unsure at all Xaa locations
YLWGXSVVFKTVGYVWEHITNMGSEIXQVLSEQLASDLEKCTEAYLVEPHEEYSVWIMWPEKCGDVIXLSILXEYYGREIVAYVIQTPRCDLYGLGRSSNERAMFIYDGLHYDTLAMCPDEGAPEEFDLSIYVVVQSRFTGAVXTLLLSYXKEAHMKRRYTDTAHFSLCCGVCQIGVTGQKENVEHAQNTAHINFQEYKCP

SEQ ID NO: 39912 - protein, 430 aa, Rhodococcus sp. RHA1
MVTVSDNDHVVIVGAGQAGGDLAANLREKAFSGRITLIGDEDSYPYSRPPLSKAYLLGNKIRSDLLVRSDEMYGRFDIDVKLGTRVKSIDRQRKRITFGESEHLDYDALVLATGGSPRTYPDERLNSSSNVFYMRALDQVERLRPHLTSGTRLTVIGGGYIGLEVAAVARTLGVAVTVIEREQRLLARVTSPVMSSFFDRIHREEGVALHTGRSVSGFDFSPDRELSRVVLDDGTIIETDVCLIGIGLQPNTALAEAAGVEVNDGIIVDSLLQTSDPSIFAVGDVARYPCSESGGTRRLESIPNSTEQARALAQTLVGNPAPYNAIPWFWSDQYELKLQVVGLISPSDAVVVRGDPQHDRSISVFYIRNDEVRAADVVSNPREFAMARKLVTKRAVVDPAKLGDASFPLKDLLPVVNSSFSVGGMPAYHH

SEQ ID NO: 39913 - protein, 170 aa, Medicago truncatula
MGIPSDDLVVIQHAKNANEPTIVTVNCPDKAGLGCDLCRIILEFGLRITRADISTDGRWCFIVFWVIPHPASLKIDWENLKTRLLSPCPSCLFSYNFNQRNPSPPPIYLLKVWIIDQKGLLHDINEILCNLQLTIQRVKVMPTPDGRALDLFFITDEIEKSVYLVYACKV

SEQ ID NO: 39914 - protein, 544 aa, Vibrio vulnificus YJ016
MTPTELKRLYRIIKVQLEYGLDDLLPDHQLAKAPRWMRKSLFWLKNQHPEKPLGDRLRLALQELGPVWIKFGQMLSTRRDLFPPHIADPLALLQDQVSPFDGALAKAQMEQALGGPLETWFSDFDLVPLASASIAQVHTAKLKTTNQEVVLKVIRPDIRPIIDADLKLMRRMASIVAKAMPEARRLKPIEVVREYEKTLLDELDLRREAANAIQLRRNFTDSEELYVPEVYPDFSNETVMVSERIYGIQVSDITGLKANGTNMKLLAERGVSVFFTQVFRDSFFHADMHPGNVFVNPEHPENPQWIGLDCGIVGTLNSEDKRYLAENFLAFFNRDYRRVAELHVDSGWVPADTNIDEFEFAIRIVCEPIFAKPLCEISFGHVLLNLFNTARRFNMEVQPQLVLLQKTLLYVEGLGRQLYPQLDLWETAKPFLEEWMMNQVGPKALINAIKDRAPYWAEKLPELPELLYDSLKQGKAMNQRMDQLYQGYRASKRQQATGKFLFGVGATLVVCSAILVDHTYEQLSLATAIAGVTFWLFSWRAYRR

SEQ ID NO: 39915 - protein, 504 aa, Zea mays
MHDEEILARTLFAMKEKLDLLHQDALEAKVQAFPEIAKYEGDDISVEPTSPSTPPTVTEPSVDEEEFYCPDVSDEWYFSDSDSMDPANNATSSQAMSNPSNAQQFPPPPPLWPTGYMQQNPVDCNIMGNINFPSPGQGPTTMWAPIQPGNTSSQSTMIPASQSALYWNHYMNFVRKPLGSVGMSPYTDSYPPSLSSTPLQGSNTIPQMPVHLESDAEHSVQDINSPEKNAPLVQKQKKSKEQNFTAPEDRLLCTTWLQISSDPIVNTGQRREVSRPELKKALSSRWDKIRADVSKFSGYYARVLREKQSGLSDDDKTSKAATLFAHEEGKPFHFMHCWHQLKGEPKWESICQGHSFRGLHARSIPSSGCPSVETPETDSGSAGLSGKRPRGRDYSKAERKKDGSSSSPEYLSRLQEITEKQIQRSIEKGKKEKTTEEDREIQKKRLELEAQKLSIRQRELKLEELKSAEQRLQMLLSTNEEDVDPEVWVVMKEQKKIAAVHIYF

SEQ ID NO: 39916 - protein, 810 aa, Polaromonas sp. JS666
MKKSKLVMVGNGMAGVRTIEELLKIAPELYDITVFGAEPHPNYNRILLSPVLAGEQTLDEIVLNSWDWYKDNHITLHAGKKVVEVDRVRRVVRAEDGTEEEYDRLLMCTGSNPFILPVPGKDLQGVIAYRDIADTNAMIEAAQKYKKAVVIGGGLLGLEAANGLMLRGMEVTVVHVMPWLMERQLDDVAGKLLQKSLEDRGLKFLIGAQTQELTGGADGRVKSIKFKDGSELDTDLVVMAVGIRPNTELAEKMRLHCNRGIVVNDTMQTVTDARIYSVGECAAHRGIAYGLVAPLFEQAKVAANHLAQFGIGRYTGSLTSTKLKVTGIDLFSAGEFMGGEGTEEIVMSDPFGGVYKKLVIKGDKLIGACLYGDTVDGSYYFKLLRDGRSVSDIRDKLMFGESNIGDTGHEGHSKAAAMPDDAEVCGCNGVTKGTICKAIKEKGLFTLDEVRKHTKASASCGSCTGLVEQLLMFTAGGDYSATPKKKAVCGCTDHSHQEVRDTIKSLHLLTIADVYKTMEWRTPNGCASCRPAINYYLISTWPKEAKDDPQSRYINERSHANIQRDGTYSVIPRMWGGHTTPNDLRRIADVADKYQIPTVKVTGGQRIDLLGVKKEDLQSVWQDLGMPSGLAYAKATRTVKTCVGSEWCRFGTQDSTQMGKDLEHALWAMYAPHKVKLAVSGCPRNCAESGIKDVGVIGVDSGWEIYVGGNGGIKTEVAEFLVKVKTSSEVMEYAGAFLQLYREEGWYLERTVHYLHRVGLDYVKKKILDDAEGRKALWERLQFSLDGAPDPWLETSKAAVDTRQFEKLPA

SEQ ID NO: 39917 - protein, 144 aa, Triticum aestivum
MHPTRWELSHMVDLQAAGLVISVVAAEVFLRQAAMEPASASLVSLRVSTATSRSCFSCRQRATPRTRMLPAMASKSGAKLVASGCKTCRGKGAVECEGCKGTGRNKKNGNIFERWKCFDCQGFGMRKCPTCGKGGLTPEQRGER

SEQ ID NO: 39918 - protein, 1003 aa, Polaromonas sp. JS666
MMRETRSTCPYCGVGCGVIIESQGDQITGVRGDPDHPANFGRLCTKGSTLHLTATAPVTRQTRLLYPMRREHRHEAAQRVSWDNALDFASESFAQIIRDHGPDAVGFYISGQLLTEDYYVFNKLAKGLIGTNNVDTNSRLCMSSAVAGYKQTLGADAPPACYDDVNHAQCIFIVGSNTAYAHPILFRRIEDAKAKNPQLKIIFCDPRRTDTAEIADLYLPLQPGTDVSLFNGMLHIMLWEGWVKADYIAAHTSGFEALKATVRDYTPDLVAETCGIKKEDLFTAAKLFATSPATLSLYCQGLNQSSSGTAKNAALINLHLATAQIGKPGAGPFSLTGQPNAMGGREVGGLANLLSAHRDLANADHRAEVAALWGVPSVPEAPGKTAVEMFQAAADGEIKALWIACTNPAQSMPDQATVRRALERAEFVVVQEAFATTSSCDYADLLLPATTWGEKTGTVTNSERRISRVRPAVPAPGETRHDWSIAVAFAQRLEKLLGAQSPHPNPLPKGEGVIQETQETSNSPSSLPLPLGEGRGEGARTGSLFPYSLSDEAAGVETIWNEHRESTRGRDLDITGMSYAMLEESPQQWPLREGETTGKVRLYEDGIFPTADGKARFVNTVYKPVAEPRESRYPFSLTTGRLRDHWHGMSRTGTLGRLFGHVAEPAIQMNAQDMARRLLNEGDLVHVTSKRGSIVVPVQSSSEIGMSQAFVAMHWGEEYLSGRSSTGAPLAGVNALTTSAYCPTSKQPELKHAAVKILKAELPWSLLAMAWLPEDDALGAREQLKPLMAAFPFSSCVPFSNNTPLAQSSRERTGLLFRAAADEAPSAETLASIERILGLAGSDALRYADKKKGQHRTVRLVRKGDQAELAGFVLAGDTSAQAWIKTLLQDELPAQTYGRLLLLPGAKPPVTVQSRGKLVCTCLNVTDTAIADHLTAVSHGGGGAGYLGTDEERLASLQGALKCGTNCGSCVPELKRLVRSARSTQPPGSGLEGRTVIPIRQLA

SEQ ID NO: 39919 - protein, 245 aa, Oryza sativa (japonica cultivar-group)
MAAATSSSALSKLAPLEAILFDIDGTLCDSDPIHFCAFRELLQQVGFNNGVPISEEFYSANISGGHNDDLARALFPDLDHDKAMKFMDDKEALYRRLAPEQLVAVEGLHDLCRWIKDHKLKRAAVTNAPRSNAELMLSLLGLTEFFPVLVIGSECDRAKPFPDPYLKALELIGASPDHTFIFEDSASGIRAGVAANVPVVGLTTRNPEKVLQDAGASLLIKDFQDPKLLSILEEIEPTVAAVEQV

SEQ ID NO: 39920 - protein, 127 aa, Triticum aestivum
MDMAPPASAVSFSPRPSTGTTFRPRAASASGSVGAGRVRAAVAPEGGKWWAPLLGWSGRADYIEAAAPAPAMAMAMAAEEEEKAGRSFVGGLTEEKARQLRARMVETESFHDAMYHSAIASRLARST

SEQ ID NO: 39921 - protein, 126 aa, Rubrobacter xylanophilus DSM 9941
MQRRRAAANLRGMAEKTLFQKIMDRELPGEIIYEDDRCVALRDINPQAPTHVLIVPRKPIPSLDDLTEEDAPLVGHLFVVARKVAEQEGLDRGYRTVFNNGPDANQTVDHLHLHLLGGRRMGWPPG

SEQ ID NO: 39922 - protein, 470 aa, Staphylococcus aureus subsp. aureus COL
MTKTLPEDFIFGGATAAYQAEGATNTDGKGRVAWDTYLEENYWYTAEPASDFYDRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYKGEIGVVHALPTKYPFDPSNPEDVRAAELEDIIHNKFILDATYLGKYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIIDGANVKGYFIWSLMDVFSWSNGYEKRYGLFYVDFETQERYPKKSAYWYKELAETKEIK

SEQ ID NO: 39923 - protein, 426 aa, Thermoplasma acidophilum DSM 1728
MQWQAMGSKDLFQRGSSLFPMGVNSPVRYFKDYPFYVDNASGSRIYDVDGNEYIDYCLAYGPSILGHADPDVVRAVRDQAEKGLIYGAPSEAEIRLGDIIRRSSKNIEMMRFTNSGTEATMHAIRLARAYTGRSIIVKMEGGFHGAHDYSLIRSGSGTLTFGSPSSPGVPEEVARTVVVGRYNDEANIRNIFSQYGSRIAAVITEPIMGNAGVITPEPGFLEFLRDITQKNGSLLIFDEVITGYRFAFSPYQDIIGIRPDLTTMGKIIGGGMPIGLFGGSADIMKKVSPSGDVYQSGTFSGNPVTMAAGFAALKKLQGMDYASLVRRTEKLMNGIDDILAKRKIRHVVNGYRSMFQFFFAESAKNYDEVMKADRDLYFRIFKRLMNHGVYVPPSQFETNFVSFAHSDDDISKTIEAFDLSVGEAAK

SEQ ID NO: 39924 - protein, 572 aa, Magnetospirillum magnetotacticum MS-1
MPQISRDIHEAAQPGDEFPRGTWWRRAGVVFATAALIGVYVAVIVSNLRDMEQERTAFAESQASKILLSFETHTVRLLDLADIYLRSARHFVLEDGPQHLGLFLDQVTPPKSDLYSTTLTVLDRRGRVTFSTDASLTPGSDHSDMPVFLHFQGTTSDSIHISAVNDSTLPDQQFFHIARPLLVGKELTGVIVVDIHSSKIAAFYRDMTLGQNSSAAIFSLDRKLIARQPPPVAEAAPMGTLQIWNDSEGNLEGRFRKRSLLDGIERTFLYKRLANYPLVVVVGFAHSDISAGLDEMKRSELIETIVVTLAAMAFATLILVMDGRNRRLAEAERTSRAAAQLLERSNADLERFAYVASHDLKTPLRVITGYAQMLDRRYRDKLDEEANEYIAFLTAGTKRMYRLITDLLHYSRINSQAKPLQPVSSGRAADIAISNLKAVIEENGATISVGPLPTIQADESQLSSLFQNLLGNAIKYRHPERKPLIRIEAVRLSGTLWRFAVKDNGIGIEPEHFERIFVIFQRLHADSAYDGTGIGLALCQRIVTRLGGRIWVESKPGEGSTFFFTANDATRD

SEQ ID NO: 39925 - protein, 249 aa, Medicago truncatula
MGRGRVELKRIENKINRQVTFAKRRNGLLKKAYELSVLCDAEVALIIFSTRGKLYEFCSTSNMLKTLDRYQKCSYGAVEVSKPAKELESSYREYLKLKQRFENLQRAQRNLLGEDLGPLSSKDLEQLERQLDSSLKQVRSTKTQFMLDQLADLQNKEHMLVEANRSLSIKLEEINSRNHYRQSWEASDQSMQYEAQQNAHSQSFFQQLECNPTLQIGSDYRYNNVASDQIASTSQAQQQVNGFVPGWML

SEQ ID NO: 39926 - protein, 409 aa, Porphyra yezoensis
MAAFVASAGCSRVGAPAARLSTARHASPVPVRVPAARRLSTGLRMVAPSPSKEEQFVCADESPMTLTRYFMGKANEQLDEEHVQDLQNLMASIQMACKKIASLVSRAGITNLTGYEASGSINVQGEEQKKLDVLSNDVLKHALKWRGGKLGIIASEEEDEPIMVDELASGNYIAVFDPLDGSSNIDAGIATGTIFGIFAESAGCLASDWEAKVDQEVLTCLQNVLQPGSNLVASGYCMYSSSCMMVLTTGSGVQGFTLDPQIGEFVLTHPSITIPSRGKIYSVNEANEPAWDPVLRSYIASLKDGSNSSGMTYSSRYIGSMVADVHRTLMYGGLFAYPADKRNANGKLRLLYECSPMSYLIEQAGGIATTGRERVLDVIPSSVHQRVPLVLGSPEDVQELLDKYYEASL

SEQ ID NO: 39927 - protein, 220 aa, Vibrio vulnificus YJ016
MELTVSVKIHYQNTHFITSAPDIRHLPADEGIEIAFAGRSNAGKSSALNRLTNQKNLAKTSKTPGRTQLINLFKVTEGCHIVDLPGYGFAQVPLEMKNKWQKSLGEYLQKRECLKGLVVLMDIRHPMKDLDQQMIFWAIESRIPVQVLLTKADKLKSGARKAELLKVRKLAETFGGDVQVDVYSSLKGLGVDQLRAKLDTWFAPALAHLQEDEEGSNSAE

SEQ ID NO: 39928 - protein, 550 aa, Oryza sativa (japonica cultivar-group)
MGVWREGAGWCFCSGGGGGRSERVKAAIFSAKAAALAAVGGGHGGAGVLIHRNLLLTTHGNLPSAAAAEDAEALLGHARLAARLVPHRFFITSSILDLTIVGLDPAENETTLQAQQPHYLKTCCKPSLDHGSVVYLLGHTGKKELVIGEGKVVIGTDNLLKLSTDGVTWCPGSAGFDAQGNLAFMICDPMKLASSPTTRSSSTSSSSSHSSKKDHPMQFGVPISVVCDWLYQHWQGNLDEVSKPKLPLVRLMSSRSDHSSTSFTRRHVFKPADDENDDTSVSSQVTSKPKHQQASGNSANARISHDANPLVDLRANNEQGVSTPEIYESPRQSSCQGQKDAGSVQLLDINFPPSAPKTIFLPLPLKQMLSDENNADTSKPRNQSRDNGFPSGIIWHRNCEALSRDPPVAPLQDDCSSEGQSSSSPVELLEYRNEDHFSSEEETMYSAETMESRNIPSPREKHVGRSQSCVTYRRWSSPRMSTIQNGTLRKQHTLVPVRKSHSQNTSLPQRSHDYLSPTVSSAMKKRNSMEQQLPTKPRRSIAQTSPKWMF

SEQ ID NO: 39929 - protein, 1471 aa, Ustilago maydis 521
MSRKSPQSPPGTEEGLGTPPLPSPPTDSQPFASQTRSSLDPALTQRPFSPLTLDELGLHPPATPSALLDIITPVNLAVHRDSVSTVQTSKEPLSRSLSNAVFESEASEYCRDKTHKQGTSPVNTQQPTADLNQSASTALATESQELFLTSFLQSLTEDGMMSESQSSMLAVTSSHASDTAAVPSVDSIKPQLGVTSFNGYSVQTEPMSKSVVPSVHLTKPPSLSNNTPAGNEESNLASETIAPHFPNKTQTTDFHRFFLAPATTIGGTAQVQTSSSLSSSVKHSSLTADVRLGINGSVAEHGSFSNKLQTQNTHKSWTSAASVGSGESFLTSTPLEGSKISTTAYDGVQTGNPAHLTPIRVGSAKFNPDWSPGLSNLGRFSLPQAPPLQPEHRYPISILETDANYETDLDTDRESDISPSGTNSFCVTPTSAVQVSATRKRKSLDPSQCDDHSGQSSKAHNTSPSFDWQIRPGDSASDRRNAFSLEGSKSPLKIVPLSNIVRSRSWSNASQSSTSTQGVTPWVVRSVKEVGPERHEHSLPSREESSPSSIDVAQPSTNQVDAKASPKPAAGPFTTLAARNENRGASYDFTRQALLELIRRTNLGMTNNTFSGRTADLPSDKNSSTSKENDFATGTASGSVSAPPVSSSSSVPADLQARLQSWQHHRKRQKLLSEPSNGTSRDRAAPQTSTSRTGSSDTSLPSSKTLLNELKVGENSWSDKVGSAEEQQQKMRRHEHYQRLLLQLNAQMQMKMRMDLQKQKEKETLDATQHQSVVNPRETPNKRPEFRKPSPPSKTIAANKSDSDGFNISNQRRDGPKALESVAVLVQKASQSGRSRHRKPQSNVSSMSVAKIEPPTVKSNERAARAMSVTNDILTSGSNIVLASPLSSTWPTNDDTTSSGLNSTPTSSSWLPESRTSYAPWGTIFANHATGYAATSSSGDLRAGQPAFCQPSWYSSFTGKPDDSVTSQATTTTDWTARSNIGVSDTSNSLSAVDLLMKHSNWRRDMNTGVTQYGSNFKMPHYTTSFSTSTAAVNARMTMGTSQGGADHAFQSSSVGAAAEHKKPFSIGAEVVFWAIKGEHSVKLVGKVESLTDNSATILVSPNDTGSSETNKSGSEISSTDQGSPDQPTRQNVYQDIPFANIISKDQAAMLGFLLGAGGLNTPSSSITFIHYPKLALSLDKNLDVLAPRSTNSIKFTDLLKAQYLDAEMDISTLHKSLVTAFSSADSKPDQVRSLLTKLKIGLTENNLLVPSSSSASSSAELVLAREVLEIGAFYSVRIGDIAAFDRYISLLTPFYDASLPASAHYEPLLGLRLLRLLSSNQISAFHTLIETLPNGLVNGSKFLQHPVSLERWLMEGSYSKVWRLSREAPPQDEYRFFVDLLMDMIRNEIASCEEKAYDSLALHDAATLLFFDNLEQVLGFAQSRGWQVNPKTQVVSFTALNANATSTTSIPKKATIANNLVFAKELESIV

SEQ ID NO: 39930 - protein, 136 aa, Clostridium thermocellum ATCC 27405
MERTLVILKPDSVKRKLVGEIISRFEKRNFTILHLKMMNIDRELACEHYSHVKDKPFFNDMIDYITSGPVVVMVLSGYRVIEAVRSMVGATSNFDSKPGTIRGDYGYHRFENLIHASDSCESAEIEIKRFFPELDS

SEQ ID NO: 39931 - protein, 150 aa, Picea abies
LGCVLAELLLSQPLFPGESGVDQLVEIIKVLGTPTREEIKYMNPNYTEFKFPQIKAHPWHKVFHKRMPPEAVDLVSRLLQYSPNLRCSALEACAHPFFNELRDPNTRLPNGRSLPPLFNFKSQELKGASPELIQRIIPEHARKHNPVLPA

SEQ ID NO: 39932 - protein, 745 aa, Burkholderia pseudomallei K96243
MTADSASTAAAPSLDDVLAFVREHAGDARLSSGERLADHAAGTSTIMQRLNVDPPATQAAALFALAPYLSDPDKQIAEHFGDEVAHLVADVRKLLRLGTVSLRAAQSAPVDAGRDAQAERRAQIEALRKMLLAFAQDIRVVLIRLASRLQSLRYYAAAKIEPPPDVARETLEIYAPLANRLGIWQLKWELEDLAFRFEDPVTYKRIAKLLDEKRVEREAYVAGAIERLQHELAAAHIQAEVSGRPKHIYSIWRKMRGKELDFSELYDVRAFRVIVPDIKDCYTVLGIVHHLWQPVPKEFDDYISRPKPNGYKSLHTVVIGDDGRAFEVQIRTQEMHRFAEYGVAAHWRYKEAGARGYGGQFSASEKYDEKIAWLRQLLAWKDEIADGGGAEVSGQQAWAQLREATLDDDHIYVLTPQARVIALPQGATPVDFAYHLHSELGHRCRGARVDGAMVPLNTQLANGQTVEIVAVKEGGPSRDWLNPQLGYLHSSRARQKVRAWFNAVDQQENVAHGRALVEKTLQREGKTSVNLEHLAAKLGFKSPDELFSVVGKEEFSLRNVEQALSDAPAPEPEPEAPANFEKRASGANVAHGASAGVLVVGVDALLTQLARCCRPAPPDPISGFVTRGKGMSIHRSDCATFRRMAERAPERVLQTTWSADVLGGRGASVYPVDLMIEATDRQGLLRDISEVFAREKMNVIGVKTQSRRNAAFMQFTVEVSSASQVQRACTLLGEIQGVVRAARKA

SEQ ID NO: 39933 - protein, 509 aa, Cytophaga hutchinsonii ATCC 33406
MTEKILILDFGSQYTQLIARRVRELNVYCEIHPYNKAPQIDGTVKGVILSGSPCSVREENAPDIDLSLYREKLPLLGVCYGAQLIAHKSGGTVQPSSIREYGRARLNNVHTSDDLFKEIVPDSQVWMSHGDTIVEIPSNFEILSSTETVRVAAYKVKGEDTFGIQFHPEVTHSLQGKELLRNFVVHICGCSQDWTPDAFVETTISELKAKIGTDKVVLGLSGGVDSSVAAVLIHKAIGPNLTCIFVDNGLLRKNEYEEVLNSYKHMGLNVIGVDAKKQFYKSLEGLSDPEAKRKAIGKEFIEVFDQESHKIADVKWLGQGTIYPDIIESVSVKGPSATIKSHHNVGGLPEKMKLKIVEPLNTLFKDEVRRVGKTLGIDDIILKRHPFPGPGLAIRILGDITAEKVAVLQEVDYIFISRLKEKGLYDQVWQAGAILLPVKSVGVMGDERTYENVVALRAVSSMDGMTADWIHLPYDFLADISNEIINRVKGVNRVVYDISSKPPATIEWE

SEQ ID NO: 39934 - protein, 430 aa, Cytophaga hutchinsonii ATCC 33406
MKNKTSAGLFSRAKEVIPGGVNSPVRAFRAVGGNPLFIKRAHGAYLVDEDDNQYIELINSWGPMILGHGNELIEKAVRDALSNSLSFGAPSRKEVEMAELIVSMVPSVEMVRMVNSGTEATMSAIRVARGYTGKEKIIKFEGCYHGHGDSFLIAAGSGAVTMGVPDSPGVPQGVANDTLTAPYNDIEAVRILVEKNKNKIAAIIIEPVAGNMGCVLPKAGFLEALREICDQENIVLIFDEVMSGFRLSVSGAQGVYGVQPDMTTMGKIIGGGMPVGAYGGKKEIMQNVSPSGPIYQAGTLSGNPIAMSAGLAILQYLQASPALYTQLNDQTDYLIHGMRKANNLLGLDYTFNHVGSMFTMFFTNIGVYDFETAKKSDLSKFAAYFQAMLSRGIYLAPSQFESLFISSAITKQLADQIIQAHAESMKEIHN

SEQ ID NO: 39935 - protein, 295 aa, Staphylococcus aureus subsp. aureus Mu50
MTHLFEGVGVALTTPFTNNKVNLEALKAHVNFLLENNAQAIIVNGTTAESPTLTTDEKERILKTVIDLVDKRVPVIAGTGTNDTEKSIQASFQAKALGADAIMLITPYYNKTNQRGLVKHFEAITDAVKLPVVLYNVPSRTNMTIEPETVEILSQHPYIVALKDATNDFEYLEEVKKRIDTNSFALYSGNDDNVVEYYQRGGQGVISVIANVIPKEFQALYDAQQSGLDIQDQFKPIGTLLSALSVDINPIPIKALTSYLEFGNYELRLPLVSLEDTDTKVLREAYDTFKAGENE

SEQ ID NO: 39936 - protein, 462 aa, Zea mays
MVSDGARGLLGAYELGRTLGEGNFGKVKQARHRGSGGQFAVKIMERARVLSQRADEQICREIATLKLLAHPNVVRLHEVAASKTKIYMVLELVNGGELLDRIAASEGKLPEQEARRLFQQLVDGVSYCHEKGVCHRDLKLENVLVDRKGNIKISDFGLSALPQHLGNDGLLHTTCGSPNYIAPEVLQNRGYDGSLSDIWSCGVILYVMLVGHLPFDDRNIVVLYQKIFKGDAQIPEWLSPGARNLLRRILEPDPAERIAMAEIKAHPWFQEHYVPVLPPYDDDDDHDSVKQIGAGSKTTHHINAFQLIGMASSLDLSGFFEEEDVSQRKIRFTSAQPPEDLFAEIERSATDMGFHVHRGHSKLRLTRNCDRSKNQKNPMSSSSSSFLVCTEVFELSPSLYVVELNKSHGDPALYRQLCQRICGDLGVLEMDQIFGTRPPVADDLAGLALALERRSATPLVAL

SEQ ID NO: 39937 - protein, 474 aa, Magnetospirillum magnetotacticum MS-1
MYRADALALAAGIAGARLMEAAGWAVARAARRLLPKGRIAILCGPGNNGGDGFVAARLLARDGWSVRVALLGAVERLKGDAAIMAGRWTGRVEPLTPDALHGCVGVIDALFGAGLARPLEGAAKAVVEEIGRLRLPVIAVDVPSGVHGDSGAVLGLAPDCLATVTFFRPKPGHCLLPGRLKCGELVVADIGIPAAVLDEIAPDLCRNGPGVWALPEIKAEGHKYSRGHVLILGGAEMTGAARLAARAARRVGAGLVSIAAPPEALGVYRAGDPGVLVASSEPFADLLEDGRRNALLLGPGGGVGEALAGKVLAALGTGRPCVLDADALSSFEGRSADLFRHLSDRVVLTPHDGEFRRLFGEMPGSRLERARHAARLSGAIVLLKGADTVVAHPKGGATITTDAPPWLATAGSGDVLAGLLAGLLAQGMEPFEAACAAVWLHGRAAAEFGPGLIAEDLSEAIPAILAERRWDPHD

SEQ ID NO: 39938 - protein, 243 aa, Staphylococcus aureus subsp. aureus COL
MKHDLETLKHIIDSSNRITFFTGAGVSVASGVPDFRSMGGLFDEISKDGLSPEYLLSRDYLEDDPEGFINFCHKRLLFVDTMPNIVHDWIAKLERNQQSLGIITQNIDGLHSDAGSQHVDELHGTLNRFYCNVCHKSYTKSDVIDRTLKHCDNCGGAIRPDIVLYGEMLDQPTIIRALNKIEHADTLVVLGSSLVVQPAAGLISHFKGDNLIIINKDRTPYDSDATLVIHDDMVSVVKSLMTE

SEQ ID NO: 39939 - protein, 358 aa, Triticum aestivum
  misc_feature (244)..(244): Xaa can be any naturally occurring amino acid
  misc_feature (262)..(262): Xaa can be any naturally occurring amino acid
  unsure (1)..(358): unsure at all Xaa locations
GTSSFPVSAVHRIGILDIRIFNTDRHSGNLLVRKVGPGSDNFGVQTELIPIDHGLCLPECLEDPYFEWIHWPQASIPFSEEELEYIANLDPVKDADMLRMELPMIRKACLRVLVLSTIFLKEGAAFGLCLSEIGEMMSRQFTGKEEEPSELELLCMEARKWVEDRELFLPEAGVEDDDDDFTQFSLDGEDDSDAFESPSFSRFGPMKASHRNPLSKLAECDEEEDDEKEMVKDDSDPLNGYVSXSWSLPSKLSALLKGFGFXGKAKPYHGGIPKTKSKVAAKTNYSGEGSMYQSGSRSANEMLPPSASFVKLSDMGSEEWTAFLDKFQELLPSAFQARKHAAGAGPRPLQRLGTSCQF

SEQ ID NO: 39940 - protein, 559 aa, Cryptococcus neoformans var. neoformans JEC21
MPDSPPRPAASPTASLSGMGIQFHSANPLPPPLHDSPPPSAAPLLRSYSDDRRQRAQDERTLLSHQTSSAGVPGSAVPSAPFSGGNLNLREGVHRNSFSHSFSADRVRTSPPPPHVPPAPPSHHPSSAVHASLPTPAAPRARALSPRLPIAQTARPAPKTSSSAMSSSIGLQTNEPRGRVVSPQHGPPGGPSPPEPAPSTPAPPNPYEPPHLASAWRGDSAYAAAMYHPLSGKDAQYGSTPTVHPAKVPFTESTAYWLGLYFVFNLGLTLFNKFVLVSFPFPYTLTGLHALSGCAGCYIALERGAFTPARLAQRENLILGAFSVLYTINIAVSNISLQLVTVPFHQVVRASTPLFTIFISSIFLRTRFSIMKLVSLLPVVAGVGFATYGDYYFTAWGLILTLLGTFLAALKTVVTNLIQTGAGGRLKLHPLDLLMRMSPLAFIQCVIYGWYTGELERVRAYGATQMTSTKAVALLVNGVIACGLNIVSFTANKKAGALTMTVSANCKQVLTIALAVVLFNLHITPTNGIGILLTLIGGGWYGYVEYQEKNKKSKVLDRM

SEQ ID NO: 39941 - protein, 81 aa, Triticum aestivum
  misc_feature (30)..(30): Xaa can be any naturally occurring amino acid
  unsure (1)..(81): unsure at all Xaa locations
MTRMLTAMASKLGAKLEATGCMTCMRKGAXNANAARGTGQATYNNGNIFERWKCFDCQRFGMRKCPTCGMGGLTPLHREKD

SEQ ID NO: 39942 - protein, 97 aa, Picea abies
TGGGPGLDQKTIDSYPKILFSRHQKLPLTCQDTWCSICLGEYEYKEVLRLMPDCRHCFHASCIDAWLKLNASCPLCRTSPLPSPLPTPLSGLIPLAR

SEQ ID NO: 39943 - protein, 417 aa, Legionella pneumophila str. Lens
MIELKNYTLNFGPQHPAAHGVLRLVLELEGETIVRADPHIGLLHRATEKLAETKPYIQSIGYMDRLDYVSMMCNEHAYVMAIEKLLGIEPPLRAKYIRTMFDEVTRILNHLLWLGATALDIGAMTVFLYCFREREDLFDCYEAVSGARMHATYYRPGGVARDLPDTMPQYKPSRWHSEREIEKKNHNRQGSLLDFLWDFTERFPHCVDEYETLLTDNRIWKQRTVDIGVVSPENALQWGFTGPMLRGSGIAWDLRKKQSYAAYDRVEFDIPVGKTGDCYDRYLVRVEELRQSNRIIRQCIEWLRKHPGPVKVDDYKVSPPRRVVMKHDMEALIHHFKLFTEGFCLPRGEVYSSVEAPKGEFGIYMVSDGANKPYRLKIRAPGFAHLSSFDDMVRGHMLADGVAILASQDIVFGEIDR

SEQ ID NO: 39944 - protein, 227 aa, Legionella pneumophila str. Lens
MTKNEYLIEKLQVDLANHITELTSAYGEVTIECEVQNLLPVMIELRDREEFSFDELIDLCGVDYLHYGDYDWETESATEHGFSRGVERQEAKAYAVNKPRFAVVYHLLSTKKNHRLRVKLFVEESHLIVPSVHHLWKSANWFEREAYDLYGILFDGHPDLRRLLTDYGFIGHPFRKDFPLSGEVEMRYDAKLQKVIYAPVDIVPRIVVPKVIRNDNRYIGNEGSKND

SEQ ID NO: 39945 - protein, 393 aa, Prochlorococcus marinus subsp. marinus str. CCMP1375
MSNLDVISERALSLKPSLTLEISSLAQSLKQKGRDICSLSAGEPDFDTPNFIVEAAKKALDDGITKYGPAGGDPSLREEVAKKLTEINDVPTSPENVLITNGGKQAIFNLLQVIINPGDEVLIPSPYWLSYPEITKIAGGIPITINSSKGNSFSLDIEEIEKNINHKTKLLILNSPCNPTGRIIQESELQSIANLLRKHPNIYVMSDEIYEFLITDKEVHISLASIAPDLKDKIFIVNGFAKAWAMTGWRVGYLQGSSKIIKKAIALQSQSTSNVCSFAQRGALAAIKGAPKGIDYMIQSYNERRKLLTEELRQISSLSLEAQSGAFYAFPKLSDELPDSLSFCKIALEKEGLAIVPGIAFGNDRCIRLSCSVNTETLNDGITRLNRIIKDIT

SEQ ID NO: 39946 - protein, 564 aa, Psychrobacter arcticus 273-4
MTTILNQHEDYQQAQEAYGFPLIIKQLLNRAKIASKDQTISYADKVTYTYAEFFKRVNRLANVLKTMGLQPGDVVAVMDWDSHRYLEAYFAVPMSGMILQTVNVRLAEDKVLYTINHSKPKALLLNAEFEPMAKNYRHEAPSIEKIIWLDDTEYGEDNIQTQQASMPDYVEGEYESLLAEVSDEFDFPDFDENTIATTFYTSGTTGDPKGVFFTHRQIVLQTLSSTLASALSAEGQGARYNDVYMPMTPLFHVHAWCWPYGATMIGLKQVYPGRYIPEVLVDLIEQHKVTLSHGVPTILQMLIKEMATRGRKFNGLKLSVGGSKLNEGLAEVAIESGIEFISGFGMSESCPVVARAVFDDKTDVMSMDEQISYRCLSGSPIMLVSMEIWDENGKALPMDGESTGELVMRAPWLTQSYFKNPDAGDELWRGGWMHTQDIACITADGTLKITDRLKDVIKSGGEWVSSLEVENILSFHPCVAEVAVIGIADEKWGERPLALVVLKPEHVDIKAEDILALGHHAVEKGYLPKYGVPSEIKFLREMPKTSVGKLDKKKMRMMYAEKLI

SEQ ID NO: 39947 - protein, 81 aa, Zea mays
  misc_feature (41)..(41): Xaa can be any naturally occurring amino acid
  misc_feature (50)..(50): Xaa can be any naturally occurring amino acid
  unsure (1)..(81): unsure at all Xaa locations
VIFDFPKPGIMFQDITTLLLDPKASRDTMDLFVERYMHQRXTVVAGVEAXGGIFGSPIALAIGAKYVPLREPRWLPGEVIY

SEQ ID NO: 39948 - protein, 127 aa, Arabidopsis thaliana
MESYQNQSGAQQTHQQLDQFGNPFPATTGAYGTAGGAPAVAEGGGLSGMLHRSGSSSSSSSDDGLGGRRRKKKGITEKIKEKLPGHHDSNKTSSLGSTTTAYDTGTVHHEKKGMMEKIKEKLPGGHH

SEQ ID NO: 39949 - protein, 419 aa, Vibrio sp. Ex25
MSVNFADLGIEQKLIETLSNLNIVTPTPVQEKSIPHVLEGKNLLAAAQTGTGKTAAFGLPIIQTVQQKKLNGTPQALVLVPTRELAQQVFDNLNQYSAQTELRIVCVYGGTSIGVQKRKLEEGADILIATPGRLLDHLFNGNVNISKTSMLVLDEADRMLDMGFWPDLQRIFRRLPAEKQILLFSATFEKRIKTIAYKLMESPVEVEVSPANTTAETVKQMVYPVDKKRKRELLAYLIGSRNWQQVLVFTKTKQGSDELAKELKLDGIKAVSINGDKSQGARQRALDEFKQGKVRALIATDVAARGLDIQELEQVVNFDMPFKAEDYVHRIGRTGRAGKSGLAVSLMSRDEEYLLHAIENLLDQRLPQEWLAGFEPTLIEEVEPEKNGSGRRRSRSSEKRKLKAKLAIHKNRGKSRNSR

SEQ ID NO: 39950 - protein, 421 aa, Staphylococcus aureus subsp. aureus Mu50
MTVKYNQNGELTMDGISLKTIAQSFGTPTIVYDELQIREQMRRYHRAFKDSGLKYNISYASKAFTCIQMVKLVAEEDLQLDVVSEGELYTALEAGFEPSRIHFHGNNKTKHEIRYALENNIGYFVIDSLEEIELIDRYANDTVQVVLRVNPGVEAHTHEFIQTGQEDSKFGLSIQYGLAKKAIDKVQQSKHLKLKGVHCHIGSQIEGTEAFIETAKIVLRWLKEQGIQVELLNLGGGFGIKYVEGDESFPIESGIKDITDAIKSEIKVLGIDAPEIGIEPGRSIVGEAGVTLYEVGTIKEIPEINKYVSIDGGMSDHIRTALYDAKYQALLVNRNEEADDSVTIAGKLCESGDIIIKDAKLPSSVKRGDYLAILSTGAYHYSMASNYNQMQKPSVFFLKDGKAREVIKRQSLRQLIINDTK

SEQ ID NO: 39951 - protein, 250 aa, Zea mays
  misc_feature (76)..(76): Xaa can be any naturally occurring amino acid
  unsure (1)..(250): unsure at all Xaa locations
MRTMVDLGKQRDRLHHRMQIINTPTTVDCAREIRLRRTLRSFIECMLPYCCTYQQQPAHSYQNDTVSVSSSTSSDXSSSDHSSSSSSIVSGTFFGHRRGRVSFCLQDATVGSPPLLLLELAVPTAALAKEMDQEGVLRIGLECDRRRSSSSNNSRSSSIFDVPVWSMYCNGRKMGFAVRRKVTENDAVLLRMMQSVSVGAGVVPLDEEEQTLYLRARFERVTGSSDSESFHMMNPRGSYGQELSIFLLRS

SEQ ID NO: 39952 - protein, 199 aa, Brassica napus
MEGVGDTTTSSSSEGNLISAAAFVEGGIQEACDDACSICLEPFCDSDPSTLTSCKHEFHLQCILEWCQRSSQCPMCWQSISLKDPTGQELLEGVVQERNLRFNPSRNATIFRHPTLGDFELQHLPAGVDNAELEERIIQHLAAAAAMGRARHGTRREGHRSSRSSTQGGHPQFMVFSPHPNAPPPPPMLSSPSQRNEAD

SEQ ID NO: 39953 - protein, 483 aa, Oryza sativa (japonica cultivar-group)
MAKKQRREAAARRRREQQQQGREQRHHHHHRRRPLLLQPRDERCVSCTTFNILAPIYKRMDSENCRESQYRAYWFSRNEKIIDRLLADCSSIICLQEVWLGNDELVDMYEKRLGDANYSLFKLARTNNRGDGLLTAVNKNYFHVLNYRELLFNDFGDRVAQLLHVESAMPFWQNRSSSCIQQQSLIVNTHLLFPHDHSLSIVRLKQVYKILQYIEAYQEEHKLGPMPIILCGDWNGSKRGQVYKFLRSQGFVSSYDTAHQYSDSEEDAHKWVSHRNHRGNICGVDFIWLLNPNKSRKPLKTSWNEAVFGIIKYLLLQVASLSEENAFALLKADSPDDQITYSSFCQALCQLGMVHPDRLNSEEIKDLWSEADHDGDDIVDYKEFQRCIWSPTCCSQEEEDDTEIDISDGSLVTFEANDEAFGFTVKEAVLFPPEVEKGMWPENYSLSDHAPLTVVFSPGSSTALHGWYDIVCGVAMHDVLDFF

SEQ ID NO: 39954 - protein, 560 aa, Arabidopsis thaliana
MASSPALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 39955 - protein, 560 aa, Arabidopsis thaliana
MASSTALICDTEAWKDLKGHVEDIKKTHLRDLMSDANRCQSMMMEFDGLLLDYSRQRATVETMDKLLNLAKAAQLTEKISRMFNGEHINSTENRAVLHVALRAPKDAVIKADGKNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 39956 - protein, 560 aa, Arabidopsis thaliana
MAPSPALICDTEAWKDLKGHVEDIKKTHLRDLMSDVNRCQSMMMEFDGLLLDYSRQRATVETMDKLLNLAKASQLTEKISRMFNGEHINSTENRSVLHIALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARSISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 39957 - protein, 202 aa, Cryptococcus neoformans var. neoformans JEC21
MTEGKSYEGMSKEERDAHDQQQREKEKKEQAVLPYSWTQELATATVTVPLPKGTRSKDLEVVIGKRKLKVKLKSSPSSILEGELYNDIVVDDSSWTIDDGTLTIELDKLSTHPPERFHIGSPQWWPHILTHHPTIDTTKINPTPSSLSDLDPKTRGMVEKMMWDNQQKALGRPTSDERKKEEVMKKFMAEHPEMDFSNAKIE

SEQ ID NO: 39958 - protein, 249 aa, Legionella pneumophila str. Lens
MRQKIVAGNWKMNGQIQQVTELVSQIEKLIGFDCAAQVAVMPPSIYIPKVRDCLRTGKIVVGAQNVYPKDYGAYTGELSAPMLKDFDCRYVLVGHSERRQFFHEDENFVAQKFHHVKDHGMIPVLCVGETLSERENGKTEQVIAQQVLAVSAKGKDCFRDCVVAYEPVWAIGTGKTATPEQAQKIHQFIRDLVGEINDSDAKHLTLIYGGSVNENNAKALFSMPDIDGGLVGGASLNAKQFVEIVKCIN

SEQ ID NO: 39959 - protein, 146 aa, Vicia faba
MGFTQQQEALVNSSWESFKQNPSYSVLFYTIILEKAPAAKGMFSFLKDSAGVVDSPKLQAHAEQVFGMVRDSAIQLQATGEVVLKNGSLGAIHIQKGVVDPHFVVVKEALLKTIKEASGDKWSEELSIAWEVAYDGLATAIKKAMS

SEQ ID NO: 39960 - protein, 333 aa, Nitrosospira sp. KAN8
MTIKVGINGFGRIGRMVFRAAVQNFPDIEVVAINDLLEPDYLAYVLQHDSVHGRFKGDVSIEDSTLIVNGKRIRLTAIKDPAELKWGEVGAEVVVESTGLFLTKESCQKHIAAGARKVIMSAPSKDDTPMFVYGVNNDTYDGEAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVSTDFRGESATSIFDAEAGMALDGNFVKVVSWYDNEWGYSSKILEMVRVVAGK

SEQ ID NO: 39961 - protein, 219 aa, Burkholderia sp. 383
MRDVIDGFLRFQRDIYPQRVELFKQLATSQNPKALFVTCSDSRVVPELLTQREPGELFVIRNAGNIVPSYGPEPGGVSATVEYAVAVLGVRDIVICGHSDCGAMGAISRCTCLDNLPAVANWLRHADAAKVINAAHEYDTPRAKLDGLVRENVIAQLANLRTHPSVALALEQGRMNLHGWVYDIETGGIDALDGATRSFVSLAESPTVVAVDSRNRGSI

SEQ ID NO: 39962 - protein, 335 aa, Nitrosomonas sp. CNS332
MAIRVGINGFGRIGRMVFRASIEEFDDIEVVAINDLLEPDYLAYMLLHDSVHGRFKGDVSVDGNNLIVNGKKIRLTATKDPEELNWGEVKVDVVVESTGLFLTKELCEKHIKAGAPKVVMTAPSKDDTPMYVYGVNDKTYQGEAIISNASYTTNCLAPIAKVLNDTWGIKRGLMTTVHAATATQKTVDGPSNKDWRGGRGILENTIPSSTGAAKAVGVVIPELNKKLTGMAFRVPTSDVSVVDLTVELEKDASYDEIRKAMKTASEGSMKGVLGYTDQKVVSTDFRGETHTSVFDAEAGIQLDKNFVKVVAWYDNEWGYSCKVLEMVRVIAGRNN

SEQ ID NO: 39963 - protein, 515 aa, Cryptococcus neoformans var. neoformans JEC21
MSDAFSTPADHALSHPELEAILENAQAGPSSIGDGAEGMSIEEAFEVDETVRRVLEGDYKTIGLQFPDELLPSSVSVYRAIQTRIAHTGAQAYVLADSTYGNCCPDVLSCLHLPADFLVHYGHACLTPTDALPVHYVFPRQKLDVKQAVESLLAASKNELDGDGRKGIVVVWDVSYDWLANDIRDTFSQDSTIQISFASIQKPTLASQKGLKDVKGKTPALRSVEPPQGLEMNDCVLWYIGEEGRSCMNLQMTHANNPLFIYSPSSQSVSPLHRTTSRLLSRRLFALHQALSADVFGLIVSNIGLASSKPLLAQLREDLKRAKKKSYTLSVGRLNPAKLANFAEIECFVLVGCAEGGVVDSKDFLRPIITPWELELALQGPDHVWAPENWTLDLGTVLKDAQEREIKIKQDSSTADSDDDSLEFSLITGTMRTKKRFAFGNGTHTLENNKLLGDGGVQDLTLRNQNFSLSKLESAGSTFLASREFQGLEPRYGMDEPSVLEQGRSGVARGYTEEK

SEQ ID NO: 39964 - protein, 293 aa, Wolbachia endosymbiont of Drosophila melanogaster
MKSTFLWTACVTPFNCNGDSIDYSSLQRLLTMQVKAENGVVLLGSTGESLSLTDSEKRTLVEFVCKLKLNTEIIIGVPGVNLYQTLEWLDFCKGMPIHGYLMTTPIYAKPGIMGQTLWFEKLLEKAHVPVMFYNIPSRAGINLHAETVRNLSSHEKFWAIKDSSGTVDTLAQYKKVAPNIEVFCGDDNMISDMAAYGAAGLVSVASNVWPYVAHEYVKKCLNGRNPQADIWQQACEALFIASNPIPTKALLHDIGLIEHQTVRLPLSTEDLPSVEKLRQVNKMILGWKELATL

SEQ ID NO: 39965 - protein, 335 aa, Nitrosomonas sp. OZK11
MTIRVGINGFGRIGRMVFRASIEEFDDIEVVAINDLLEPDYLAYMLVHDSVHGRFRGDVSVSGNNLVVNGKPIRLTAVKDPAELKWDEVNVDVVVESTGLFLTKQDCEKHIKAGARKVVMSAPSKDDTPMYVYGVNDKTYQGEAIISNASCTTNCLAPIAKVLNDTWGIKRGLMTTVHAATATQKTVVAPSNKDWRGGRGILENIIPSSTGAAKAVGVVIPELNKKLTGMAFRVPTSDVSVVDLTVELEKDASYEDICNAMKAASGGSMKGVLGYTNQKVVSTDFRGETCTSVFDAEAGIQLDKNFVKVVAWYDNEWGYSCKVLEMVRVIAGHGR

SEQ ID NO: 39966 - protein, 175 aa, Triticum aestivum
  misc_feature (90)..(90): Xaa can be any naturally occurring amino acid
  unsure (1)..(175): unsure at all Xaa locations
MGPTVMASSVTSVAPFQGFKSTAGLPVSRRSNGASLGSVSNGGRIRCMQVWPIKGIKKFEILSYLPPVSTEALLKQVDYLIRSKWVPCLXFSKVGFIFREHNASPGYYDGRYWTMWKLPMFGCTDATQVINEVEEVKKEYPDAYVRIIGFDNMRQVQCVRFIAFKPPGCKESGKA

SEQ ID NO: 39967 - protein, 582 aa, Vibrio sp. Ex25
MQSDIEICRNTPLSSIDVIAEKVGLLPEEYDTHGRHKAKVHPKCLERLKENDNGKLVLVTAITPTPLGEGKTVTTVGLAQGLAKLRQSVIACIRQPSMGPVFGIKGGAAGGGYSQVAPMEELNLHLTGDIHAVTAAHNLASAALDARLYHEQREGYDAFEARTGLKALKIDTASITWKRVMDHNDRALRKVKIGLNEPGKVINGYERDEGFDISAASELMAIIALAKDLKDLRQRIGKIVVAYDLNGNPVTTEDLQVAGAMAVTLKEAIAPTLMQTLEGVPTLIHAGPFANIAHGNSSIIADDIALKLSDYTVTEAGFGSDMGFEKACNIKAAAASKAPDCVVIVATLRGLKANSGHYDLRPGMAIPDSIFNPDQAALEAGFENLKWHINNVHKYGIPAVVAINQFPQDCEKELKILKELVQQFNPEVKVAISTAFAQGGQGTTQLAQHVIDACTQPTEFRPLYNKEQSLREKLMAVCEAGYGAANIEMSSLATEQLNHFENLGFNNLAVCIAKTPLSITTDSAVKGAPTGFTVPIRELRLCAGAGFVYALSGTVMTMPGLPDKPAFMNLDLDDEGNIVGLS

SEQ ID NO: 39968 - protein, 405 aa, Vibrio sp. Ex25
MEDALAVILAGGMGSRLSPLTDDRTKPAVPFGGKYRIIDFTLTNCLHSGLRKILVLTQYKSHSLQKHLRDGWSIFNPELGEYITAVPPQMRKGGAWYEGTADAIYHNMWLLSRNDAKYVVVLSGDHIYRMDYAAMLEEHKEKGAKLTVACMDVPVEDASAFGVMGTAENGLVTSFIEKPECPPTLPGSKTRSLVSMGIYIFDMDVLKEALEDDSKLDSSSHDFGKDIIPKLIDTESVYAYQFCGSKGRVDKDCYWRDVGTIDSFYEANMDLLEPVPPMNLYQSNWAIRTYEPQFPPARTVSSATGNEGIFINSIIATGVINSGGSVQHSIISSNVRIQDSATVVDSIIFDDVEVGEGSQLVNCIVDKHVRIPPHTQIGINKLEDAKRFKISDKGIVVIPESYQFD

SEQ ID NO: 39969 - protein, 294 aa, Glycine max
MSTSSINGWCLSSISPAKTSLKKATLGPSVFATREDMAKEYEQAIEELQKLLREKSELKATAAEKVEQITASLGTSSSDGIPSSEASDRIKAGFIHFKKEKYDKNPALYGELAKGQSPKFMVFACSDSRVCPSHVLDFQPGEAFVVRNVANIVPPYDQSKYAGTGAAVEYAVLHLKVSEIVVIGHSACGGIKGLLSFPYDGTYSTDFIEEWVKIGLPAKAKVKTQHGDAPFAELCSHCEKEAVNVSLGNLLTYPFVRDGLVNKTLSLKGGYYDFVKGSFELWGLQFGLASSFSV

SEQ ID NO: 39970 - protein, 220 aa, Hyphomonas neptunium ATCC 15444
MDAAAAPEFTEEALEAGRLLFAGKAEFVMGVVSLSGLPPADRSEVCFAGRSNVGKSSLINALTGRAKLARSSAEPGRTRELNYFDIGDEGKLYLVDLPGFGYAKVSKTQTAAWTKLIKSYLRGRPSLRRVFLLVDARRGDLMDTDEEVMDLMDGAAVTYQVVLTKVDKVPKGEVEKIVVKIADKLKKRGAAHPVVRMTSAEKGFGIPELRAEIAALAMLG

SEQ ID NO: 39971 - protein, 255 aa, Methanosarcina acetivorans C2A
MGDVTTAFFLTTFAGISTGLGSLIAFLVPNLKFSWLSALLGFAAGAMIYISFVELLTESVGAVGFFQANAAFFLGIFGMCLLDRMVEHIHMDTLHDGNPFSVSENHNLRKTGLLTAFGIAMHNFPEGMAVLFSSLSSTYLGFSVAIAIAIHNIPEGVAVSIPIYYASGSRKKAFAYSFFSGLTEPLGAGIGYFLLFRFLTPEILFFMLAAVGGVMVFICFDELLPIAIKYGDEHLTFLGVFSGMLVVSLSLYLIH

SEQ ID NO: 39972 - protein, 554 aa, Colwellia psychrerythraea 34H
MCSIFGILDIKTGADALRPTALECSRLLRHRGPDWSGIYHSDNAILVHERLSIVDTEHGAQPLYNGDKSNVLAVNGEIYNHKALASALNVDYEFQTASDCEVILPLYEEFGVEFVDKLQGMFAFIVYNEKDNSYLIARDHIGIIPLYTGYDSEGNFYVASEMKALMPICKTVEEFPPGHILDSRVGKLQQYYKRNWQEYAAIKDNTTSTTKIREALEESVKSHLMTDVPYGVLLSGGLDSSLISAITQKFAARRIEDNDLAEAWWPKVHSFACGLAGSPDLIAAQTVADSIGTIHHSVVFTEQEGIDALKEVIYHLETYDVTTIRASTPMYLMARKIKAMGIKMVLSGEGADEIFGGYLYFHKAPNAQEFHEELNRKLDRLHKFDCLRANKSMSAWGIEARVPFLDKNFMDVAMRINPEDKLCGNGKMEKAILRESFEGYLPKEILWRQKEQFSDGVGYSWIDGLKAHVESLVTEQQLENAHIRFPVNTPDNKEGYYYRTVFEDKYPLATAADCVIGGKSVACSTEEALAWDESFQNNADPSGRAVLSVHNESY

SEQ ID NO: 39973 - protein, 170 aa, Helicobacter pylori
GSGMHTHVSIWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGMDGVKNKMDPGEAMDINLFKLTLDEIREKGIKQMPHTLRRSLEEMLADKQYLKEGQ

SEQ ID NO: 39974 - protein, 559 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSTVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 39975 - protein, 170 aa, Helicobacter pylori
GSGMHTHVSIWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 39976 - protein, 482 aa, Acinetobacter sp. ADP1
MIQESLQYLLKHPDISFTAPTSGAVIEVNDAAKGTPLAWVKSHDRSGVEAAIQRSAQAQAKWKTQTALQRADVLWAWFHLINEHKENLAQILTAEQGKPLAEARGEIGYAASFIRWFAEQARRIDGEILPPTMAHQRLLVIKQAIGVTAAITPWNFPAAMITRKAAPAIAAGCSMLVKPAELTPLTAYALEVLALQAGLPQDILINISGDSVEVGKTLCESDVVRKLSFTGSTPVGRILMQQSAPSIKKLSLELGGNAPVLVFDDANLDQAVQGIMASKFRNSGQTCVCANRIYVQSGIYDALTTKLVDAVKALKVGDGREEGVTQGPLIDARAVAKVQSHIEDATSKGATLQTGGQLAAQGGTFFEPTVLSGVTQEMRVAKEETFGPLAALFRFETEEQAIAMANDTEFGLAAYLFTQSTARQWRVGEALEYGMVGVNTGAISNEVAPFGGVKQSGLGREGSQHGIEEYLEMKYLCVDLSE

SEQ ID NO: 39977 - protein, 242 aa, Triticum aestivum
  misc_feature (54)..(54): Xaa can be any naturally occurring amino acid
  unsure (1)..(242): unsure at all Xaa locations
MMMGTDVCSSRMLSLPRYESGDEELTVLPRHTKVVVTGNNRTKSVLVGLQGAAXRSACRVWLTLAVGLGGWHWLVLKNGVEVKLQRNALSVLEAPTGNEDDDEIDGGNSSFCGSFDMGDKDMNYSSIEYQKPTKPRVRHTRPWSSCTTTSSSRANNLHSTSKLRARVNLTKLGTPTLWRYWKHFNLGGEKCVQVSMNPTPSEEQLFHGVQQHFQSQQLDELQVILGFIQTAKRLKTLYKNSS

SEQ ID NO: 39978 - protein, 214 aa, Oryza sativa
VGDEKMQGLYVAKLVRSFCRSSSESEEEDIFEHVASILVNISKVEAGRRILMEPKRGLLKQIIRQSDSSTQRPSQGVVSTLRNCCFEADTQIQNLLSLAEYIWPPLLLPVAGKKISSEEDRSKMPPELANALSHEREAVEISEFRQQARGAIYMIVLQDKGRRAFWSVNGPRILQVGYEDEGAPKVMEAYELIGSLLVGKGGDDQVQEQGGQKP

SEQ ID NO: 39979 - protein, 170 aa, Helicobacter pylori
GSGMHTHVSVWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 39980 - protein, 170 aa, Helicobacter pylori
GSGMHTHVSIWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 39981 - protein, 856 aa, Nocardia farcinica IFM 10152
MSAQDLPQELRRALSTVAREPRLLVASDYDGTLAPIVSDPSKAYPHRESVSALRALAGLTGTTAAVISGRALRDLAALSRLPVEVQLIGSHGSEFDVGFVHAIDNDAKQLLHEVQAALTQIADDNPGASVETKPASVALHVRNAAPEIGRRALEAVRQGPARWVGVQVTEGKAVIELAVIQTDKGTALDTIRHQEGATAAVFFGDDVTDEKAFRVLSGPDVGIKVGEGESLAKYRVDSTEAVACALAFLLEERRTWLAGASAPRIERLTMLASPRSVALLTPDATVTWFCHPEPDSAAVFAHLLGGPQAGHFSVAPERPGLPLSQRYVDGTMTVETRWASLQVTDYLPHDVAPTRTDLTRVISGHARAVVTFAPRPEFGQVPVSLEADRDGLKVLGTNDPMVLRSPGVQWRIDNDGVHDVATAVVDPAQGPVVLELRCGTHDLDPASASETERRREAERYWREWANSLELPPLKPDLMKRSALTLRGLVHAPSGSILAAATTSLPEDIGGVRNWDYRYCWLRDAALTAQSLVTLGSLTEAEQFLGWVHRVLETLPGPERLHPLYTIYGETLPPEAVIDQLPGYAGSRPVRVGNAANMQVQLDVFGPIVDLISTLAHARERKGITEPAKALPDADWELVHAMVAAVQRRWTEPDHGIWEIRGNPRHHVYSKVMGWLTVDRALTLAQKFDRPVDPEWVSLRETIAEEVKSKGWNDEVQSFTAAYDGTDLDAATLHIGLSGLIDPSDPRFAATVVATEAELRSGSTVYRYHHDDGLPGGEGGFHLCAAWLVEAYLLIGKRSDAEALFAQLVDVAGPTGLLSEEYDPVAERSLGNHPQAYSHLGLLRCAQLLSQPVQVLV

SEQ ID NO: 39982 - protein, 145 aa, Vigna unguiculata
MVAFSDKQEALVNGAYEAFKANIPKYSVVFYTTILEKAPAAKNLFSFLANGVDATNPKLTGHAEKLFGLVRDSAAQLRASGGVVADAALGAVHSQKAVNDAQFVVVKEALVKTLKEAVGDKWSDELGTAVELAYDELAAAIKKAY

SEQ ID NO: 39983 - protein, 145 aa, Vigna unguiculata
MVAFSDKQEGLVNGAYEAFKADIPKYSVVFYTTILEKAPAAKNLFSFLANGVDATNPKLTGHAEKLFGLVRDSAAQLRASGGVVADAALGAVHSQKAVNDAQFVVVKEALVKTLKEAVGDKWSDELGTAVELAYDELAAAIKKAY

SEQ ID NO: 39984 - protein, 799 aa, Oryza sativa (japonica cultivar-group)
MPRKVVSGPDYDDEYDDDYDEYDEDYDDYGETGHSDDIQHPVKEEKESSKKSSSTVPVLWRCSMCMFDNHESMVYCEMCGVFRESFMKSAKDGSIKVHGIPSDFGTPSMPKSDCTKMPVNTRTTDFDGDPEIKNASISHEKVGSTQYTSAGSSSGAGKKVKHIALPEDVPVERTAQLISDHFQLKEDQSSRASSSAQNEDVAQKLSSDIQKLGLEKNEVDTAKPYLPEEYKPEKWMFANEESGVLSQLNLAIVGHVDSGKSTLSGRLLHLLGRISKKDMHKNEKEAKEKGKGSFAYAWAMDESSEERERGVTMTVAVAYLETKKYRVVLLDSPGHKDFVPNMISGATQADAAILVVDACTGSFEAGMDGEGGKSVGQTKEHAQLIRSFGVEQLIVAVNKMDAIGYSKERFEFIKVQLGSFLRSCNFKDSSVTWIPLSAVENQNLIKIPSDVRLTSWYQGFCLLDAIDSLQLPSRDVSKPLILPICDVIKSQSTGQFAAFGKLETGAIRIGSKVLISPCGEVAAVKSIERDSNSCDIARAGDNVAVSLQGIDGSKLILGGILCNPGFPVPVSNFLELRVLVLDVTIPILIGYQVEFHIHHVKEAARVTKIVALLDKAGKPSKTAPRFLKSKQNAVVQVTLDAPVCVQEFSKCRALGRAFLRSSGSTIAVGVVTRPCFGAHIVADSKRDIKDPEHPYSLEELNVVTEDSVEINDELSHVRVTFTPTVERCSMATVIGLCLRVKLMRSLPPRYKVDIRVAPGSHATETAVNKQLNDKERVAAALENPNLLDIVEECLSPTFA

SEQ ID NO: 39985 - protein, 333 aa, Nitrosospira sp. GS832
MTIKVGINGFGRIGRMVFRAAVQNFPDIEVVAINDLPEPDYLAYMLQHDSVHGRFKGDVSIDGDTLVVNGKRIRLTAIKDPSELRWGEVGAEVVIESTGLFLTEETCQKHIAAGAGKVIMSAPSKDDTPMFVYGVNDNTYDGQSIISNASCTTNCLAPIAKVLNDTWGIKRGLMTTVHAATATQKTVDGPSNKDWRGGRGILENIIPSSTGAAKAVGKVIPELNTKLTGMAFRVPTSDVSVVDLTVELEKEASYEEICDAMKKASEGSMKGVLAYTDQKVVSTDFRGESATSIFDAEAGMALDGNFVKVVSWYDNEWGYSSKILEMVRVVASK

SEQ ID NO: 39986 - protein, 375 aa, Torenia fournieri
MVSPASPSPARVELLSNSGIKAIPKEYVRTEEELRSITDIFSKEDGAKNIDSPDLPIIDLSKIDSSDEETRKKGHEELKEAAIEWGVMHLINHGISDELINRVKKAGGEFFDLPVEEKEKYANDQSSGNVQGYGSKLANNAGGILEWEDYFFHCVYPEEKRDMAIWPKDPQDYIPATTEYAKEIRSLTTKILSVLSLGLGLDQDRLEKEVGGKDDLTLQMKINYYPKCPQPELALGVEAHTDVSALTFILHNMVPGLQVLYKGEWVTASCVPDSIILHVGDTIEILSNGMYKSVLHRGLVNRERVRVSWAVFCEPPKEKIVLKPLPETVGEDRPALFPPRTFAQHMKHKLFKKSDDEVHDEEGVVVVEHDDKSVE

SEQ ID NO: 39987 - protein, 333 aa, Nitrosospira sp. NRS527
MTIKVGINGFGRIGRMVFRAAVQNFPDIEVVAINDLLEPVYLAYMLQHDSVHGRFKGDVAIDGDTLVVNGKRIRLTAIKDPAELKWGEVGAEVVIESTGLFLTKETWQKHIAAGAGKVIMSAPSKDDTPMFVYGVNDNTYDGQSIISNASCTTNCLAPIAKVLNDTWGIKRGLMTTVHAATATQKTVDGPSNKDWRGGRGILENIIPSSTGAAKAVGKVIPELNTKLTGMAFRVPTSDVSVVDLTVELDKDATYEEICAAMKQASEGAMKGVLGYTDEKVVSTDFRGESCTSIFDAEAGMALDGSFIKVVSWYDNEWGYSSKILEMTRVVAGK

SEQ ID NO: 39988 - protein, 333 aa, Nitrosospira sp. TYM9
MTIKVGINGFGRIGRMVFRAAVQNFPDIEVVAINDLLEPDYLAYMLQHDSVHGRFKGDVSIDGDTLVVNGKRIRLTAIKDPAELRWGEVGAEVVIESTGLFLTKETCQKHITAGAGKVIMSAPSKDDTPMFVYGVNDNTYDGQSIISNASCTTNCLAPIAKVLNDTWGIKRGLMTTVHAATATQKIVDGPSNKDWRGGRGILENIIPSSTGAAKAVGKVIPELNTKLTGMAFRVPTSDVSVVDLTVELDKDATYEEICAAMKQASEGAMKGVLGYTDEKVVSTDFRGESCTSIFDAEAGMALDGSFIKVVSWYDSEWGYSSKILEMARVVAGK

SEQ ID NO: 39989 - protein, 265 aa, Legionella pneumophila str. Lens
MLRRFAVIGNPIVHSLSPVIHQMFAQQTQIELIYEKILGDDVKFEQQISDFFIQYGNGLNVTLPYKKRAYELAKVRTQRCTLAGAANTLWMEENQLHADNTDGIGLIRDLSRFLELKDKKILILGAGGAARGIIFPLLEAKPLQLIVANRTLEKAKELQRQFPQINVTSFAELTEFFDLIINATSASLSHQVIVLPEEVLSHKPFCYDLAYNQKTSTAFVQYARNRGCEAVDGLGMLVEQAAEAFFIWNNIMPSTKEILEQLRSF

SEQ ID NO: 39990 - protein, 333 aa, Nitrosovibrio sp. FJI82
MAIRVGINGFGRIGRMVFRASIEEFDDIEVVAINDLLEPDYLAYMLLHDSVHGRFKGDVSVDGNNLIVNGKKIRLTATKDPEELNWGEVKVDVVVESTGLFLTKELCEKHIKAGAPKVVMTAPSKDDTPMYVYGVNDKTYQGEAIISNASCTTNCLAPIAKVLNDTWGIKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVPTDFRGESATSIFDAEAGMALDGNFVKVVSWYDNEWGYSSKILEMVRVVAGK

SEQ ID NO: 39991 - protein, 473 aa, Prochlorococcus marinus subsp. marinus str. CCMP1375
MGKSPQDVLRQIKDEGIELIDLKFTDIHGKWQHLTVTSDMVDENSFKEGLAFDGSSIRGWKAINESDMSMVPDSSTAWVDPFYRHKTLSLICSIQEPRSGEAYSRCPRSLAQKALAYLSNTGLADSAYFGPEPEFFIFDDVRYDSKEGTSFYSVDTIEAPWNTGRAEEGGNLAYKIQYKEGYFPVSPNDTAQDLRSEMLLLIGELGIPIEKHHHEVAGPGQHELGMKFASLISAADNVMTYKYVVRNIAKKYGKTATFMPKPVWNDNGTGMHVHQSLWKDGQPMFYGEGTYANLSQTAKWYIGGILKHAPSFLAFTNPTTNSYKRLVPGFEAPVNLVYSQGNRSAAVRIPLTGPSPKAKRLEFRSGDALANPYLAFSAMMMAGIDGIKNQIDPGDGVDVDLFELPEDELSKIATVPSSLNNALEALKADNDYLTAGGVFDHDFINNFIEMKYEEVQQLRQRPHPHEFFMYYDA

SEQ ID NO: 39992 - protein, 333 aa, Nitrosovibrio sp. RY3C
MAIRVGINGFGRIGRMVFRASIEEFNDIEVVAINDLLEPDYLAYMLLHDSVHGRFKGDVSVDGNNLIVNGKKIRLTATKDPEELNWGEVKVDVVVESTGLFLTKELCEKHIKAGAPKVVMTAPSKDDTPMYVYGVNDKTYQGEAIISIVSCTTNCLAPIAKVLNDTWGIKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVSTDFRGESATSIFDAEAGMALDGNFVKVVSWYDNEWGYSSKILEMVRVVAGK

SEQ ID NO: 39993 - protein, 313 aa, Psychrobacter arcticus 273-4
MSALQQLRTMTTIVADTGDLAAIERLKPIDATTNPSLITKALIHPDNEAVLSETMSRHRNDIDAVIDELTIQIGCNILSLIEGRVSTEVDARLSYDTQATIDKALAFMEAYQKSGIDSERVLIKMAATWQGIEAARYLETQGIHCNLTLLFGQHQAIACADAGVTLISPFVGRILDWQKRQQNRQNIPVSDDMGVQSVKLIYQYYKQHGYKTQVMGASFRSTEQILALAGCDLLTIAPNLIDELAAMDIEVTRQLSESMSMDMTDMTRVSLSAEEFSHAYQQDTITQDLLPKGIDGFISARDELAHMLASMRS

SEQ ID NO: 39994 - protein, 189 aa, Psychrobacter arcticus 273-4
MSANTAVTAADTATESSNTLNSDHPFWQIIRTVPDFPKIGIDFYDITPLLRSHINEVIDALLAVLPKGIMDEVDCLGAVEARGFVFASLLAGRLGKGMILLRKPGKLPPPVANKAYVLEYGKDTLEMQNNLPPERVLLVDDILATGGTLTTAYELCQSVNHTVVGALVLLDLVNLHGDFPVPVYTVLKA

SEQ ID NO: 39995 - protein, 428 aa, Acinetobacter sp. ADP1
MDTKHSALNQRKQQATPRGVGVMCQWYADKAENATIWDAEGNTYIDFAGGIAVLNTGHRHPKVLAAVKAQLERFTHTAYQVTPYESYVALAERINELAPIAGPAKTTFFTTGAEAVENAVKIARCYTGRQGIITFGNGFHGRSFMTMAMTGKTAPYKRDFGLMPGGVFHARYPVESRGISVDDALESIENIFSEDVAPHDVAAIVLEPVQGEGGFNVVPADFLKRLRALCDKHGILLVADEVQTGFARTGKLYAMDHYETKADLITMAKSLGGGFPISGVVGRAEVMDAPNPGGLGGTYAGNPVAVAAAHAVIDAIQEEKLCERANELGAELVHVLKGLQQSTDQVITDIRALGSMVAAEFETAEQAKAVQNYAMQNGLLLLTCGKYGNVIRFLYPLTIPVEQFRSGLDILKQGVASLATDHTTQAIG

SEQ ID NO: 39996 - protein, 554 aa, Thiobacillus denitrificans ATCC 25259
MRTGDTRTSGLSTRPVHRLLQAHHSRMADVHMRELFDTDPQRFERFSLQVGDLLLDYSKNRITDETMDLLVRMAEESDVAGWRERMFRGDKINTTENRAVLHVALRNRSNRPVNVDGEDVMPKVNAVIERMGAFAEQVRGGVWRGYSGALITDVVNIGIGGSDLGPQMVVQALKPYRHPRLKLHFISNVDGAHVKETLEALDPETTLFIVSSKTFTTQETMTNAHYARDWFLARAGDVAHVARHFVAVSTNRDAVTAFGIDAANMFEFWDWVGGRYSLWSAIGLSIVLAVGAERFLELLEGAHEMDEHFRHAPLRQNMPVILALLGIWYNNFFGAESHAILPYDHYLRSLPAYLEQADMESNGKSVDRDGRVVDYPTGQIIWGATGINGQHAFYQLLHQGTKMIPADFIVSITPHTELQEHHDILIANFLAQTEALMRGRTREETLEEMGRSPGDPSVQHRVFEGNHPSNAILLKKLTPHTLGMLIALYEHKIFVEGVIWNLNSYDQWGVELGKQLAGRILPELHADAPVAGHDASTNALINHYRRMTQPHPGL

SEQ ID NO: 39997 - protein, 284 aa, Burkholderia thailandensis E264
MSGRSFLIGLIGSGIGGSLSPAMHEEAGRRQGLNYVYRRIDLDALRLTADALPELLTAAERMGFDGLNITHPCKQRVIEHLDELSPDAAALGAVNTVRFLDGRRIGHNTDWSGFAKAFARGLPGASLERVVQLGAGGAGAAVAHAALTMGATQLALFDVDPARARSLADQLQARFPHTRLSAGGPLAGALANANGLIHATPTGMLKHPGLPLPAELLRSDLWVADIVYFPLETELIRAACALGCRTLPGGGMAVYQAVDAFEIFTGRAPDAERMFEHFQALVAR

SEQ ID NO: 39998 - protein, 479 aa, Acinetobacter sp. ADP1
MAAPKNVSESGHSEGLKSGLQSRHLTMISIAGVIGGALFVGSGSVIYSAGPAAILAYTLGGLLVLLIMRMLGEMAVMNPDSGSFSTYADRAIGRWAGFSIGWLYWCFWTLLMGWEAYVAGKILNSWFPFIPIWGYMLLVIVGLVWVNLQDVKNYGEFEFWFALIKVVAIVMFLVVGSLAIMHLWPWGDPSAAGFTNLTAQGFMPGGFSSVITALLGVMFAYMGAEIVTVAAAESKDPAKEIRKASNSIVWRIILFYVGSMFITVCLIPHNNPLLKDPTWGTYSVTLSTLGIPEARHIVNFVVLTSVCSCFNSALYTCSRMMFSLSKRGDAPKIFAKTNRNSSPWAGVIFSSIFSIVAVYLTATESMNVYDVLMLATGTVALYVYLAVAFSQLRMRKKIEAEGKAVDFKMWLFPWLTYAVIITIIGAIITMLIEGTYFKEVTYTTGLALVIVILGILTHKFNWGKDAREKMLEQSKKSMT

SEQ ID NO: 39999 - protein, 540 aa, Burkholderia sp. 383
MTLNSLPAWTALQSHFEQIRHARLRDWFAPENDHTPTRAERFTIPGGGIAADFSKNRINDDTLRLLVQLARDAGVEARRDAMFAGEIVNPTEGRAALHTALRATDPQAPFHAQISAERAKMATFARAVRSGTWTGYTGKRIRHVINIGIGGSDLGPKMVVHALHHVATPEITTHFVSNVDGADLARVLEQVDPEETLAIIVSKTFTTLETMTNARSLRDWFVARGCPEDALAKHFVGVSANPAEVVKFGIAADNVFEMWDWVGGRYSLWSAVGLSIMIAIGPEQFDELLAGANDMDRHFREAPLERNLPVLLGLIGIWYRNFFGSQSYLVAPYSEALHYLPSYLQQLEMESNGKSARLDGTFVDYPTSAVTWGEPGTNGQHAFFQMLHQGPTIVPIDFIAVLTPEHPLASHHPKLLANCFAQSEALMLGRTLDEARKVAGPGKEALAPHLTFPGNRPTTTLLVDALTPRTLGALIALYEHKVLVQATVWDINPFDQWGVELGKILGKVVEADLSAESIDPAKHDSSTTALIERARAALKR

SEQ ID NO: 40000 - protein, 599 aa, Bradyrhizobium japonicum USDA 110
MMLDTTLNARIQAFLDKFEAALVAGDLDAAVAMFAPECYWRDLVAFTWNIKTMEGRDQIREMLNSCLAQAKPRNWKIADAESATEADGVIECWITFETEVARGYGLVRLQNGQIWTLLTTMVELKGHEEKAGFTRPLGARHGVNPGAKTWKELRDEETEQLGLKTQPYVLIIGGGQGGIALGARLRQLGVPTIIVEKNARPGDSWRNRYKSLCLHDPVWYDHLPYIDFPKNWPVFSPKDKIGDWLEMYTKVMELNYWTGTTAKHADWDDAKKEWTVVVERDGKEITLKPKQLVFATGMSAKPNMPQFKGMDTFKGEQHHSSRHPGPDRYKGKKVVVIGSNNSAHDICAALYEAGVDVTMVQRSTTHIVRSDSLMASIADLYSERAVRGGMTTAKADLIFASLPYKILHQLQKPVYDKIRQDDADFYAGLTRAGFRLDFGDDDSGLFMKYLRRGSGYYIDVGASQLIIDGKVKLVAGQVEEITPNGVRLYDGKELPADVIVYATGYSSMNGFVADLISRDMADKVGKVWGLGSNTTKDPGPWEGEQRNMWKPTQQEGLWFHGGNLHQSRHYSQFLSLQLKARYEGVPTPVYGLQPVHHKA

SEQ ID NO: 40001 - protein, 170 aa, Helicobacter pylori
GSGMHTHVSVWKNNENLFSGETYKGLSELALHFLGGVLCHARGLAAFTNASTNSYKRLIPGYEAPSILTYSANNRSASVRIPYGISKNSTRFEFRFPDSSSNPYLAFAAILMAGMDGVKNKIDPGEAMDINLFKLTLDEIREKGIKQMPHTLRRSLEEMLADKQYLKEGQ

SEQ ID NO: 40002 - protein, 560 aa, Arabidopsis thaliana
MASSPALICDTEAWKDLKGHVEDIKKTHLRDLMSDANRCQSMMMEFDGLLLDYSRQRATVETMDKLLNLAKASQLTEKISRMFNGEHINSTENRSVLHVALRAPEDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 40003 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKHDLKEGQ

SEQ ID NO: 40004 - protein, 419 aa, Nicotiana tabacum
MEVISTNTNGSTIFKNGAIPMNGHQSGTSKHLNGYQNGTSKHQNGHHNGTSEHRNGHQNGISEHQNGHQNGTSEHRNGHQNGISEHQNGHQNGTSEHQNGHQNGTSEQQNGTISHDNGNELLGNSNSIKLGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKSFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPINPIDKETTQVKSKLAPLKFYNSDIHKAAFILPSFARSMIES

SEQ ID NO: 40005 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGH

SEQ ID NO: 40006 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 40007 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIREKGIKQMPHTLRRSLEEMLADKQYLKEDQ

SEQ ID NO: 40008 - protein, 560 aa, Arabidopsis thaliana
MASSTALICDTEAWKDLKGHVEDIKKTHLRDLMSDANRCQSMMMEFDGLLLDYSRQRATVETMDKLLNLAKAAQLTEKISRMFNGEHINSTENRAVLHVALRAPKDAVIKADGKNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELISNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 40009 - protein, 333 aa, Nitrosovibrio sp. RY6A
MAIRVGINGFGRIGRMVFRASIEEFDDIEVVAINDLLEPDYLAYMLLHDSVHGRFKGDVSVDGNNLIVNGKKIHLTATKDPEVLNWGEVKVDVVVESTGLFLTKELCEKHIKAGAPKVVMTAPSKDDTPMYVYGVNDKTYQGEAIISNASCTTNCLAPIAKVLNDIWGIKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVSTDFRGESATSIFDAEAGMALDGNFVKVVSWYDNEWGYSSKILEMVRVVAGK

SEQ ID NO: 40010 - protein, 175 aa, Escherichia coli W3110
MSTTNHDHHIYVLMGVSGSGKSAVASEVAHQLHAAFLDGDFLHPRRNIEKMASGEPLNDDDRKPWLQALNDAAFAMQRTNKVSLIVCSALKKHYRDLLREGNPNLSFIYLKGDFDVIESRLKARKGHFFKTQMLVTQFETLQEPGADETDVLVVDIDQPLEGVVASTIEVIKKGK

SEQ ID NO: 40011 - protein, 323 aa, Prochlorococcus marinus subsp. marinus str. CCMP1375
MATVTELLQPIEIDLEHLLKDLRDLIGAGHPILQAAAEHLFSAGGKRIRPGIVLLISKALSAEGELSSKHRRLAEITEMIHTASLVHDDVLDEASTRRGVDTVHNRFDHKVAVLAGDFLFAQASWHLANLDNLDVVKLLSRVIMDLAEGEVKQGIYRFDPNQSLDVYLEKSYCKTASLIANSAQAVGVLSNESDYHLKCLYNFGKQLGLAFQVVDDILDFTSDDKQLGKPAASDLSAGYLTAPALYALEENPSFKELIIREFSNEGDLDHAMELVRESNAIIRSRKLAENFAKNSYESIKWMPDSPSKRALLDLPEYVLGRLF

SEQ ID NO: 40012 - protein, 316 aa, Oryza sativa (japonica cultivar-group)
MAQPSVILATASYDHSIKFWEAKSGRCYRTLQHTESHINRLEITPDKRFLAAAGNPHIRLFDINSNSNHPVISYDSHTSNVMAVGFHCDGNWMYSGSEDGTVRIWDLRTATCQREYESRAAVNTVVLHPNQKELISGDQNGNIRVWDLAANSCSCELVPEVDTAVRSLTVMWDGSMVVAANNRGTCYVWRLLKGTQTITCFEPLHKLQAHDGYILKCLLSPEFCDPNRYLATASSDHTVKIWNVDGFKLEKTLVGHQRWVWDCVFSVDGAYLITASSDTTARLWTMSTGEAIRVYTSHHKPVVCCALHDGAESAPS

SEQ ID NO: 40013 - protein, 395 aa, Nitrosospira sp. HBN8222A
MSVIRVTDLDLKGKRVFIRADLNVPVKDGKVTSDARISASMGTIDYCLKQGGKVMVTSHLGRPEEGVWSEENSLKPVADNISERLGKSVRLVKDWVEGNFDVAEGELVILENCRFNKGEKKNVDETAQKYARLCDVFVMDAFGTAHRAEASTYGIARYAPVACAGILLTEELDALTKALLDPARPMVAIVGGSKVSTKLTVLESLSEKVDQLVVGGGIANTFLKAAGKNIGKSLCEDDLVPTAKMLMEKMAKRNATIPIAVDVVVGKKFDASEPAVLKDAGAVTNDDMIFDIGPKSARELSDIIMKAGTVVWNGPVGVFEFDQFGEGTKTIAMAIADTDAFTLAGGGDTIAAIQKYDIYDKVSYISTAGGAFLEFLEGKKLPAVEILEQRAAGSR

SEQ ID NO: 40014 - protein, 395 aa, Nitrosospira sp. KAN8
MSVIRVTDLDLKGKRVFIRADLNVPVKDGKVTSDARISASMGTIDYCLKQGGKVMVTSHLGRPEEGVWSGENSLKPEADNISERLGKPVRLVKDWVDGNFDVAEGELVILENCRFNKGEKKNADETAQKYARLCDVFVMDAFSTAHRAEASTYGIARYAPVACAGVLLTGELDALTKALLDPARPMVAIVGGSKVSTKLTVLESLSEKVDQLVVGGGIANTFLKAAGKNVGKSLCEDDLVPTAKMLMEKMAKRNATIPIAVDVVVGKKFDASELAVLKDAGAVTDDDMIFDIGPKSARELSDIIMKAGTVVWNGPVGVFEFDQFGEGTKTIAMAIADTDAFTLAGGGDTIAAIQKYDIYDKVSYISTAGGAFLEFLEGKKLPAVEILEQRAAGSR

SEQ ID NO: 40015 - protein, 477 aa, Psychrobacter arcticus 273-4
MITPPENSSQSTPHSQTKPLTPTALDAAGIDIATDSATMSLPHNSDFENGRWFPTWRPFKGDLDRTPVGINEYLPPSKSMLLGVQHTFAMFGSTVLAPLLMGFDPNLAILMSGICTVMFFMITGGRMPSYLGSSFAFIGPVIAVTAYAGVGFNANLNVALGGIMACGIIYALVGLLVMKTGTGWIERLMPPIVTGAIVMIIGLNLAPVTIQGVSANQFDAWMAALTILLISGVAVFTRGMLRRLLLLVGLILSYIAYYVMTNVLGYGVPIDFSGVSTASWFGLPSVHTPKFEISAIILIAPVAFILIAENLGHFKAVEGMTKARVTPYMGRAFFADGLATTFSAGFGGTGVTTYAENIGVMAVTKVYSTTIFVIAGLVAIMLGLSPKFGAIIQTIPPALLGGASIVVFGLIAIAGAKIWIDSHIDFSKNSNLIIAAVTVIMGTGNFSLHLGGFDLGGIGTATLTAIVLNALFNLRKN

SEQ ID NO: 40016 - protein, 395 aa, Nitrosospira sp. PJA1
MSVIRVTDLDLKGKRVFIRADLNVPVKDSKVTSDARISASMGTIDYCLKQGGKVMVTSHLGRPEEGVWSEENSLKPVADNISERLGKSVRLVKDWVDGNFDVAEGELVILENCRFNKGEKKNVDETAQKYARLCDVFVMDAFGTAHRAEASTYGIARYAPVACAGILLTEELDALTKALLDPARPMVAIVGGSKVSTKLTVLESLSEKVDQLVVGGGIANTFLKAAGKNIGKSLCEDDLVPTAKMLMEKMAKRNATIPIAVDVVVGKKFDASEPAVLKDAGAVTDDDMIFDIGPESARELSDIIMKAGTVEWNSPVGVFEFDQFGEGTKTIAMAIADTDAFTLAGGGDTIAAIQKYDIYDKVSYISTAGGAFLEFLEGKKLPAVEILEQRAAGSR

SEQ ID NO: 40017 - protein, 328 aa, Wolbachia endosymbiont of Drosophila melanogaster
MLNTDLTNSDKLDDIVSSDLSAMNDFVFKNVNDEDAKLATDIISHLVRSGGKKIRPKLVFIICKMLNYSGENRINVAASVEFIHNATLLHDDVLDESEARHGVKTANKIWGNKSSILVGDLLLTLAFRWLIECGNLNILSILSKASHLLVKGEIKQMTARFDPHTVRENYFDIIGEKTASLFSACCEAASTVSGATNDETERLKNFGFNFGMAFQIVDDMLDYTANQGTSGKQVGKDFFEGKVTLPAIIAYEKGSPAEQKFWEKCFSSARHNFDQALHYINHHNAIQLSMEKARHYINMAQNDISTFSDSFYKTTLINFLNASIERRM

SEQ ID NO: 40018 - protein, 226 aa, Streptococcus thermophilus LMG 18311
MDELKKLAGVYAAGFVEDGMVVGLGTGSTAYFFVEEIGRRIKEEGLSVVGVTTSTQTTKQAEGLGIPLKSVDDIDSIDVTVDGADEVDPQLNGIKGGGGALLMEKIVATPTKKYIWVVDESKMVDQLGAFKLPVEVVQYGADRLYLDFESKGYKPSFRVTEQGDRFVTDMKNFIIDLDLGKINNPVALGDELKAMTGVVEHGLFNGMVNKVIVAGKDGVKIVEVKD

SEQ ID NO: 40019 - protein, 515 aa, Bacillus cereus ATCC 10987
MVVAYKHEPFTDFSVEANKLAFEEGLKKVESYLGQDYPLIIGGEKITTEDKIVSVNPANKEELVGRVSKASRELAEKAMQVADETFQTWRKSKPEMRADILFRAAAIVRRRKHEFSAILVKEAGKPWNEADADTAEAIDFMEYYGRQMLKLKDGIPVESRPIEYNRFSYIPLGVGVIISPWNFPFAIMAGMTTAALVSGNTVLLKPASTTPVVAAKFMEVLEEAGLPAGVVNFVPGSGSEVGDYLVDHPRTRFISFTGSRDVGIRIYERAAKVNPGQIWLKRVIAEMGGKDTIVVDKEADLELAAKSIVASAFGFSGQKCSACSRAVIHEDVYDHVLNRAVELTKELTVANPAVLGTNMGPVNDQAAFDKVMSYVAIGKEEGRILAGGEGDDSKGWFIQPTIVADVAEDARLMKEEIFGPVVAFCKAKDFDHALAIANNTEYGLTGAVISNNRDHIEKAREDFHVGNLYFNRGCTGAIVGYQPFGGFNMSGTDSKAGGPDYLALHMQAKTTSETL

SEQ ID NO: 40020 - protein, 377 aa, Zea mays
MALPTANPGFRLGCQESPAMGLRSAPRLALRRPGAVSGHRSRTGRGKFPVASTSLDDYLPMRSTEVKNRTLTGDITSLRLITAVKTPYLPDGRFDLEAYDSLINMQIEGGSEGVIVGGTTGEGHLMSWDEHIMLIGHTVNCFGTRIKVIGNTGSNSTREAVHATEQGFAVGMHAALHINPYYGKVSTEGLISHFEAVLPMGPTIIYNVPSRSGQDIPPQVIETLSGYPNMAGVKECVGHERVKCYTDKGITVWSGNDDECHDSRWKYGATGVISVASNLVPGLMRSLMYEGENALLNEKLLPLTKWLFCLPNPIALNTALAQLGVARPVFRLPYVPLPLEKRIEFVRIVEAIGRGNFVGQQEARVLDDDDFVLISRY

SEQ ID NO: 40021 - protein, 381 aa, Nicotiana tabacum
MEVISTNTNGSTIFKNGAIPMNGYQNGTSKHQNGHQNGTSEHRNGHQNGISEHQNGHQNGTSEHQNGHQNGTISHDNGNELQLLGSSNSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFSDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKETTQVKSKLAPLKFYNSDIHKAAFILPSFARSMIES

SEQ ID NO: 40022 - protein, 353 aa, Nicotiana tabacum
MEVISTNTNGSTIFKSGAIPMNGHHNGTSKHQNGHKNGTSEQQNGTISLDNGNELLGNSNCIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFNDPRVTLVLGDGAAFVKAAQAEYYDAIIVDSSDPIGPAKDLFERPFFEAVAKALRPGGVVCTQAESIWLHMHIIKQIIANCRQVFKGSVNYAWTTVPTYPTGVIGYMLCSTEGPEIDFKNPVNPIDKETAQVKSKLAPLKFYNSDIHKAAFILPSFARSMIES

SEQ ID NO: 40023 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGIDGVKNKMDPGEAMDINLFKLTLDEIREKGIKQMPHTLRRSLEEMLADKQYLKEGQ

SEQ ID NO: 40024 - protein, 560 aa, Arabidopsis thaliana
MASSPALICDTEAWKDLKGHVEDIKKTHLRDLMSDANRCQSMMMEFDGLLLDYSRQRATVETMDKLLNLAKASQLTEKISRMFNGEHINSTENRSVLHIALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 40025 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSTRFEFRFPDSSSNPYLAFAAILMAGMDGVKNKMDPGEAMDINLFKLTLDEIREKGIKQMPHTLRRSLEEMLADKQYLKEGQ

SEQ ID NO: 40026 - protein, 148 aa, Salvia miltiorrhiza
MADPLTDEQISEFKEAFSLFDKDGDGCITTKELGTVMRSLGQNPTEAELQDMINEVDADGNGTIDFPEFLNLMARKMKDTDSEEELKEAFRVFDRDQNGFISAAELRHVMTNLGEKLTDEEVDEMIREADVDGDGQINYEEFVKVMMA

SEQ ID NO: 40027 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 40028 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPDVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 40029 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLQSSRTQGTAPEGFNYSTTTLLKRYLETSSEPQM

SEQ ID NO: 40030 - protein, 170 aa, Helicobacter pylori
GSGMHTHVSIWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 40031 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDEFMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 40032 - protein, 108 aa, Triticum aestivum
LISRVSKPSQGTPPPPLASSARRGSHLSDFSQWPLGNYRGFVMSASVEGEGRCSKPTVEVGVAHVGCAEDAAAFVALAAAVDLSMDACRLFSHKLRKELSHLRSDVLR

SEQ ID NO: 40033 - protein, 285 aa, Brassica napus
MTMMLNPDVDLIDRGGSVVVREVWAYNLVSEFHLISAVVEDFPYISMDTEFPGVIFKAEPAILRRGNPGYLYKLLKSNVDVLSLIQVGITLSDADGNLPDLGGGVDGSRFIWEFNFRDFDVDRDAHAEDSIELLRRHGIDFERNRSEGVESERFAELMMSSGLICNESVSWVTFHSAYDFGYLVKILTRRELPSSLRDFLRLLRAFFGERVYDVKHMMKFCERRLYGGLDRLARSLEVNRKVGKCHQAGSDSLLTWHAFQRMRDLYFAEQGPEKLAGVLYGLEVF

SEQ ID NO: 40034 - protein, 142 aa, Glycine max
MDASSFKIILGSSSVARRKILSEMGYLFTIMTADIDEKSIRKETPEDLVMALAEAKANAIISKLQTTTNQQRVDEPTILIAADTVVVYEGVIREKPTSKEEARQFLKDYSGRHAATVGSVLVTNLKTGLRKGDSDRVEIYFK

SEQ ID NO: 40035 - protein, 303 aa, Cryptococcus neoformans var. neoformans JEC21
MSNSWYDTLTSAPALIATALGVSVAALFVSTHNNSNKTAAQVKEQVKEVAHSVHAEGSTGKMAQAEDPITPSELAKHDGSDPSKPIYVAIKGKVFDVSPRSEMYGPGKGYNVFAGKDGSKGLGMSSLDPTDAVADYSSLNESQMNTLNQWEAFFEKIQRGGAGRAVASVMQIIDVPDCSRLQWPCIQGPCRRAFYGGQPQPAYGAPPGQYPPGGEYYTSTPGKPPTPARHLLTLPSPACTANTSPATAWTTTPLPRKRATAAPASAQRPRVAASAPVAAAVSNAARLASVSRRWSRTVDRRAK

SEQ ID NO: 40036 - protein, 395 aa, Nitrosospira sp. PM2
MSVIKVTDLDLKGKRVFIRADLNVPVKDGKVTSDARISASMGTIDYCLKQGGKVMVTSHLGRPEEGVWSEENSLKPVADNISERLGKPVRLVKDWVDGNFDVAEGELVILENCRFNKGEKKNADETAQKYAKLCDVFVMDAFGTAHRAEASTYGIAKYAPVACAGILLTEELDALTKALLNPARPMVAIVGGSKVSTKLTVLESLSEKVDQLVVGGGIANTFLKAAGKNVGKSLCEDDLVPTAKMLMEKMAKRNATIPIAVDVVVGKKFDASEPAVLKNADAVTDDDMIFDIGPKSARELSDIIMKAGTVVWNGPVGVFEFDQFGEGTKTIAMAIADTDAFTLAGGGDTIAAIQKYDIYDKVSYISTAGGAFLEFLEGKKLPAVEILEQRAAGSR

SEQ ID NO: 40037 - protein, 604 aa, Cryptococcus neoformans var. neoformans JEC21
MSDPNSDLYPIHLLMDELKSEDVVLRLSSIRRLSTIALALGPSRTREELIPFIQYQLDDEDEVLLVLAEELGNFVEYVGGKEYAHVILGPLENLTAVEETLVREKAAESISKISVLLSAQDLEQYFLPIVKRLSTGEWFTSRTSACALFAAPYPNASSSSQEEMRKLFGALCHDDTPMVRRAAAKALGPLAKVVSETSGQHDTIVSELIPMYRKLAGDDQDSVRLLTIPDLIALAAALSDEETKTNLLEPMRASITDKSWRVRYMVANEFVGLAESAGESIIREELVGAFVGLLKDNEAEVRTAASGQVPGFAKLVDKEVILARLLPCVRDLSTDSSQHVRAALAMEISGLAPLLGKDATIEHLLPLFLQLLKDEFSDVRLNLIGKLDMVNEVIGIDRLSQALLPAIMTLAEDKQWRVRQAIIEYIPLLAQQLGVEFFDDKLGSLCMSWLGDTVFSIREAATINLKKLTDVFGVEWAKTTIIPKVLEMGNHQNYLYRMTTIFAITTMAPSLNTAIIRDTVLDAALNLANDAIPNIRFNVAKCLETLASVLAQTPEGQELVHRRVVTALRKLQEDQDADVRFFATKAYERTTGDDVRGAEPMILS

SEQ ID NO: 40038 - protein, 395 aa, Nitrosospira sp. TCH711
MSVIRVTDLDLKGKRVFIRADLNVPVKDSKVTSDARISASMGTIDYCLKQGGKVMVTSHLGRPEEGVWSEENSLKPVADNISERLGKSVRLVKDWVDGNFDVAEGELVILENCRFNKGEKKNVDETAQKYARLCDVFVMDAFGTAHRAEASTYGIARYAPVACAGILLTEELDALTKALLDPARPMVAIVGGSKVSTKLTVLESLSEKVDQLVVGGGIANTFLKAAGKNIGKSLCEDDLVPTAKMLMEKMAKRNATIPIAVDVVVGKKFDASEPAVLKDAGAVTDDDMIFDIGPESARELSDIIMKAGTVVWNGPVGVFEFDQFGEGTKTIAMAIADTDAFTLAGGGDTIAAIQKYDIYDKVSYISTAGGAFLEFLEGKKLPAVEILEQRAAGSR

SEQ ID NO: 40039 - protein, 67 aa, Oryza sativa
  misc_feature (12)..(12): Xaa can be any naturally occurring amino acid
  unsure (1)..(67): unsure at all Xaa locations
LNNCLDQLRAPXSETRVFMRCDVSFDQSSHGLRRSLNTMIGRAAHIEFLENDLYARFIMWSFPDFFR

SEQ ID NO: 40040 - protein, 392 aa, Nitrosomonas sp. CNS332
MSVIKLVDLDLKNKRVFIRSDLNVPVKEGKVTSDARITASMATINHCLKQGARVMVTSHLGRPEEGVWTMENSLQPVANDISRRLGTTVRLIKDWVDGGFEVAPGELVILENCRINKGEKKNLEETAKKYANLCDVFVMDAFGTAHRAEASTHGVAKYAPVACAGILLTEELDALTKALHQPARPLVAIVGGSKVSTKLTVLESLTEKVDQLVVGGGIANTFLKAAGNNVGKSLCEDELVPIAKSLMDKMNQRNATIPIAIDVVVGKKFAADEPAVLKEANAVSDDDMIFDIGPKSTQELVNIIMKAGTVVWNGPVGVFEFDQFGEGTHAIAKAIAETDAFTLAGGGDTIAAIQKYDIYDKVSYISTAGGAFLEFLEGKKLPAVEILELRAQ

SEQ ID NO: 40041 - protein, 465 aa, Glycine max
SDDSKKTRRTRKKGASSSAGLEEKKEVKEEKKVRRRKKTEEEKLIVEDKGSEAEISDQDEPSFLENVEDDSDSGLELIKDDGEDISFTYGWPPLVCCFGAVQHAFVPSGRPAYMLINHEIHGSIPDALWSPEKFVRAPGGSAGSVAIALATLGGKVAFMGKLADDDYGQAMLYYMNANNVQTRSVRIDSKRATAVSLMKVGKRSRLKMSCVKPCAEDSLTKSELNFDVLKEAKMFYFNTHSLLDRNMRSTTLQAIKISKHFGGVIFYDLNLPIPLWHSSEETMMFIQQAWNLADIIEVTKQELEFLCGITPSEEFDTKNNARSKFVHYEPEVVSPLWHENLKVLFVTNGTSKIHYYTKELDGAVLGMEDAPITPFTCDMSATGDGIVAALMRMLTVQPDLLTDKGYLEHSIKYAIDCGVIDQWILGRVRGFPPHEDMEEDITPDSNGIRSISETEYRTAVGSASE

SEQ ID NO: 40042 - protein, 453 aa, Pseudomonas fluorescens
MTRNNPQTREWQALSNDHHLAPFSDFKQLKEKGPRIITHAKGVYLWDSEGNKILDGMAGLWCVAVGYGREELADAASQQMRELPYYNLFFQTAHPPVLELSKAIADIAPEGMNHVFFTGSGSEGNDTMLRMVRHYWAIKGQPNKKVIISRKNGYHGSTVAGASLGGMTYMHEQGDLPIPGIVHIAQPYWFGEGGDMSPEEFGVWAANQLEEKILELGVDNVGAFIAEPIQGAGGVIVPPDSYWPRMKEILAKYDILFVADEVICGFGRTGEWFGTDYYGLKPHMMTIAKGLTSGYIPMGGLIVRDDVVAVLNEGGDFNHGFTYSGHPVAAAVALENIRILRDEKIIERVHAETAPYLQKRLRELNDHPLVGEVRGVGLLGAIELVQDKATKRYEGKGVGMICRQFCFDNGLIMRAVGDTMIIAPPLVISKAEIDELVTKARQCLDLTLSALQG

SEQ ID NO: 40043 - protein, 524 aa, Prochlorococcus marinus str. NATL2A
MNNNDKWARYCDLLYSDDSLGFWLDISRMDVAINDFEDFNEIYSKAFDALESLENGSIANIDEGRQVGHYWLRNPKVAPSPEISDSITKEIQDISKFGSSILNGEITNSDGEKYTDVFWIGIGGSGLGPLLIKESFKRESIGLDLHFLDNVDPEGISHKLNSILPNLNSTLFVVVSKSGGTPEPLIGMEQAMKFVRDNNQNWSSRAIAITSKGSKLDLLAHNENWLDIFDLPDWVGGRTSITGAVGLLPAALIGADINKFLNGASQMDALTRVKDIKNNPAALLSLAWFKSGNGKGLRDMVVLPYRDRLEVFSRYLQQLVMESLGKKFDRDENQVNQGIAVYGNKGSTDQHAYVQQLRDGIDNFFVNFIEILHDPLEIVEVKNKRPGDYLSGFLQGTRSALTEGGRQNLTITFKSFDESSLGALIALFERAVSLYAELINVNAYNQPGVEAGKKAATKIIKLQKEIEELLDDGKQRTLNEINDALSSDSTESIYLILRKLSENSDHYSMIGNQSNPDKLIISKT

SEQ ID NO: 40044 - protein, 114 aa, Clostridium thermocellum ATCC 27405
MDIIKAIEQEQLKKDVPDFSIGDYVRVNVKVKEGNRERIQAFEGTVIAKKGSGISETFTVRKISYGVGVERIFPVHSPRVAGIEVIRKGKVRRAKLYYLRERVGKSAKVKTKLE

SEQ ID NO: 40045 - protein, 548 aa, Mycobacterium bovis AF2122/97
MSDARVPRIPAALSAPSLNRGVGFTHAQRRRLGLTGRLPSAVLTLDQQAERVWHQLQSLATDLGRNLLLEQLHYRHEVLYFKVLADHLPELMPVVYTPTVGEAIQRFSDEYRGQRGLFLSIDEPDEIEEAFNTLGLGPEDVDLIVCTDAEAILGIGDWGVGGIQIAVGKLALYTAGGGVDPRRCLAVSLDVGTDNEQLLADPFYLGNRHARRRGREYDEFVSRYIETAQRLFPRAILHFEDFGPANARKILDTYGTDYCVFNDDMQGTGAVVLAAVYSGLKVTGIPLRDQTIVVFGAGTAGMGIADQIRDAMVADGATLEQAVSQIWPLDRPGLLFDDMDDLRDFQVPYAKNRHQLGVAVGDRVGLSDAIKIASPTILLGCSTVYGAFTKEVVEAMTASCKHPMIFPLSNPTSRMEAIPADVLAWSNGRALLATGSPVAPVEFDETTYVIGQANNVLAFPGIGLGVIVAGARLITRRMLHAAAKAIAHQANPTNPGDSLLPDVQNLRAISTTVAEAVYRAAVQDGVASRTHDDVRQAIVDTMWLPAYD

SEQ ID NO: 40046 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGMDGVKNKIDPGEAMDINLFKLTLDEIREKGIKQMPHTLRRSLEEMLADKQYLKEGQ

SEQ ID NO: 40047 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHTQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 40048 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLNEIREKGIKQMPHTLRRSLEEMLADKQYLKEGQ

SEQ ID NO: 40049 - protein, 552 aa, Arabidopsis halleri subsp. gemmifera
MASSTALFCDTEAWKDLKGHVEDIKKTHLRDLMSDANRCQSMMMEFDGLLLDYSRQRAPVETMDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNIKGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPFEKNIPVLLGLLSVWNVSFLGYPARAILPYSQALEKFAPHIQQVSMESNGKGVSIDGLPLPFETGEVDFGEPGTNGQHSFYQLIHQGRVIPCDFIGIVKREVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTALEGFNYSTTTLLKRYLETSSEPQM

SEQ ID NO: 40050 - protein, 438 aa, Actinobacillus pleuropneumoniae serovar 1 str. 4074
MLTQEKNDLNKSGLDITNDTLVLILAGGRGSRLYELTDRRAKPAVYFGGCRRIIDFALSNCINSNLLKIGVITQYAAHSLLRHLQRGWSFLPYERNQYIDMLPARQQLDENTWYRGTADAVYQNMSMMKSHYRPKYVVILAGDHIYKMDYTQMLRDHVESGAKCTVGCIEVPREQAVEFGVMAVNDKLKVKEFVEKPADPPAMPGRPDSSLASMGIYVFDADYLYKMLEQEAAVPGTSHDFGKDIIPKAVEEGVLYAHPFERSCKGRNATGAIYWRDVGTIDSYWAAHMDLVSEEPQLDLYDESWPIHGRPQQTAPARFYYNKQRQRTLDNSLIAGGCVITDAEISNSVLFNRVHVAEETIIEHTVILPQVSIGKNCVIKRAVIDRHCVIPDGLQIGVNPEEDAKHFRVSKGGIVLVTQGMLDKLQGITSNIKLHHTI

SEQ ID NO: 40051 - protein, 661 aa, Actinobacillus pleuropneumoniae serovar 1 str. 4074
MKVTAGSPFPLGAQAVENGTNFAIFSENATAIELCLFKQSQEQRFAMRRTGDVWHLFVENIGEGIEYGFRVAGITDKQKGALFNPQKLLLDPYAKRIVGTVSAHTADEIKYFQWDDKRDNAHLAPKSVVVAPDNFDWEDDERPHYPWRETIIYELHVKGFSRLNQQIPEPLRGTYAGLAHPASIAYLKRLGVTTIELQPVSHHIDEVHLQKMGKTNYWGYNVIGHSAVEPVLAWDQEDPITEFKYLVKTLHKHGFEVILDLVYNHTAEGGTDSLTLCQRGIDNQNYYWLNQQGEYENWAGCGNALNLSHPRVCQWAIDSLVYWVSECHVDGFRFDLATTLGRTPEFDQLSPFFEKIKQTPELEHIKLIAEPWDIGPNGYQVGRFPIQFAEWNDKYRTTMREFFLGESGNLGEFARRLAGSDDLYWQYSPAKSINYFASHDGFTLQDLVSYNKKHNEANGENNRDGENTNHSNNHGVEGETDNEFVNILRDQTACSLLATLFLSNGVPMLRAGDELGHSQKGNNNAYCQDNEIAWIDWQNANESRIEYVAKWIALRKRIALLSHQNHWWTENDVQWFSSQGKVMEIEDWHNTESKALQILLQDHWLILINAKKTTQQFFLPTGKWHICLGKNIATLIANTQSVALQFEQMGVCVLQRKLSSY

SEQ ID NO: 40052 - protein, 129 aa, Solibacter usitatus Ellin6076
MESDILVVDDSAAIRKILQRVLRQTGMAIRAIHEAGDGQEALALLAEHRVDLVLTDINMPKMDGLQLLASLKASAQWHNTPVVMITTEGGETKVAEAVKLGAAGYVRKPFTADQIKEKLVGILEPALPL

SEQ ID NO: 40053 - protein, 392 aa, Nitrosomonas sp. OZK11
MSVIKLVDLDLKNKRVFIRADLNVPVKEGKVTSDARITASMATINHCLKQGAKVMVTSHLGRPEEGVWTEENSLQPVADDISRRLGKPVRLIKDWIDGGFEVAPGELVILENCRINKGEKKNLEDTAKKYASLCDIFVMDAFGTAHRAEASTHGIAKYAPVACAGILLTEELEALTKALQQPARPLVAIVGGSKVSTKLTVLESLAEKVDQLVVGGGIANTFLKAAGNNIGKSLCEDDLVPVAKSLMEKMSKRNATIPIAVDVVVGKKFAADEPAVLKTADAVSDDDMIFDIGPKSAQELVHIIMKAGTVLWNGPVGVFEFDQFGEGTHAIAKAIAETSAFTLAGGGDTIAAIQKYDIYDKVSYISTAGGAFLEFLEGKKLPAVEILELRAQ

SEQ ID NO: 40054 - protein, 392 aa, Nitrosospira sp. GS832
MSVIRVTDLDLKGKRVFIRADLNVPVKDGKVTSDARISASMGTIDYCLKQGGKVMVTSHLGRPEEGVWSGENSLKPVADNISERLGKPVRLVKDWVDGNFDVAEGELVILENCRFNKGEKKNADETAQKYARLCDVFVMDAFGTAHRAEASTYGIARYAPVACAGILLTEELDALTRALLDPARPMVAIVGGSKVSTKLTVLESLSEKVDQLVVGGGIANTFLKAAGKNVGKSLCEDDLVPTAKMLMEKMAKRNATIPIAVDVVVGKKFDASEPAVLKDAGAVTDDDMIFDVGPKSARELSDIIMNSGTVVWNGPVGVFEFDQFGAGTRTIAMAIAHTKAFTLAGGGDTIAAIQKYDIYDKVSYISTAGGAFLEFLEGKKLPAVEILEQRAQ

SEQ ID NO: 40055 - protein, 392 aa, Nitrosospira sp. NRS527
MSVIRVTDLDLKGKRVFIRADLNVPVKDGKVTSDARISASMGTIDYCLKQGGKVMVTSHLGRPEEGVWSGENSLKPVADNISERLGKPVRLVNDWVDDNFDVAEGELVILENCRFNKGEKKNADETAQKYARLCDVFVMDAFGTAHRAEASTYGIARYAPVACAGILLTEELDALTRALLDPARPMVAIVGGSKVSTKLTVLESLSEKVDQLVVGGGIANTFLKAAGKNVGKSLCEDDLVPTAKMLMEKMAKRNATIPIAVDVVVGKKFDASEPAVLKDAGAVTDDDMIFDVGPKSARELSDIIMKAGTVVWNGPVGVFEFDQFGAGTRTIAMAIAHTKAFTLAGGGDTIAAIQKYDIYDKVSYISTAGGAFLEFLEGKKLPAVEILEQRAQ

SEQ ID NO: 40056 - protein, 202 aa, Oryza sativa (japonica cultivar-group) [sequence omitted]

SEQ ID NO: 40057 - protein, 392 aa, Nitrosospira sp. TYM9
MSVIRVTDLDLKGKRVLIRADLNVPVKDGKVTSDARISASMGTIDYCLKQGGKVMVTSHLGRPEEGVWTGENSLKPVADNISERLGKPVRLVKDWVDGNFDVAEGELVILENCRFNKGEKKNADETAQKYARLCDVFVMDAFGTAHRAEASTYGIARYAPVACASILLTEELDALTRALLDPARPMVAIVGGSKVSTKLTVLESLSEKVDQLVVGGGIASTFLKAAGKNVGKSLCEDDLVPTAKMLMEKMAKRNATIPIAVDVVVGKKFDASEPAVLKDAGAVTDDDMIFDVGPKSARELSDIIMKAGTVVWNGPVGVFEFDQFGAGTKTIAMAIAHTKAFTLAGGGDTIAAIQKYDIYDKVSYISTAGGAFLEFLEGKKLPAVEILEQRAQ

SEQ ID NO: 40058 - protein, 468 aa, Bacillus cereus ATCC 10987
MKRENNVKKRMGYVMNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDNFMIEEFKNFFISEVAPETIAAVVMEPVQGEGGFIVPSKKFVQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVINRFEEMKNKYNCIGDVRGLGAMCAFELVQDRKTKAPDKTLTANLCAEANKRGLLLLSAGTYGNVIRVLMPLVITDEQLEEGLTIIEESLQVCYEKANIARV

SEQ ID NO: 40059 - protein, 393 aa, Nitrosovibrio sp. FJI82
MPVIKLIDLDLKDKRVFIRADLNVPVKDGKVTSDARISASMATINHCLRQGARVMVTSHLGRPEEGVWSEENSLKPVADNIAARLGKPVRLIRDWVDGGFEVAAGELVVLENCRINKGEKKNLDETAQKYARLCDVFVMDAFGTAHRAEASTHGIAKYAPVACAGILLTEELDALTKALLNPARPMVAIVGGSKVSTKLTVLESLSEKVDQLVVGGGIANTFLKAAGNNVGKSLCENDLVPTAKMLMEKMEQRNASIPIAVDVVVGKKFDANEPAVLKDAAGVADDEMIFDIGPKSAQALADIIMQAGTVVWNGPVGVFEFDQFGAGTKAVALAIVNTKAFTLAGGGDTIAAIQKYDIYDKVSYISTAGGAFLEFLEGKKQPAVEILEQRALA

SEQ ID NO: 40060 - protein, 483 aa, Bacillus cereus ATCC 10987
MDKKATFVNVEKKAMYINGEWITLQEQIEVNNPATKEIFATVPKGGVTEAKQAVDAAHEAFKSWSKLTAADRAVKLKKWFTLIDENKEEIAAIMTREQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDGRVRKVSFTGSTEIGKELMASAAQTMKKVSLELGGHAPFIVMNDADLDKVVEAVIGSKFRNAGQTCICTNRVFVQEEVYEVFAEKFQKSVGQLKVGDGFGDGTTVGPLIDENAVSKVQEHIADAIQKGGTVLYGGQKVAELDGHFMQPTVIGLANDTMLCMNEETFGPVAPVAKFKTVEEVIERANNTPYGLAAYIFTKDISQAFQISEALEYGIIGLNDGLPSVAQAPFGGFKESGIGREGGHFGIEEYLEIKYISLGL

SEQ ID NO: 40061 - protein, 203 aa, Triticum aestivum
MMMRSLEPAAEHKASSSFGNLLSIFLRVSSSEPKPPRRSFDAEGVVGLGIVAAMSRAYLTAQPIAIGAAARRRAHEEDELSESYTCVITHMATGAGEGGSMRKRVYFGFGDGGDGWFVEAAEEAPARADDFLSRCCLCNKRLDGLDIYMYRGEKAFCSSECRCHQMLMDDRAENCGSEALRANSYSASPCSAPMSFSPSVAAA

SEQ ID NO: 40062 - protein, 424 aa, Acinetobacter sp. ADP1
MKLDNIQVDTVVVGAGQAGVAMSEHLTALGISHLVIEKNRIAEAWRSRRWDSLVANGPCWHDRFPNMTFDADQDSFVHHDQVAEYFEKYAKQFNAPIETGVEVTKAYKNKNKKGFTVETSQGVIQTQRIVVATGAFQKAIIPSIAPKQPDFYQIHSDQYRNPQALPEGNVLVIGSGSSGVQIADEINRSGRKVYLSVGPHERPPRSYRNRDNVWWLGVLGGWDYMKSDNSPLKGLAVSGARGGVNIDFRLLANEGITLLGMTRSFEGDKIYFQNDLQKNLKDGDETLLKFLDSADEYVRQNELNLPLEHQVREILPDPSCVTDPILALDLKEANITTVIWASGFGLDYDWLQVKAFNDQGRPAHKQGISDERGVYFLGLPYLTGRGSSFIWGVWYDAKHIADHIQIQRSYLDYQTDKDSLDHSA

SEQ ID NO: 40063 - protein, 347 aa, Burkholderia thailandensis E264
MTTAGKEGPANSPMTMIQALRSAMDVMLERDDNVVVFGQDVGYFGGVFRCTEGLQNKYGKSRVFDAPINEGGIVGAAVGMGAYGLRPVCEIQFADYFYPASDQIVSEAARLRYRSAAEFIAPLTIRMPCGGGIYGGQTHSQSPEAMFTQVCGLRTVMPSNPYDAKGLLISAIESDDPVIFLEPKRLYNGPFDGHHERPVTPWSKHPASRVPDGYYTVPLDSAAIVRAGGEVTVLTYGTTVHVSLAAAEETGIDAEVIDLRSLWPLDLDTIVESVRKTGRCVVVHEATRTCGFGAELVALVQEHCFHWLEAPVERVTGWDTPYPHAQEWAYFPGPNRVGDALRRAMEN

SEQ ID NO: 40064 - protein, 170 aa, Helicobacter pylori
GSGMHTHVSIWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 40065 - protein, 201 aa, Bacteroides fragilis NCTC 9343
MEITNAEFVISNTDVKKCPAGTFPEYAFIGRSNVGKSSLINMLTGRKGLAMTSATPGKTMLINHFLINNSWYLVDLPGYGYARRGQKGQKQIRTIIEDYILEREQMTNLFVLIDSRLEPQKIDLEFMEWLGENGIPFAIIFTKADKLKGGRLKINISAYLRELRKQWEELPPYFITSSEERLGRTEVLNYIESINKELNSK

SEQ ID NO: 40066 - protein, 170 aa, Helicobacter pylori
GSGMHTHVSVWKNNENLFSGETYKGLSGFALHFLGGVLHHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 40067 - protein, 211 aa, Glycine max
MSSSSGQSSGYDLSFKILLIGDSGVGKSSLLVSFISSSAEDLSPTIGVDFKIKTLTVGGKRLKLTIWDTAGQERFRTLNSSYYRKAQGIILVYDVTRRETFTNLSEVWSKEVELYSTNQDCVKILVGNKVDRDTERAVSREEGLALAKDLGCLLLECSAKTRENVEQCFEELALKIMEAPSLLEEGSTAVKRSVLKPKQESQASQNGGCCS

SEQ ID NO: 40068 - protein, 475 aa, Mycobacterium smegmatis str. MC2 155
MREYLKFYIDGRWVDPVEPRTLDVDNPTTEQVAGRIAIGAAADVDAAVEAARKAFTTWSQTSRDERLAVLGAILDEYQKRAIDLADAVGEEMGAPASLAAGPQVRMGLGHLTTSIEALKKFQFEEQYGSTLVVKEPIGVCGLITPWNWPINQIACKVFPALATGCTMVLKPSEVAPFSAQIFTEIIEAAGVPAGVYNLVYGDGPGVGSALSSHPDIDMVSFTGSTRAGIDVARNAAPTVKRVTQELGGKSPNIVLDDADFAKSVAAGVSAMMTNSGQSCNAPSRMLVPNSRMGEAITIARGTAAAVKVGDPSDKKAIGPVASKAQFDKIQGLIQKGIDEGATLVAGGTGRPDGLDTGYYVKPTVFADVTNDMTIAREEIFGPVLCILGYDDLDQAVEIANDTEYGLAGYVSGADLETARAVARRIRAGSVAINHGFDLSAPFGGYKRSGNGREWGHFGFDEYLETKAAMGYAPPQ

SEQ ID NO: 40069 - protein, 863 aa, Arachis hypogaea
MFSGVTGMLNRGHKIKGTVVLMRKNVLDVDTFTDVVATANIGGLIGTGINVIGSTVDALTAFLGRSVSLQLISSTQSDENGNGKVVKDTFLEGIIASLPTLGAGESAFSIHFEWDDSMGIPGAFYIKNYMQVEFFLKTLTLEDVPNQGTIHFVCNSWVYNSKLYKSPRIFFSNKPYLPSETPAPLVKYREEDLKNLRGDGKGERQEHERIYDYDVYNDLGNPDRNENHARPILGGSTTFPYPRRGRTGRYPARNDPNSEKPGDVYVPRDENFGHLKSSDFLANSIKFLTRYVLPAFESVFDLNLTPNEFDSFQDVRDLYEGGIRLPTEVISTISPLPVIKELFRTDGEQVLKFPPPHIIQVNKSAWMTDEEFAREMIAGVNPCMIRSLQEFPPKSNLDPTIYGDQNSKIPAEVLDLEGCSLEEAINGRRLFILDYHDVFMPYVRRINETHAKAYATRTILFLKEDGTLKPVAIELSLPHPDGDKSGAISEVILPAKEGVESTIWLLAKAYVIVNDSCYHQLMSHWLNTHAVIEPFVIATNRQLSVIHPIYKLLSPHYRDTMNINALARQNLINSDGIIERTFLPSKFSVEMSSAVYKNWVFTDQALPADLIKRGMAVEDSSSPYGIRLVIEDYPYAVDGLEIWFAIKEWVQDYVSLYYPTDNDLKKDPELQNWWKEAVEVGHGDLKDKPWWPKMQTVEELVESCTTIIWTASALHAAVNFGQYPYGGLILNRPTLSRRLLPEQGTAEYEEMVKSHQKAYLRTITPKLETLIDLTTIEILSKHASDEVYLGERDNPHWTFDSRALEAFQRFGNKLSEIEEKLTEKNKDGRLSNRIGPVELPYTLLHPTSNEGLTFRGVPNSISI

SEQ ID NO: 40070 - protein, 104 aa, Triticum aestivum
  misc_feature (37)..(37): Xaa can be any naturally occurring amino acid
  misc_feature (64)..(64): Xaa can be any naturally occurring amino acid
  misc_feature (73)..(73): Xaa can be any naturally occurring amino acid
  misc_feature (78)..(78): Xaa can be any naturally occurring amino acid
  misc_feature (80)..(80): Xaa can be any naturally occurring amino acid
  unsure (1)..(104): unsure at all Xaa locations
LIEPYSRVEIAHIAEMIELPIDHVEKKLSQMIVDKKXAGTLDQGAGCLIIFGGSKDRGNLPATXNIPNVRKVXDSFMXSXAKFMVKHPNLFISFPHFPKHLLPY

SEQ ID NO: 40071 - protein, 493 aa, Mycobacterium smegmatis str. MC2 155
MAVKVASSWINGASVETSGETHQIIDPATGKSVSEYNLATAADVDTAVAAARAAFPAWAGATPAERSAVLAKLAKLADEHAEQFVAEEVSQTGKPVRLATEFDVPGSVDNIDFFAGAARHLEGKATAEYSGDHTSSIRREAVGVVATITPWNYPLQMAVWKVIPALAAGCAVVIKPAEITPLTTLTLARLASEAGLPDGVFNVVTGSGAEVGTALAGHRDVDVVTFTGSTAVGRKVMASAAVHGHRTQLELGGKAPFVVFSDADLDAAVQGAVAGALINTGQDCTAATRAIVARELYDDFVAGVAEVMGKIVVGDPHDPDTDLGPLISYAHRDKVAGMVARAPQQGGRVVTGGEAPDLPGAFYRPTLIADVDESSEVYRDEIFGPVLTVRSFTDDDDALRQANDTEYGLAASAWTRDVYRAQRASREINAGCVWINDHIPIISEMPHGGVGASGFGKDMSDYSFEEYLTIKHVMSDITGVAEKEWHRTIFNKR

SEQ ID NO: 40072 - protein, 863 aa, Arachis hypogaea
MFSGVAGILNRGHKIKGTVVLMRKNVLDVDTFTDVAATANIGGLIGTGINVIGSTVDALTAFLGRSVSLQLISSTQSDENGNGKVVKDTFLEGIIASLPTLGAGESAFSIHFEWDDSMGIPGAFYIKNYMQVEFFLKTLTLEDVPNQGTIHFVCNSWVYNSKLYKSPRIFFSNKPYLPSETPAPLVKYREEDLKILRGDGKGERQEHERIYDYDVYNDLGNPDRNENHARPILGGSTTFPYPRRGRTGRYPARNDPNSEKPGDVYVPRDENFGHLKSSDFLANSIKFLTRYVLPAFESVFDLNLTPNEFDSFQDVRDLYEGGIRLPTEVISTISPLPVIKELFRTDGEQVLKFPPPHIIQVNKSAWMTDEEFAREMIAGVNPCMIRSLQEFPPKSNLDPTIYGDQNSKIPAEVLDLEGCSLEEAINGRRLFILDYHDVFMPYVRRINETHAKAYATRTILFLKEDGTLKPVAIELSLPHPDGDKSGAISEVILPAKEGVESTIWLLAKAYVIVNDSCYHQLMSHWLNTHAVIEPFVIATNRQLSVIHPIYKLLSPHYLDTMNINALARQNLINSDGIIERTFLPSKFSVEMSSAVYKNWVFTDQALPADLIKRGMAVEDSSSPYGIRLVIEDYPYAVDGLEIWFAIKEWVQDYVSLYYPTDNDLKKDPELQNWWKEAVEVGHGDLKDKPWWPKMQTVEELVESCTTIIWTASALHAAVNFGQYPYGGLILNRPTLSRRLLPEQGTAEYEEMVKSHQKAYLRTITPKLETLIDLTTIEILSKHASDEVYLGERDNPHWTFDSRALEAFQRFGNKLSEIEEKLTEKNKDGRLSNRIGPVELPYTLLHPTSNEGLTFRGVPNSISI

SEQ ID NO: 40073 - protein, 484 aa, Agrobacterium tumefaciens
MIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPVVLIGPLIDQEAVPKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSDLGREGSHYGIDEYLEIKYLCSAIG

SEQ ID NO: 40074 - protein, 393 aa, Nitrosovibrio sp. RY3C
MPVIKLIDLDLKDKRVFIRANLNVPVKDGKVTSDARISASMATINHCLRQGARVMVTSHLGRPEEGVWSEENSLKPVADNIAARLGKPVRLIRDWVDGGFEVAAGELVVLENCRINKGEKKNLDETAQKYARLCDVFVMDAFGTAHRAEASTHGIAKYAPVACAGILLTEELDALTKALLNPARPMVAIVGGSKVSTKLTVLESLSEKVDQLVVGGGIANTFLKAAGNNVGKSLCENDLVPTAKMLMEKMEQRNASIPIAVDVVVGKKFDANEPAVLKDAAGVADDEMIFDIGPKSAQALADIIMQAGTVVWNGPVGVFEFDQFGAGTKAVALAIANTKAFTLAGGGDTIAAIQKYDIYDKVSYISTAGGAFLEFLEGRKLPAVEILEQRALA

SEQ ID NO: 40075 - protein, 331 aa, Triticum aestivum
MAIPANAAVSLNFPVINMEKLETGERGAAMEVIHDACKNWGFFELLNHGISHKLMDEVERVSKAHYAACREDKFKEFAARTLEAGEKGADVKDVDWESTFFVRHLPASNLADLPDLDHHYRQVMKEFASEIEKLAEKVLDLLCENLGLEQGYLKRAFAGSRGPTFGTKVSSYPPCPRPDMVDGLRAHTDAGGVILLFQDDQVSGLQLLKDGAWVDVPPMRHAIVVNIGDQLEVITNGRYKSVMHRVLTRPDGNRMSIASFYNPGADAIIFPAPALVGAADAAERNEGEEGTAVYPRFVFEDYMNLYVRYKFEAKEPRFKAMKADAAPIATA

SEQ ID NO: 40076 - protein, 397 aa, Solibacter usitatus Ellin6076
MPDSSDEFYRIQKLPPYVFAVINEMRAKARAAQIDVIDLGMGNPDGATPRVIVNKMIEATRNPRNHRYSQSRGIPKLREEITRRYLANYGVELDPDKEAIVTIGAKDALAHLLFATVGPGDTVVSPNPAYPIHQYGVLMAEGHACMLPMPDAATFLERLKELYRNNSKKPKLLLISFPHNPTTTCVDLDFFREIVALAREHGTLIVHDFAYADLGFDGYQPPSILQVEGAKDVAVEIFSLSKSYNMAGWRVGFCVGNQKMISALARIKSYLDYGVFQPIQIASIIALRECEEDTKKICAVYQKRRDVLVNGLKRAGWPVEKPRGSMFLWAPVPEKYRAAGSLEFCKLLLEKAQVAVSPGIGFGPLGEGHVRFALVENEQRIRQATRAIGQFFKSDAQ

SEQ ID NO: 40077 - protein, 82 aa, Triticum aestivum
ICISVLRYVPLESLYPSLALGFYCRDKDDFDDFCLRALKLAEESNGAPLFTVTQTHTAINQSNYGFADDDSEDEREDDWQML

SEQ ID NO: 40078 - protein, 393 aa, Nitrosovibrio sp. RY6A
MPVIKLIDLDLKDKRVFIRADLNVPVKDGKVTSDARISASMATINHCLRQGARVMVTSHLGRPEEGVWSEENSLKPVADNIAARLGKPVRLIRDWVDGGFEVAAGELVVLENCRINKGEKKNLDETAQKYARLCDVFVMDAFGTAHRAEASTHGIAKYAPVACAGILLTEELDALAKALLNPARPMVAIVGGSKVSTKLTVLESLSEKVDQLVVGGGIANTFLKAAGNNVGKSLCENDLVPTAKMLMEKMEQRNASIPIAVDVVVGKKFDANEPAVLKDAAGVADDEMIFDIGPKSAQALADIIMQAGTVVWNGPVGVFEFDQFGAGTKAVALAIANTKAFTLAGGGDTIAAIQKYDIYDKVSYISTAGGAFLESLEGKKLPAVEILEQRALA

SEQ ID NO: 40079 - protein, 103 aa, Sesbania rostrata
MSGRGKGGKGLGKGGAKRHRKVLRDNIQGITKPAIRRLAKRGGVKRISGLIYEETRGVLKIFLENVIRDAVTYTEHARRKTVTAMDVVYALKRQGRTLYGFGG

SEQ ID NO: 40080 - protein, 191 aa, Brassica napus
LQAQARTRASRSSHSSASFHSSTALLFPSSTPSPRSLHTRSLSNAEVIPMDHRGHSKRVDWQTEEDEDKILEVDTWKPRLHHPKPLRSERNNESPRKRQQSLLAPRSTENSPQVGSSGSRRRTPFTPTTTRSEYSWGCNNYYYSGYHPNYMANTESYKAKVRSQSAPKQRLEVSNETSGYKKSVQGQYYYY

SEQ ID NO: 40081 - protein, 417 aa, Oryza sativa (japonica cultivar-group)
MDPSKRGFMNLLNQGSPSQQSSQNSPPTQFPSTFSQSQFPQSPHFTQASPPNFQTFNPFGPPANYHLYGSSPPNFQGFLQQASWLQSAPISFQGFRPQESWMHSPNQVVGSASSHGSKSASQCPARQEENNLVNIEESSDNSQETGRRGTHVNWTEEENLRLLSSWLNNSLDSINGNDKKGEYYWRDVAAEFNGNASSNNRKRTVVQCKTHWGGVKKDIAKFCGAYSRARRTWSSGFSDDMIMEKAHALYKSENNDKTFTLEYMWRELKDQPKWRRILEEDSKNKRTKISESGAYTSSSNQETEEETSRKEKRPEGQKKAKAKLKGKGKKPAPSPLGDQPSQDFVLFNEAVKLRAEAVLKSAEATTKSAEAKKEQTRMEKYQTYLKLLDKDTANFSDAKLKRHEAVLEKLATELAEE

SEQ ID NO: 40082 - protein, 451 aa, Psychrobacter arcticus 273-4
MKIHRPHLLKHTFNVVNRVRQTVSIAGLSALRVAKGEKPDAMLLKETFEQLGTTYIKIGQFIASTPSLFPRDYVQAFQSCLDQTTPLSYAYIEQVLKEEFAVNGLTLEETFAYIDSQPLASASIAQVHAARLHNGDEVVLKVQKPDVETIMQTDLGVLHGVTKLVELLMPSMRFASIAPIIDEIRLRMLAETDFIAEAQNIRDFQQFLAVSGNTRVVAPKVYEAHTTKRVLTMSRLYGVSMVDESLMRQYCTDPAQVMADTLNTWFASLMLCNSFHADLHAGNLMLLTDGRIGFLDFGIVGKLKAESWHACMGMMQAMQDNDYYAMARHMIDMEMTHSSNQVDVVALGNDLQRMMKTIMAEDKAFTSGVPFNTKEQADELNTMMLEIVEVGKRHGIHFPRDFALLTKQMLYFDRFMRTLAPDMDMFSDQRVQMLGKAEINDQENHPILNVL

SEQ ID NO: 40083 - protein, 304 aa, Arabidopsis thaliana
MAIISEVEEESSSSRPMIFPFRATLSSANPLGFLEKVFDFLGEQSDFLKKPSAEDEIVVAVRAAKEKLKKAEKKKAEKESVKPVEKKAEKEIVKLVEKKVEKESVKPTMAASSAEPIEVEKPKEEEEKKESGPIVPNKGNGTDLENYSWIQNLQEVTVNIPVPTGTKARTVVCEIKKNRLKVGLKGQDPIVDGELYRSVKPDDCYWNIEDQKVISILLTKSDQMEWWKCCVKGEPEIDTQKVEPETSKLGDLDPETRSTVEKMMFDQRQKQMGLPTSEELQKQEILKKFMSEHPEMDFSNAKFN

SEQ ID NO: 40084 - protein, 170 aa, Helicobacter pylori
GSGMHTHVSIWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 40085 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSTRFEFRFPDSSSNPYLAFAAILMAGMDGVKNKMDPGEAMDINLFKLTLDEIREKGIKQMPHTLRRSLEEMLADKQYLKEGQ

SEQ ID NO: 40086 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEDQ

SEQ ID NO: 40087 - protein, 780 aa, Yarrowia lipolytica CLIB122
METTEKTAFEAVSVEPFYTGGKTSLADDGYTLATSFGEDVVVTNIKTGEEICRIEGDSEILTTLEISPDAQYLVTCSRSLTMRTYRIPSGELVRSARAHDAPVIVMAIDSSSSLVATGGAEGTVKVWDLERGFVTHNLKGHGGVVSALKFFGEQGGSVWRLASGADDCKIRVWDLVSRKCLKVLDSHNSVIRGLSWSSDGGILVSGGRDKIVNVWDANKFKLVRTIPVGESIETAGILNGEGLRIYTGGEMGVVKIWNGQTSALIAAQVQPAVHNKENERVGVVDILYKTDKLVSVLSDQTFVELDDDLKEVRRIVGFHDQIIDMTYVGEDESKLAVVTNAPDIRIQTVGGIETNVLTGHRDNVIAVDRSFDGTWLASSGKDHEARIWHVPTLTCFAVCTGHAGSVGGVALPRLPLEGRPPQFLITGSQDLTIKKWNIAKDGTAKAEYTRKAHEKDINALDVSPNDRLFATASQDRTAKVWDMNSGEAVGVLRGHKRGVWSIKFNPYEKQIVTGSGDKTVKVWSLNDFSCLRTFEGHTNSVLRTVWTSLGSQIVSSGGDGLIKVWTYASGECAVTLDNHEDKVWSLAVRGSDDGAQMVSGDGEGTITVWKDISDEEKAAKKAAAELQVEQEQQLANYVRSKDWENAILLALTLNQPYKLFCLFRDVLADRQDEDSIMGLTKVDNVIAGLNVEQLELLIKRVRDWNTNARSSVVAQRVMNCILVNHSVDKLSQVPKISTMTDALIPYSERHFNRVDEMYDESYLLDYALNEMDFLDTPQVV

SEQ ID NO: 40088 - protein, 420 aa, Deinococcus radiodurans R1
  misc_feature (122)..(122): Xaa can be any naturally occurring amino acid
  unsure (1)..(420): unsure at all Xaa locations
MEQDTAWRQEANQTFHTRATFLECARVNLGSGGRADLSRRKRRPMDYYELLGVSRTASADEIKSAYRKLALKLHPDRNKEEGAAEKFAQVSEAYSVLSDTEKRAHYDRFGSAPGAGMPGGDXFGGMGGMGGVGFDPMDIFEQLFGGAAGMGGRGRRGPARGDDLETEVRITLEQARAGEEVEVTVDRLTECEHCHGTRTEPGGKPPVTCSTCNGSGAVRGQARTIFGVVETQQVCPTCKGDGKMVVDPCTVCHGRGRTLKSEPVKVKLPKGIDEGYRIRVAGQGNEGPGGNGDLYVHIEMEPHPELHRQDENLIFPARIGFATAALGGRIQVPTLDGPQEVEVKPGTQHGELHRLRGQGMPRLQGAGTGDLIVDYEIVVPKHLNAEAKDALQAYARAVGDEVPEEHEGLFGKIGKLFGRD

SEQ ID NO: 40089 - protein, 118 aa, Campylobacter lari RM2100
MKNKYIEQFEQKQIEGKNVPEFRAGDTLRLAIRIKEGDKTRIQNFEGICIARRGNGVDETFIVRKIGANNVGVERIFPIYSESLESITVLRRGRVRRARLFYLRDRRGKAARIKELKK

SEQ ID NO: 40090 - protein, 343 aa, Solibacter usitatus Ellin6076
MLVAELIAQRQFRFTEIPIEDPGPGEVQVRVNAVGICGSDLHSYAEGAIGDTPCEYPMVLGHEPAGTVVKTGTGVGGWSRGDRAALEPALYCYHCEFCRSGRHNICANIRFLSNPGTPGFFREFVNLPVSNLLAIPPELSLELATIVEPLAVALHSLKFAAIQPRETVAVFGAGPIGLLTIACLKDAGAGRIWVVEPVSHRRELALRMGAAAALDPTHLDAARQILSDTARRGVDCAIDCAAREDTTNAAIRAARNGGRVVLTGIHSAAFVPFEVSPMRRKELAIFNVRRSCHESHEALSMLTSQMSSFAPLVTHTRPLHALPDAFTLTEHYADGVAKMVVVP

SEQ ID NO: 40091 - protein, 501 aa, Burkholderia sp. 383
MNPTSAENHQHADWRRLAAHVVPRTLAHIGGCSVPARSGRTFAAINPATEAVIAEVASCDAPDVDDAVRAARHAFESGAWSRCAPAERKRVLCRLGELIASHGAELALLDSLNMGKRVADAFSIDVPAAGGLFSWYGEAVDKLHGEVASTDPGNLAVVTREPLGVVGAVVPWNFPLDMVAWKVAPALAAGNSVVLKPAEQSPLSALRLAELALEAGLPPGVLNVVPGYGETAGRALGLHPDVDVLAFTGSTAVGKKFLEYAAQSNMKQVWLECGGKSPNLVFDDTDDLDLAARKACFGIFFNQGEVCSANSRLLVQRSIHDAFVDRLIAHAAAFMPGDPLDPSSGMGAIVDEQQHRRVREWIARGRDSATLAIGGGAPRVDGKGYFIEPTIFIDVKHDDAIAREEIFGPVLSVMAFDTEDEAVRLANDSIYGLAASLWTGSLSRAHRVSGRLRAGTVSVNTVDALSAQTPFGGFRQSGFGRDLSLHAIDKYTGLKTTWISY

SEQ ID NO: 40092 - protein, 463 aa, Burkholderia sp. 383
MNAPNFPHRTTQDYQRSDAAHHLHAFVDQKALNEEGARVMVRGEGVHLWDNDGNRYLDGMSGLWCTNVGYGRPELVDAAARQMKELSYYNMFFHTTHPSVIELSERLFALLGNRFSHVVYTNSGSESNEVLIRTVRRFWDVMGKPEKKVLIGRVNGYHGSTVGSASLGGMAFMHEMGDLPIPNITHVDEPYWYANGGDLSPEAFGKQAALSLERKILEIGADRVAAFVAEPFQGAGGMIFPPDGYWQEIERICRQYDVLLCADEVIGGFGRTGEWFAHRHFGFEPDLICVAKGLTSGYVPMGGLIMSRRVGDALVDKGGVYAHGLTYSGHPVAAAVALANLDVLEREGLVERTKTDTGPYLQKALRDAFGSHPLVGEVQGVGAVGAIQFAKNKATRERFANEADLTWHSRTVGFELGAIVRSTNGRLIVAPPLVIDHAQIDELVDTMRKAVDATAREVLGIDC

SEQ ID NO: 40093 - protein, 375 aa, Colletotrichum gloeosporioides f. sp. malvae
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPQAIARVDMAGRDLTDYLMKILAERGYSFSTTAEREIVRDIKEKLCYVALDFEQELQTASQSSSLEKSYELPDGQVITIGNERFRAPEALFAPSVLGLESGGIHVTVFNSIMKSDVDVRKDLYGNIVMSGGTTMYLGLSDRMQKEITSLAPSSMKVKIIAPPERKYSVWIGGSIFASLSTFQQMWISKQEYDESGPSIVHRKCF

SEQ ID NO: 40094 - protein, 895 aa, Solibacter usitatus Ellin6076
MRLSMHQKLNERVVDLNPQETSEWIESLDQVIDEAGPDRATFLLEHLTERARATGVELPVQLNTPYINTIRPEDEVPYPGDRAMERRIKSLIRWNAMAMVVRQNKYDAGIGGHISTYASLATLLEVGFNHFFHASYGDQPGDLVYFQGHASPGVYGRAFLEGRITEEHLKNFRHELRDTPGLSSYPHPWLMPDFWSFPTVSMGLGPINAIYQARFMRYLENRGIIPETPRQVWAYLGDGEMDEPESMGSITLASREKLDNLKFVINCNLQRLDGPVRGNGKVIQELEAAFRGAGWNVIKVIWGSDWDPLLARDTTGLLQRRMGEVVDGEFQTYVTKDGAYIRQYFFGKYPELLDLVSHLSDEEVFKLRRGGHDPRKVYNAYKQAVETKGKPTLILAHSVKGYGLGESGEGRNISHQQKKLNEQEIANFRSRFEIPIPDEAARNASFYRPPSDSPEMSYLHERRRVLGGYMPSRKVPESKITAPPLEYLKESLEGSGEREVSSTMAMVRVLTLLLKHPEIGKRVVPIIPDEARTFGMESLFRQFGIYASQGQLYKPHDAEIFLYYKESRDGQILEEGITEAGSISSFTAAGTAYANYGVEMIPFFIYYSMFGFQRVGDSIWAFGDARGKGFLCGGTAGRTTLSGEGLQHQDGHSILHASTVPNCKTYDPAFAYEIAIIVQDGIRVMYQEKQDCFYYLTLYNENYPMPAMPAGLDPEGVLKGIYRFKAPEKGKAKVHLFGSGPILNEALRAQQILAEKYNVPSDVWSVTSYNELRRDALAVERWNRLHPDQPQRVPYLLQAMKGADAPVIAASDYMKVVADQIAPWLPGRMETLGTDGFGRSDNREYLRRHFEINAESIAAAALSRLARDGKFDAKKAVAAFKDLGVDTEKIDAARA

SEQ ID NO: 40095 - protein, 375 aa, Arabidopsis thaliana
MEGAGETTTSEGHLTSAAAFVEGGIQDACDDACSICLESFCESDPSTLTSCKHEYHLQCILEWCQRSSQCPMCWQSISLKDPTSQELLEAVEQERNFRFNPTRNATIFRHPTLGDFELQHLPVGVDNAEIEERIIQHLAAAAAMGRARHGVRREGHRSRSSSQGHQQFMVFSSQPNASSPPPHPPMPSSPSQRDESDTVSNLPHNALGEGSHQSNTQPPTSSHPRQVSPSASDSNSRPLNQSSPSEQDRAGPSELQSFSESLKSRLNAVSTRYKESISKNTRNWKDRLFSRNTSMADLGSEVKREVSAGIATVSRMMERLETRENSRPSTASVSDVSENHTPETNNEHNRAAAGDEHSVNERGVKETCATGSGSS

SEQ ID NO: 40096 - protein, 235 aa, Zea mays
MTVLDAESRFHVLAVDDSIIDRKLIEMLLKSSSYQVTTVESGNKALELLGLRDNGAEDASPPSSSSSSSSSSSPDHQEIDVSLIITDYCMPGMTGYDLLKRVKGSSSLKDIPVVIMSSENVPARISRCLQDGAEEFFLKPVKPADMKKLKSHLLKRKQPKQKNKPQAQAVESPEQQLDPHPQPVHELELEEAAADRNGVNKRKAAAMEEGLTVVVTAPESTKPRRLSTSSLTVET

SEQ ID NO: 40097 - protein, 1342 aa, Burkholderia thailandensis E264
MPHALALDAGAPAPLGSRWDGGGVNFAVYSRHAARVELCLFDASGRQERARLTLPARTGDVWHGYLPGAAPGTVYGYRVHGCYAPHRGERFNPHKLLLDPCACALTGDFVWHDAVYGYRRDRGADDPHARDPRDSAPYVPKSRVVAPAVRGARPPKPGTPWRDTVIYELHVRGFTRRHPDVPAPLRGTVAGLGTRAAIAHLRELGVSAIELLPTAAFIDEAELARRGRRNYWGYNPLAPCAPHPRYLAHDGDDEFACTVDRLHEAGIEVIVDVVLNHTAERDARGPTLCLRGLDNASYYRLDPERPARYVDYTGCGNTLDLSRPAAIALALATLRHWACDIGVDGFRFDLATTMLRDADGRVGNEAPLVAAILADAELASLKLIAEPWDATLSGYRLGGFAPPFAEWNDRYRDGMRRFWRGDRGAAGECATRFAGSSDVFARAGRAPSASVNFVTAHDGFTLADLTSYAAPRGGGPGASSGRRDEITVCGADESAADDASVRLRRRRLRASMLGALAMSHGTPMIVAGDEFSRTLHGDNNAYCVDSPASWIDWSARGDPDRDLRTFVTRALSVRRALDMLRQTRFFDGRPIAAQGADKDIAWLLPEGRELTEDDWRANETRGFAALLADPRRGGDASPSRIYVAMNARDTRCAFRLPESAGERTPDWLVALDSDATECAAAGALYPGGSWITVEGGGFVALVPADTAGVGVAGPLAARARRAGIAIDYVGADGLRRQVPAEALERLVAALGERADAAEGPDGTTRAGADAARPSSARRPATQAPARCWLPLALRQRPGCWALSVQTYGLRSARSWGIGDFDDLAHMIDVAARLGAAGVQSSPVHALSLSQPQRASPYAPCDRLMLNPLLISAPLAAGDAPPPDYLRFVEQPRVRAELSRIERAATIDYPAVASLKRQALALLHAAFVRDGPDAERTAYRAFCHGEGVALREYATFEALGEWQAAQQGRYVGWMQWPSAYRDPRSTPVADFADAHRERIDFFMYLQWQARRQWHRAAARGRDARMALGLVADLALGAGADSVEAWRWPGLAALDAELGAPPDAFAARGQRWGLAPWRVQRLADADFAPFAAVLDAAMRDAGALRIDHAAGLMRQFWVPRGGDAARGAYVSYPFDALLARITRASAAHRCAVIGEDLGNVPPGLRERLAQAHILGCRVVYFERTPDHAFVAGDRYPPLTAAMASTHDLPTIAGFYSGADNDELDARGLRASPSLAALAREERRVALATLRARLAPYGDTTNAAAFARALHRFLADCASRLVIVQLDDALGVERQANLPPLGDAPPNWRQRIPVAIDALANHGGLRDLAWIFEKRAPSNGSSRTE

SEQ ID NO: 40098 - protein, 116 aa, Psychrobacter arcticus 273-4
MSEQTPNTAANDIEQLIRNQIKDNKVILYMKGSPQFPQCGFSAKAIEVLTQIGRPFAFVNILENPEIRATLPQIANWPTFPQLWIDGELMGGSDIILQMYQSGELKPLVEANSPAA

SEQ ID NO: 40099 - protein, 152 aa, Arabidopsis thaliana
MVSPSFSTKLVFFACFVLFTFSHKLVTGESDKVELNLYYESLCPGCQSFIVDELVKVFDSDLDTITDVKLVPFGYAKVSNNLTVICQHGEEECKLNALEACVINTLPNPKSQYKFIRCVENNTDNWESSCLKGYGNEKAINDCYNSDLSKKV

SEQ ID NO: 40100 - protein, 304 aa, Prochlorococcus marinus str. MIT 9313
MSGLQVLLVAGTHGNEINGPWLLDQWSQTPELINTHGVGVVPVIGNPEALALGRRYLDCDLNRSFRLDLLRSPSILDREVVRAKQLLSFFGPEGSTPCQIVIDLHSTTSAMGSTLVVYGRRSVDLALAALIQARLGLPIYLHDGDDDQQGFLVERWPCGLVIEIGPVPQGLLKARIIEQTRLAVQACLEALSSVASGSPTYPDEFVVHSHLGSLDLPRDALGQPAACVHPSLQGRDWQPLQMGAPLFLWPDGEVFRFEGRDSPIPVFINEAAYVEKHIAMSLTCREVCPLPEQWQGALQQLVDC

SEQ ID NO: 40101 - protein, 651 aa, Triticum aestivum
MSKLLVIALLLLPLINHGIYLATAWDDQDFFKYCPPSNCSQHGPEVRFPFCLESSNTSAVAAAAAASCGCSSTDGLIWKLACFGQDTILVHPVLGSYSVSAIDYRRSSVKLIPLVDPCLMLQQKLAISRRWSSRQVDVIDGMQLPDRQFSILSYKYATLVCCSSEFTPAAADADSIAGPVSCLSNTTLFLYLVAAYKDMSILPLDCKVFPVSDGVSGRLIPMYMLEDPMSGTPFSLSFKERAERMLSFAETTVYWFGGNCRQCELSGQRCAFSSQRDETFCIPDPHGSRIKVIAATSSVAAFVVLLVTVATVLYLSLKTRYNAEIHLKVEMFLKTYGTSKPTRYTFSEVKKMARRFKEKVGQGGFGSVYKGELQNGVPVAVKMLENSTGEGEAFINEVATIGLIHHANIVQLLGFCSEGMRRALIYEFMPNESLEKYIFSRDSANFQHLLVPDKLLDIALGIARGMEYLHQGCNQRILHFDIKPHNILLDYNFNPKISDFGLAKLCARDQSIVTLTAARGKMGYIAPELYSRNFGGVSYKSDVYSFGMLVLEMVSGRRNSDPRIGSQDDVYLPEWIYEKVVNGEELALTLETTEEEKEKVRQLAIVALWCIQWNPRNRPSMTKVVNMLTGRLQSLQMPPKPFVSSENELMP

SEQ ID NO: 40102 - protein, 661 aa, Acinetobacter sp. ADP1
MQVKTPDIGVDKATVAEILVKVGDTISENDSLILLESDKASVEVPSTASGVVKSILVSLGDEVSEGTTLIELESGDNTDKTESESAPAQTEVKAETPVEQVAPQETKPATSTSAASSVVEVQVPDIGVEKATVAELLVSVGDEIAENDSLVLLESDKASVEVPSTVSGTIESIEVKAGDTIQEGVLLLKVKTAGASNAAPAKQEAVVPTAAPVATKAETQAETPAVQSAPAGAVDVLVPDLGVDKAAVAEILVNVGDKITKDESIVVVESDKATVEVPSTVSGIVKAIHVKAGQDVKEGILLVTVEAEGAVASAPKAPVAKAEAAPAPAAQKAEAPAAKVETAPQAGADKLTKEQEAENSKVYAGPAVRKLARELGVVLAQVKASGEHGRLMKEDIYAYVKQRLTAPVAAPKAAAAAVASGLPTLPDFSAFGGVEEKTLTRLQQVSIPQLSLNNFIPQVTQFDLADITELEAWRNDLKGNFKKEGISLTIMAFIIKAVAHLLKEEREFAGHLSDDGKSVLLRKEIHMGIAVATPDGLTVPVLRNPDQKTIKQIAVELGVIGQKARDKKLSPKDLQGANFTISSLGAIGGTAFTPLVNWPQVAILGISPATMQPVWNGKDFDPRLMLPLSLSYDHRVINGADAARFTNKLTKLLQDIRSLLI

SEQ ID NO: 40103 - protein, 250 aa, Arabidopsis thaliana
MASSSATKFVDLFPCLFLACLFVFTYSNNLVVAENSNKVKINLYYESLCPYCQNFIVDDLGKIFDSDLLKITDLKLVPFGNAHISNNLTITCQHGEEECKLNALEACGIRTLPDPKLQYKFIRCVEKDTNEWESCVKKSGREKAINDCYNGDLSQKLILGYAKLTSSLKPKHEYVPWVTLNGKPLYDVYITLPFIFILTNFKLISLFWGCRITIIWSHKSAKRTKERISQNYAVPRSCMRGKCQSFKSPM

SEQ ID NO: 40104 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGIDGIKNKMDPGEAMDINLFKLTLDEIREKGIKQMPHTLRRSLEEMLADKQYLKEDQ

SEQ ID NO: 40105 - protein, 904 aa, Acinetobacter sp. ADP1
MAFYGDSDAQETKEWQDAFDSVLQHMGTERAAFLLEKLYQRAIAKHVPIQRLNTPYLNTISVAEEPAMPGDQDMERRIRALIRWNALAMVLRANKTGDDLGGHLASFASSATLYDVGFNHFFRANSDNFGGDMIYYQGHCAPGIYARSFLEGRLTEDQLNNFRREVNGNGLSSYPHPYLMPDYWQFPTVSMGLGPIMSIYQAHIQKYLMNRGLIKEEDRKVWAYLGDGEMDEPESTGAISLAGREKLDNLIWVVNCNLQRLDGPVRGNGKIIQELESLFRGAGWRVIKVVWGRHWDPLLAKDNSGALKAIMEEAVDGDYQRYQVKGGAYTRAHFFGKYPEAEDLVKNLSDEDIDNLNRGGHDPYKVYAAYAEAMKSTGQPTVILAKTVKGYGLSDEIEAVNKTHQIKKMHVDSLKYVRDRFNLPFTNEQLEELPLYRPAENSPELKYMKARREALGGYLPARRKESEALAIPDISIFDSVLSGSNGKEQSTTMVMVRLIAALLKEKAIKDRVVPIVPDEARTFGLEGMFRQLGIYAAHGQKYTPEDNEQLMNYREAKDGHMLQEGINEAGAMSAWAALGTSYSTNNLPMIPMYMYYSMFGFQRIGDIAWAAGDAQAQGFLLGATAGRTTLNGEGLQHQDGHSHILANTIPNCISYDPCFGYELAVVVHDGLQRMYVNQERVFYYLTVMNENYEHPEMPKGAEEGIKRGMYLFEKDDKATVQLLGSGVILREVIKAAKILREEYQIHSNIWSVTSFNELSRDGMACDEYNRLHPLAEETKESWVSQQLRGTDGIVVSATDHMRAYSEQIRAYLPDNRPYVTLGTDGYGRSDTRGNLRSYFGVDAAHIVVATLKKLADEGEVENRLVKDAISSFELETDRPVAWAPQAHPEVQPVAAYEEHSGEGN

SEQ ID NO: 40106 - protein, 1072 aa, Bacillus cereus G9241
MPKRLDINTILVIGSGPIVIGQAAEFDYSGTQACQSLKEEGYKVILVNSNPATIMTDTATADKVYIEPLTLEFVSRIIRKERPDAILPTLGGQTGLNMAVELAKSGILEECGVEILGTKLSAIEQAEDRDLFRSLMQELNEPIPSSTIIHTLEEAHEFVKEIGYPVIVRPAFTMGGTGGGICSNEEELIEIVSGGLKHSPVTQCLLEKSIAGCKEIEYEVMRDSNDNAIVVCNMENIDPVGVHTGDSIVVAPSQTLSDREYQMLRNTSLRIIRALGIEGGCNVQLALDPHSFQYYVIEVNPRVSRSSALASKATGYPIAKLAAKIAVGLTLDEIINPVTQKTYACFEPALDYVVSKIPRWPFDKFESANRTLGTQMKATGEVMSIGRNLEESLLKAVRSLELGIYHLELDHLKELDKETMKKRIIKADDERLFIVAEAIRQGVTKEEINDWCEMDFFFLQKVENIVNMEREVKANVGNMEVLQTAKEMGFSDHYIANAWNKTEREIYDMRKESNITPVYKMVDTCAAEFESATPYYYSTYGDENESVRTDRKSVVVLGSGPIRIGQGVEFDYATVHSVWAIKEAGYEAIIVNNNPETVSTDFSISDKLYFEPLTIEDVMHIIDLEKPEGVIVQFGGQTAINLAAKLEAHGVKILGTSLEDLDRAEDRDKFEAALTQLGIPQPVGKTATTVEQAVAIADKIGYPVLVRPSYVLGGRAMEIVYRQEELLHYMKNAVKVHADHPVLIDRYMVGKEIEVDAISDGENVFIPGIMEHIERAGVHSGDSIGVYPPQSLSDKLKEQIIEHTIALGKGLNIVGLLNIQFVVFEDQVYVIEVNPRASRTVPFLSKITGVPMANVATKVILGQDLVAQGYGTGYHPEEKEVYVKAPVFSFAKLRSVDTTLGPEMKSTGEVMGKDLTLEKALYKGLVASGINIPTHGSVIITVADKDKEEAMEIAKRFHEIGYNLLATAGTAQSLAEQNIPVQVVNKIDSEDYNLLDIIRQGKAQFVINTLTKGKQPARDGFRIRRESVENGVACLTSLDTTRAILRVLESMTFSAHSMKEITQTKRHEVVHA

SEQ ID NO: 40107 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEDQ

SEQ ID NO: 40108 - protein, 411 aa, Oryza sativa
MGCFCIFGKRRATRQQSSQHNDDPSGDMNITKFTYKELSRVTENFSPSNKIGEGGFGSVYKGKLRNGKLVAVKVLSLESRQGAKEFLNELMAISNVSHENLVKLYGYCVEGNQRILVYNYLENNSLAQTLLGYGHSNIQFNWATRVNICVGIARGLTYLHEVVNPHIVHRDIKASNILLDKDLTPKISDFGLAKLLPPDASHVSTRVAGTFFTYSVLHDRGYLAPEYAIRGQVTRKSDVYSFGVLLLEIVSGRSNTNTRLPYEDQILLERFPEITNGVLLLQTWVHYEEGDLEKIIDASLGDDLDVAQACEMDVELAKISKPAIISDFMDLKVRSMRKEVDIVSSSTSTLLSSIMAHSSPLLSQETTEASMTFTAISDPSEVVHECMQMQACNNGWSIRDQHMSELEVITN

SEQ ID NO: 40109 - protein, 681 aa, Deinococcus radiodurans R1
MQNPPQHPEAQSPETRDREFFITAAIDYANGTPHIGHVYEKILADAIARYQRLAGRDVTFVMGTDEHGEKISKAAAKGGVTPQELVDDLSERAFQGLWKKLGISYDFFIRTTSAKHKKYVQDVLQRVYDAGDIYFAEYEGLYSVGAERYVTEKELVEGPDGVRRFPGDKDPPELRREANYFFNMQKYQPWLLETLQQNPDLIQPAGYRNEVLEMLKEDIGPLSISRPKARVPWGIELPWDTDHVTYVWFDALLSYLTPLVSQGQDASMSGKAWHVIGKDILKPHAVFWPTMLRAAGLPLYRRLVVHSHILAEDGRKMGKSLGNAIDPEELVAAWPVDAIRYALLREASLGADSPFGEGVLVSRLNSDLANDLGNLLSRTVSMIQKYRGGVIPAATEPTDREREIEAAARALPDEVLRLVDELKINMAIDAAMSFVRDLNRYIAESTPWTLAKSPETQGRLDTVLYTAAEGLRVASVALEAVIPTKAKELREQLGLGRQGYPLQAAWGLTPAGTRVQGGAILFPKPEPKADETKNAEAKPPKPQAKKEKKTVTDTAPAKTTEQKPEAAAPAQNDGLISIDDFAKIDLRIAEVVACEAVEKADKLLKLTVKLGDETRTVVSGIRKWYEPEALVGRKVVLVANLKPAKLRGIESQGMILAAEDDAGNLDLVGTELDLPSGTKVR

SEQ ID NO: 40110 - protein, 500 aa, Mirabilis jalapa
MTAIKMNTNGEGETQHILMIPFMAQGHLRPFLELAMFLYKRSHVIITLLTTPLNAGFLRHLLHHHSYSSSGIRIVELPFNSTNHGLPPGIENTDKLTLPLVVSLFHSTISLDPHLRDYISRHFSPARPPLCVIHDVFLGWVDQVAKDVGSTGVVFTTGGAYGTSAYVSIWNDLPHQNYSDDQEFPLPGFPENHKFRRSQLHRFLRYADGSDDWSKYFQPQLRQSMKSFGWLCNSVEEIETLGFSILRNYTKLPIWGIGPLIASPVQHSSSDNNSTGAEFVQWLSLKEPDSVLYISFGSQNTISPTQMMELAAGLESSEKPFLWVIRAPFGFDINEEMRPEWLPEGFEERMKVKKQGKLVYKLGPQLEILNHESIGGFLTHCGWNSILESLREGVPMLGWPLAAEQAYNLKYLEDEMGVAVELARGLEGEISKEKVKRIVEMILERNEGSKGWEMKNRAVEMGKKLKDAVNEEKELKGSSVKAIDDFLDAVMQAKLEPSLQ

SEQ ID NO: 40111 - protein, 435 aa, Triticum aestivum
  misc_feature (164)..(164): Xaa can be any naturally occurring amino acid
  unsure (1)..(435): unsure at all Xaa locations
MDADTSRQVRVRFITKLPPPLRAPPTAIAVPAELSRMGLSEIVNSLLLSAEPDHQAQPFDFIVDGELVRMPLHQFLLAKGISAERVLELEYIKAVAPRKQEPPLPHDDWVSAVDGSNPSFILTGCYDGLARIWKDAAECTQVLEGHSGAITSASFINKGVETDXSLHVVTGSKDRSLRLFKFDTSVTIGSSKRIGAYKILPGHTSSIQSIAVDPSRNMICSASWDTTIKLWAVEGSEEDSDTVSVKKRRMNSDASGPEESQLEGSASSTLLGHTQCVSSVAWPEQRTIYSASWDHSVRQWDAQTGRETWNMFCGKALNCLDCGGEGSSLIAAGGSDPVLRVWDPRKPGTTAPIFQFSSHSSWISACKWHPSSWFHLISSSFDGKVMLWDLRTAWPLASVDSHKDKVLCADWWKGDSVISGGADSKLCISSGVEIA

SEQ ID NO: 40112 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGIDGVKNKMDPGEAMDINLFKLTLDEIREKGIKQMPHTLRRSLEEMLADKQYLKEGQ

SEQ ID NO: 40113 - protein, 370 aa, Bradyrhizobium japonicum USDA 110
MVNDPLRVGAAASPHTPRRAKQAPTGHRPSSLDLNMPSSKPLMTQSSGPIPASVESALRTLETESGGINALAAALRGPLGATFAKAVDMIRQAKGRVIVTGLGKSGHMGRKIAATLASTGTPAFFVHTAEAAHGDLGMITADDVIMALSWSGEQPEMKTLVNYSARFAIPMIAVTSNAASSLGQAADLVIELPKAREACPHNLAPTTSTLMQAAIGDALAIALLEGRGFTALEFAHFHPGGKLGAMLKFVRDYMRTGAEIPVKPEGTKMSEAVVEMSAKGLGCVCIVNDANEAVGIITDGDLRRHMRPDLLTVSVDDIMTRQPKSVPPSMLATEMIEVLNTRKITTLLVTEAGKVVGIVHLHDLLRAGVA

SEQ ID NO: 40114 - protein, 486 aa, Celosia cristata
  misc_feature (315)..(315): Xaa can be any naturally occurring amino acid
  unsure (1)..(486): unsure at all Xaa locations
MNSSETPTDHIILLPFLAQGHLRPFFHLAHFLQSFTPFKISLLTTPLNAASFRRLSDNLNYNLNIVDLPFNSTDHGLPPNTENTEKLPLPSIVTLFHASTSLEYHVRNYLTRHHLNNPPICIIFDVFLGWANNVARSVGSTGICFNTGGAYGLAAYTSIWTHLPHRNISDDEEFSLTDFPENRKFRRNQLHRFLRFADGTDDWSRFFQPQINFSMNCSGWLNNTVEEIEPLGFEILRKKLELPIWGIGPLIATSSNCNNNNDDHGCIEWLNQFEKDSVLYISFGSQNTVNPTQMMELAKGLEESNVPFLWVIRPXFGFDINGEFKPEWLPDGFEERMMKKKQGKLVPKWGPQLEILKNEATGAFLSHCGWNSVIEGLREGVPIIGWPLAAEQAYNSKMMVEEMGVAVELTRGLEGEVKKDGVKKVVEMVLDRKQGSCGCEMKKRAVEIGEKLRDAMKVEGDYKGSSLKALDDFVGFIVSHKGKVVA

SEQ ID NO: 40115 - protein, 182 aa, Brassica napus
MPLSLRLAPSPTALSPTTGGFSPAKKQCRIPSYSGVATTTRRIGFCSLDYVKRGDSSVVRCSLETVNVSVGQVTEVDKDTFWPIVKAAGEKIVVLDMYTQWCGPCKVIAPKYKALSEKYEDVVFLKLDCNPENRPLAKELGIRVVPTFKILKDNQVVKEVTGAKYDDLVAAIETARSASSSG

SEQ ID NO: 40116 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKEGQ

SEQ ID NO: 40117 - protein, 476 aa, Campylobacter lari RM2100
MGKFVNNIDEFFSYCQEHEVLFVDFRFTDMIGTWHHITYNIKAIDDKTFENGIPFDASSLHGWQPIEKSDMILKPDVKSAFLDPFTADPTIIVICDVYDIYKDQMYEKCPRSIAKKAMQHLSTSNIADTAYFGPENEFFIFDNVKIVDSSHCAKYEVDTEEGEWNDNKDFADSYNSGHRPRNKGGYFPVSPVDSSVDIRSEMVQVLERVGLKVFVHHHEVAQGQAEIGVEFGNLVEAADNVQIYKYVVKMVAHLNGKTATFMPKPLYGDNGSGMHVHMSLWKDGVNLFYDKEGYGKLSECAINYIGGILANARSVAAFTNPSSNSYKRIVPGFEAPCILTYSCQNRSASCRVPYGINEKSARVEIRFPDSTSNPYLAFTSLLMAGLDGIKNKTIPVGPMDENLFALTLDEIREKGIEQLPHTLRGSLEALIRKNAFLKPVMSDVFIDDYQHMKFETQVWPVEARPTAYEFKTCYSC

SEQ ID NO: 40118 - protein, 708 aa, Arabidopsis thaliana
MVSRFRLALEAVLGSRRRKKMASTSSGGGGGGDKKKKKGFSVNPKDYKLMEEVGYGASAVVHRAIYLPTNEVVAIKSLDLDRCNSNLDDIRREAQTMTLIDHPNVIKSFCSFAVDHHLWVVMPFMAQGSCLHLMKAAYPDGFEEAAICSMLKETLKALDYLHRQGHIHRDVKAGNILLDDTGEIKLGDFGVSACLFDNGDRQRARNTFVGTPCWMAPEVLQPGSGYNSKADIWSFGITALELAHGHAPFSKYPPMKVLLMTIQNAPPGLDYDRDKKFSKSFKELVALCLVKDQTKRPTAEKLLKHSFFKNVKPPEICVKKLFVDLPPLWTRVKALQAKDAAQLALKGMASADQDAISQSEYQRGVSAWNFNIEDLKEQASLLDDDDILTESREEEESFGEQLHNKARQVSGSQLLSENMNGKEKASDTEVVEPICEEKSTLNSTTSSVEQPASSSEQDVPQAKGKPVRLQTHSGPLSSGVVLINSDSEKVHGYERSESERQLKSSVRRAPSFSGPLNLPNRASANSLSAPIKSSGGFRDSIDDKSKANVVQIKGRFSVTSENLDLARASPLRKSASVGNWILDSKMPTGQAIKESSSHLSFIIPQLQNLFQQNSMQQDLIMNLVNTLQQAAETTDGSQNGKLPPLPRGSDSNGTVVELTAAERERLLLTKITELRARMKELTEELEVEKSKQTQLQQKLKSVTGREQL

SEQ ID NO: 40119 - protein, 649 aa, Geobacillus stearothermophilus
MEKKTFYLTTPIYYPSDKLHIGHAYTTVAGDAMARYKRLRGYDVMYLTGTDEHGQKIQRKAQEKGVTPQQYVDDIVAGIQELWRKLDISYDDFIRTTQERHKKIVEKIFARLVEQGDIYLGEYEGWYCTPCESFYTERQLVDGNCPDCGRPVEKVKEESYFFRMSKYVDRLLQYYEENPDFIQPESRKNEMINNFIKPGLEDLAVSRTTFDWGIKVPGDPKHVIYVWIDALANYITALGYGTDNDEKFRKYWPADVHLVGKEIVRFHTIYWPIMLMALGLPLPKKVFGHGWLLMKDGKMSKSKGNVVDPVMIIDRYGLDALRYYLLREVPFGSDGVFTPEGFIERINYDLANDLGNLLHRTVAMIEKYFGGAIPPYRGPKTPFDRDLSETAREVVRQYEEAMERMEFSVALSAVWQLIGRTNKYIDETQPWVLAKEESKREELASVMAHLAESLRYTAVLLQPFLTRTPERIFTQLGISDRSLKEWDSLYDFGLIPEGTNVQKGEPLFPRLDIGVEVEYIKAHMQGGKPAEAAKEEKQAARAEEISIDDFAKVDLRVAEVVQPERMKNADKLLKLQLDLGGEKRQVISGIAEFYKPEELIGKKVICVANLKPAKLRGEWSEGMILAGGSGGGFSLATVDQHVPNGTKIK

SEQ ID NO: 40120 - protein, 377 aa, Malva pusilla
MADGEDIQPLVCDNGTGMVKAGFAGDDAPRAVFPSIVGRPRHTGVMVGMGQKDAYVGDEAQSKRGILTLKYPIEHGIVRNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 40121 - protein, 344 aa, Glycine max
MGPMLQTILTVLLLLMLLLIVIFLFFLFKPWRFFFSPRFLSSIKGELERPLFVGDEGDASSFNQCNELPRDYDLEGACYPSEAHFRSPRTHGQGLVHKQRLQTLNMPQPHAGDTLVVDVISDHSSEDLDVGQTLKLPSSHLAHIQKHALPNFQIDRLQDFVQRDISDQRSCLTLEVISGPSQGLRYSVQSTSPSRLPLTLGRVSPSDLLIKDSEVSGKHAMIKWNLDKMKWELVDMGSLNGTLLNSTPINHPDTGSRNWGDPMNLTNGDIITLGTTSKVMVHITSQTQHHIPFGVGMASDPMALHRGGKRFPMEDVYYYQWPLPGLDQFGIFGICDGHCPTVGL

SEQ ID NO: 40122 - protein, 395 aa, Blastopirellula marina DSM 3645
MAKKSIADVDVAGKTVLMRVDFNVPLDDAGKVTDARRVEMALPSIKSVIDRGGRVILMSHLGRPEPGADNSKYSLKPAAEALAGLLSKPVAFATDTVGSDAVAKAGALTDGDVLVLENLRFEKGEKKGDAEFAGKLAALADIYCNDAFGTCHRTDASMVAVPEAMGDKPKVVGYLVDKEIKYLTDAIKSPQRPFVAILGGAKVSDKIMVIKNLLGICDKVLIGGAMAYTFSLAEGGKVGGSLVEKDKVDLAKELIAAGGDKLVLPVDTHCGDDFKSSCNKVVVKAGEIPDGFEGLDIGPETAKMYAELVKNAKTVVWNGPMGVFEMPPFDEGTKAVAQAIADSDSISIIGGGDSAAAVAQLGFADQVSHVSTGGGASLAMLEGQKFAAVELLDEK

SEQ ID NO: 40123 - protein, 478 aa, Vitreoscilla sp. C1
MYKKSTIRIFATTSHKMNIDKEINMTNTTLNATANHLHPFSDNQQLKEKGVRVITKADGIYIYDDAGNKIIDGMAGLWCVNIGYGRKELADIARDQMNELAYYNTFFKTSHPAVINLSAKLASIAPAGFNHVFYTGSGSESVDSMIRMVRHYWDSVGKPSKKTLIGRWNGYHGSTIGGVSMGGMKGMHKQGGFPIEGIVHIEQPWFYGLHEEGETAEQFGIRAANWLEEKILEIGADNVAAFVGEPIQGAGGVIIPPSTYWPRIQEICQKYDILLVADEVICGFGRTGEWFGHETFGFQPDIFTTAKGLSSGYLPIGAVFVGDKVVEGILKGGDFNHGFTYAGHPVAAAVALKNVEILDDEGIIKNVHDKTGPYMQAKWREMLSQFKYVDDVRGVGLIQGFTLVKNKATREMFPNEGETGTMLRDIFFSNNLIMRACGDHIVASPPLTITKEEIDLMLATAEKCLQEFETAMDSKLGA

SEQ ID NO: 40124 - protein, 764 aa, Legionella pneumophila str. Lens
MLKILKRIVQDVTAASDLKEALGILVQRIDTAINAEAVSVYLIDNKNAEYVLIATEGLNKQAEFRVRIALDCGLIGLIGRREEPINIENAPSHPDFYHNPLIGEDHLNAFLGVPIIQHRKLYGVLVVQQLEQRHFDDAEESFLITLAAQLGGIIAHAEATGELAELTQPKKGIGVDKVEAAYTALTGIGSVPGIGIGTAVVVYPPADIDAVPRNPVEELEDEINAFYEALETTRDDIRRLSKRMKETVAEEEHALFDVYLRILDRDSLGAEVEHVIREEKISAQAALATVIKKHVQQFESMGDDYLRERASDFRDLGRRVLAELQRTQREEIVYPKRTILIGEEITAAALAEVPEGQLAGVVSAKGSNNSHVAILARALGVPTVMGLRGLKVELVSRRALIVDGYYGHVYISPSKSLLAEFKQLAQEEQELNQSLVSLRDKPAETTDNYRVSLQVNTGLAMDAGLSMSVGAEGVGLYRSEVPFMSRDRFPSEDEQTIIYRQTLKAFAPRLVTMRTLDIGGDKILPYFPVEEENPYLGWRGIRITLDHPDVFLIQVRAMMRASEELDNLRIMLPMVTTLSEVEEAVYLIEQAFDELVEEGCEIVKPKIGVMIEVPAAAYLAREMAKRVDFISVGSNDLTQYLLAVDRNNARVAALYDPLHPAMLRTLLKIVEGGHAAGVEVSICGEMASDPLAVILLIAMGFDTLSMNSASLPRVKWVIRNFAIANARKILAEVLEFEHPAEIRFHLQKALEEEGLGGLIRAGKS

SEQ ID NO: 40125 - protein, 750 aa, Oryza sativa (japonica cultivar-group)
MASSSNPSNLPCSSDGVCMLCKVLTTEVEQLRCSTCATPWHTPCLSSIPPLTDVAHWVCPDCSGDVTASYPPSDVVRPESSLIAAIRVIEADPVLSIQEKARRRQELLGHAGDAGAAITEAVGENVEDSESNNPLSMLNKNINCSFCMLLPERPVTTPCGHNFCLKCFRRWIENGKRACVICRAPITQKVAQDLRINLALVQAIRMAKAANNASTTGETTVYHYKENEDKPDRAFTTERAKRAGMANASSGQIFVTIAPDYFGPILEDHDPRRNRGVRVGDHWKDRMEGRQWGAHFPHIAGIAGQSTHGAQSVALSGGYLDDEDHGEWFLYTGSGGRDLSGNKRTSKEQSFDQKFEKLNAALRVSCLNGYPVRVVRSFKEKRSPYAPESGVRYDGIYRIEKCWRKTGVQGTFKVCSDEHGDHPRPLPDIEELKNAIDITERKGNPAWDFDATDGWKWMITPPISRKAVVTGDPRGKKMQGAARHTNNLSMRERLLKEFRCSICRNVMEEPVTTPCAHNFCKKCLLGSYDNLSLTEERSRGGRTLRARKIVKKCPSCPSDIADFVQNPQVNRDIMNVIESLQKEAEKEDHARVSGEGSSAALVDSDDENDTAWENQDDGNLDEGGCNNPEDMITESVDLNSVTNVDNTENKVEVQQPHKRTAGAGKGKGGKWARTSSAPGDADARNVVTSTETLDGIAAENVADLVQIEDCTFTGVERADPNALEVDGKNMIPDFSEAEKVNPKQDQEVLP

SEQ ID NO: 40126 - protein, 390 aa, Thiobacillus denitrificans ATCC 25259
MQSGLLDLPWWGLVLVTLGLTHVTIAAVTIYLHRSQAHRSVDLHPVVSHFFRFWLWLTSGMVTREWVSIHRKHHAKCETPEDPHSPQTRGLKKVFWEGSELYRAEAKVAETLEKYSHGTPDDWVERNVYSRHSAKGIFLMMAIDLALFGPIGLTIWAVQMAWIPITAAGIINGVGHYWGYRNFACEDASTNILPWGILIGGEELHNNHHAYGTSARLSNKWYEFDIGWLYIKLMSYAGLATVRKVAPTVKWQAPKPLCDLDTLQAIITHRYDVMSRFVKSVRAESAAEIAKLRAGANLPQNWNFDSFRRWLHKEPAELAADDRAALDTLLGRSERLQTVYRMRQELAAIWGRSTASREQLLEQLQAWCKRAEESGIQSLRDFSVRLRCYA

SEQ ID NO: 40127 - protein, 115 aa, Streptococcus thermophilus LMG 18311
MNPLIQSLTEGQLRTDIPSFRPGDTVRVHAKVVEGTRERIQIFEGVVISRKGQGISEMYTVRKISSGIGVERTFPIHTPRVDKIEVVRYGKVRRAKLYYLRALQGKAARIKEIRK

SEQ ID NO: 40128 - protein, 412 aa, Erythrobacter sp. NAP1
MAMPKAGRSWEDVREEMIARGAGDAKWRDGKTAVYVFNAGPEIGEVQHEAYTLFMSENGLGPLAFPSLAQMEREVVEMALSVLHGPEGATGAITSGGTDSITMAMKAARDYARAEKGLSGPANIVLPQSAHPAFDKAAHLMDIEVRRVPLKVDGSYEADPAAMGEACDQSTIMMVGSAPNFPHGIIDPIEALGQVAEAKGVWLHTDACVGGYFAPFARMNGVPVPPFDFEVTGVHSMSADLHKYGYAAKGASTVLFRSKALFEHMPFDTKNWNGAPMKTPTLAGTRPGGAISAAWAVMNVLGIEGYREKQGLVCETRERAEKGLAQLRFEVLGKPMLGLIAFRHPEHDSFALYSEMYRKGWFTSITIDPPSLHLMLSPKHAEVIDQYLDDLREACETVEAGKEGAKVEARYN

SEQ ID NO: 40129 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKESQ

SEQ ID NO: 40130 - protein, 204 aa, Plantago major
PVLSMSPSFAKQPLPTKSGSCGNVVRNAELKVIDPDTGCSLPRNQPGEICIRGPQIMKGYLNDAEATARTIDVDGWLHTGDIGFVDDDDDVFIVDRVKELIKFKGFQVPPAELEALLVSHPNIADAAVVPKIDEAAGEVPVAFVVRSNGFELTEEAVKDFIAKQVVFYKRLHSVYFVHAIPKSPAGKILRKDLRAKLASAAAHS

SEQ ID NO: 40131 - protein, 256 aa, Saccharum hybrid cultivar CP65-357
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGADEGKEASKGDAGEGQ

SEQ ID NO: 40132 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGIDGVKNKIDPGEAMDINLFKLTLDEIREKGIKQMPHTLRRSLEEMLADKQYLKEGQ

SEQ ID NO: 40133 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSTRFEFRFPDSSSNPYLAFAAILMAGMDGVKNKMDPSEAMDINLFKLTLDEIREKGIKQMPHTLRRSLEEMLADKQYLKEGQ

SEQ ID NO: 40134 - protein, 509 aa, Solanum tuberosum
MALTLSFSLPLPSLHQQFPSKYSTFRPIIVSLSEKPTIVVTQPTKLPTRTIPGDYGLPGIGPWKDRLDYFYNQGKDEFFESRVVKYKSTIFRTNMPPGPFISSNPKVIVLLDGKSFPVLFDVSKVEKKDLFTGTYMPSTELTGGYRVLSYLDPSEPNHEKLKKLMFFLLSSRRDHVIPKFHETYTEFFETLDKEMAEKGTAGLNSGNDQAAFNFLARSLFGVNPVETKLGTDGPTLIGKWVLLQLHPVLTLGLPKFLDDLILHTFRLPPFLVKKDYQRLYDFFYTNSASLFAEAEKLGISKEEACHNLLFATCFNSFGGMKIFFPNMLKSIAKAGVEVHTRLANEIRSEVKSAGGKITMSAMEKMPLMKSVVYEALRVDPPVASQYGRAKQDLKIESHDAVFEVKKGEMLFGYQPFATKDPKIFDRPEEFVADRFVGEGEKLLKYVLWSNGPETESPTVGNKQCAGKDFVVMVSRLFVTEFFLRYDTFNVDVGKSALGASITITSLKKA

SEQ ID NO: 40135 - protein, 170 aa, Helicobacter pylori
GSGMHTHVSVWKNNENLFSGETYKGLSELALHFLGGVLCHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 40136 - protein, 504 aa, Oryza sativa (japonica cultivar-group)
LPRHPRLLKASPRVAPRRTTPPSPSPPRPTPPPRDLAMAALLHLQSSATAAAAPSFLLLRRRGGGVTAPAGSSRRRRACFRVEAKIREIFMPALSSTMTEGKIVSWTASEGDRLAKGDPVVVVESDKADMDVETFHDGFLAAVLVPAGESAPVGSAIALLAESEDEIPAAQSKAASLSSSSSSSPPPPPPQESTPPPPPPPPPAPVAAAVSAPAPPSPASQGGLRVVASPYARKLAKDLNVDLNSITGSGPGGRIVAKDVEAAAAAPKKAAPVAAARPDVPLGSTVPFTTMQGAVSKNMVESLAVPTFRVGYTFTTDALDALYKKIKPKGVTMSALLAKATAMALVQHPVINSSCRDGKSFTYNSSINIAVAVAIDGGLITPVLPDADKLDIYSLSRKWKELVDKARAKQLQPHEYNSGTFTISNLGMFGVDRFDAILPPGTGAIMAVGSSQPTLVGTKDGSIGIKNQMQVNVTADHRVIYGADLAAFLQTLSKIIEDPKDLTF

SEQ ID NO: 40137 - protein, 179 aa, Cryptococcus neoformans var. neoformans JEC21
MFSLRPLFRSSQLTTAARRTLHYTAPALNTSTRPESPVTPVPTVQDGTVPTEYELANGPQADLVSGAPAELLHRPVRIFRPTKNTMQSAKGKTKRWIIDFDVLQGAGRWENRLMGWASSADYVQGTTLAFRSKEDAIYFAEKQGWPYKVDEPKKIEIPPKSYANNYVHVPGKLRIHHTK

SEQ ID NO: 40138 - protein, 205 aa, Haemophilus influenzae Rd KW20
MSEIKLNYHKTHFLTSAPNIRSIPEDTGIEIAFAGRSNAGKSTALNALTNQKNLARTSKTPGRTQLINLFEVEPNCKLVDLPGYGYAAVPEQMKIQWQKSLGEYLQKRECLAGLVVLMDIRHPLKDLDQQMIEWAVSANLPVLLLLTKADKLSQSARSKQVKMVREAILPFQGDIQVEAFSAQNKIGIDKLAVKLDFWFSPLFAE

SEQ ID NO: 40139 - protein, 355 aa, Solibacter usitatus Ellin6076
MSIQTRTTKTVLAGILIATGVLSIVLSAQSRGSANRSAVAPRQEFVKRAVDEAYAKFRSDTTGKNADYIPYLAQVDSKLFGVSVVTTDNESYSVGDTSYAFSIQSISKVFTLALAMKELGAAKVFERIGSEPTGRAFNSVIAVVDMPSHTGNPLVNAGAIATTSLISGAGAAEKWSKILEFYGKAAGEKLSLIDEVYKSEAATNQGNRALAALLVKYERIYSDPLEAVDIYTKACSVGANTKQLAQMGATLANNGRNPVTGEQVIREEDIPHILSAMTMAGLYDGSGGWAWHVGLPAKSGVGGAILAIAPGKGAIAVFAPRLDEAGNSVKAQKVITYVADKLDYNLFSPKSVGLK

SEQ ID NO: 40140 - protein, 291 aa, Clostridium acetobutylicum ATCC 824
MEKFRTIAITGATSGLGKLVAIELVKRDAHLILTARNKERAEATKKMLESINPKAKIDFFFGDLSVMRDVKRVGEEIKAVHPRIDVLVNNAGLHAFEQRVTSDGLAEMMAVNYLAPWLLTNTLLQSLIASRNARIVNVASEASRNHGELKLPGDLTDISEFTSRESSAIYGKTKLLNIMFTAELARRLSGTGIIVNALNPGFNVTGLGRELWFATALERILKFFHIGDPRKGADIILRLSIDAQYNSVTGGYFNVITGNPISPIYPGGDKVMQNKLWSDTETLLKQRGFIE

SEQ ID NO: 40141 - protein, 283 aa, Solibacter usitatus Ellin6076
MEIEFAPVVKREGINWITVTAFAVFHLGAVAALFFFSWPAFFAAVFLYWASLSLGIGMGYHRLLTHRSYQVPKWLEHSLAVCGALALEGGPIFWVATHRVHHQFSDKHGDPHTPRDGKWWSHITWMMVGDVTHCDSVACAKYAPDMAADPFYVWLSNYHWIPLTVVGIALLAIGGLPFLLWGVFFRVTLGLHATWMVNSLTHLWGARRFDTRDDSRNNWFVAALSFGEGWHNNHHAHPTSARHGLAWYEVDISWMTIRLLQALGFAKGVKVAKIGPVRERKVA

SEQ ID NO: 40142 - protein, 474 aa, Stevia rebaudiana
MSTSELVFIPSPGAGHLPPTVELAKLLLHRDQRLSVTIIVMNLWLGPKHNTEARPCVPSLRFVDIPCDESTMALISPNTFISAFVEHHKPRVRDIVRGIIESDSVRLAGFVLDMFCMPMSDVANEFGVPSYNYFTSGAATLGLMFHLQWKRDHEGYDATELKNSDTELSVPSYVNPVPAKVLPEVVLDKEGGSKMFLDLAERIRESKGIIVNSCQAIERHALEYLSSNNNGIPPVFPVGPILNLENKKDDAKTDEIMRWLNEQPESSVVFLCFGSMGSFNEKQVKEIAVAIERSGHRFLWSLRRPTPKEKIEFPKEYENLEEVLPEGFLKRTSSIGKVIGWAPQMAVLSHPSVGGFVSHCGWNSTLESMWCGVPMAAWPLYAEQTLNAFLLVVELGLAAEIRMDYRTDTKAGYDGGMEVTVEEIEDGIRKLMSDGEIRNKVKDVKEKSRAAVVEGGSSYASIGKFIEHVSNVTI

SEQ ID NO: 40143 - protein, 474 aa, Aspergillus nidulans FGSC A4
MWSPFLEVAKALREGHVVEFITQKYNEYGWTFEQNVLGRSGISTIEPENLKALLATQFNDFCLGTREREFGPLLGQGIFTLDGAGWSHSRALLRPQFTRDQVADLDLMESHISRLIELVPKDGSAFDIQRLFFLMTLDSSTHFLFGESVHCMDEGNVLARSTVNNAQGFANAFNTALDYLNWRSVAGNFYWMITSKEFRDANKRVHEVVDYYVHQAIEAKRHPEKKEPGRYIFAEALAADNDNPKVLRDNMLNILLAGRDTTASLLSSAFFYLSRHPAVWEKLRRVIIEEFGDVQNPKGEITHAKLKDLPYLRYVLNEVLRLQPPVPLNLRVAVKDTSLPVGGGPDGKSPVFVEKDQPVLYSVYAMHRRKDLWGPDADSFRPERWEENAKHGWEYLPFNGGPRICLGQQYALTEASYTMVRLMQRFSKVENGEPGLDEPLIRATLTMSHENGVKVRFKLQHVRRKPSPLQTCTR

SEQ ID NO: 40144 - protein, 615 aa, Botryotinia fuckeliana
MSDFPTKEVVNHEDVSSSHYDTQAKMSEEDVSDVGNEKGAAQARPSHIGRKVSEWEALQIAAAGDMETIDNEVQDLEAEVTSRGKSRSDIFQLSFKDPRHYTWLLVAFASMGGLLSGIDQSLISGANLYMPSSLGLNTKQVSLVSSGVPLGAVGGALMLGPLNEAVGRKQAIVWSLFLYTVGAALEAGAVNFGMMMAGRVILGLGVGLEGGTVPVYVAESVAPKYRGNLVSLYQFMIALGEVLGYVVAAIFVGVKSGGWRYMLGSSLVFSTIMLVGILFMPESPRFLMHKGRTADAWGVWKRIRGTDEAARKEFFVMKHSVDSEREMEGARKRFAWLDFITVPRARRAIVYANVMIFLGQFTGINAIQYYMATLMQQVGFNDKEAVFMSLVGGGALLIGTIPAILYMEKFGRRFWAIAMLPGFFIGLVIIGCSYLIPLTNKAGSQGTYITGLILYEGFFGSYACLTWVIPSEVYPTYLRSYGMETSDTMLFLCSFLVTYFFAEMQKAMSNIGLTLGFYGGIAVVGWFYQVLFMPETKNKTLEEIDVIFSQPTGQLVKENLRSSMVTASDFIHGRWGKVFSPVSESDIFRKENGHKSDEGGMGDAKHEELMQPESM

SEQ ID NO: 40145 - protein, 526 aa, Chlamydophila pneumoniae J138
MERKRFIDCDSTKILQELALNPLDLTAPGVLSAERIKKFSLLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIVQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGFCWGINSFDQEGVSLGKALANRVLELLEGADASNFPEAASLLTLFNIKFR

SEQ ID NO: 40146 - protein, 511 aa, Alcaligenes faecalis
MGEEMKTESKKPDSARSELAMKYFQAEYGHFINGEWVGGSSSEKIAMINPANLEVLSYIQSGNAEDVNRAVEAATQAFPKWSRSTPSERQAALYEMARRLRARANDYAAMLSLDNGKPIMEALHIDIPATIGQFELFAGAAFGLHGQTIDATQGVAIIHREPLGVVAQIIPWNVPLVMMATKIAPALAAGNTIVLKPAESVCLAVMEFIREMADLLPPGVLNVITGYGPNVGEALVTHPNVRKVAFTGSRPTAQKLMQYASVNVIPQTLELGGKSANIICADADMDAAAESAAMSIVVNKGEICFAATRHFVHESVMDAFVEKVQNILRKIRVGDPMIPSTQMGPQASRMQFDKVLGYLDIGRNEGATTAMGGKRATVSGFEQGYFIEPTLFTDVRNKMRIAQEEIFGPVGVVIPWKDEAQVIREANDTEFGLAAGLWTKNITQAHRMAREIEAGTVWVNRYFNMIPNVPFGGYKQSGFGREFSLDVLSHYTQLKSVIVSLQEGPIGLFDH

SEQ ID NO: 40147 - protein, 238 aa, Burkholderia thailandensis E264
MTIEVGLLLFPQVQQLDLTGPHDVFASLPGVTVRLVWKTREPVAASSGLVLVPNATFDDCPPLDVICVPGGAGVADLMEDAGTLAFIRRHAAHARYVSSVCTGALVLGAAGLLRGRRATTHWAFHSLLAPLGATPVRERVVRDGNLVTGGGVTAGIDFALTLAAELVGEDDAQAVQLQLEYAPAPPFAAGDPDTAPARIVERVRERSKPVLARREQVVARVAAALAQPRADGGCGRAC

SEQ ID NO: 40148 - protein, 197 aa, Triticum aestivum
  misc_feature (54)..(54): Xaa can be any naturally occurring amino acid
  misc_feature (73)..(73): Xaa can be any naturally occurring amino acid
  misc_feature (83)..(83): Xaa can be any naturally occurring amino acid
  misc_feature (117)..(117): Xaa can be any naturally occurring amino acid
  misc_feature (140)..(140): Xaa can be any naturally occurring amino acid
  misc_feature (143)..(143): Xaa can be any naturally occurring amino acid
  misc_feature (153)..(153): Xaa can be any naturally occurring amino acid
  unsure (1)..(197): unsure at all Xaa locations
MAPTVMASSATSVAPFQGLKSTAGLPVSRRSNGASLGSVSNGGRIRCMQVWPIXEGIKNSETLSYLPPLNTEXLLKQVDYLIXRSKWVPCLQFNKVGLSSRLSTTHPLGYYDGRYWXTMWKAAYVWGCTDPPSVNKVEEXKKXIPDAYFRIIXSTNRKAQIAHGRSGKAKNITRHIKAGFRILGFLHYFCFQKKVSQ

SEQ ID NO: 40149 - protein, 327 aa, Bacillus subtilis
MTLFLHGTSRQNQHGHLEIGGVDALYLAEKYGTPLYVYDVALIRERAKSFKQAFISAGLKAQVAYASKAFSSVAMIQLAEEEGLSLDVVSGESYIRLLQQAFRQNASTFMETIRAGKNCGWRLSTASAALWWIISMKSSLLEDLCKETGHSIDVLLRITPGVEAHTHDYITTGQEDSKFGFDLHNGQTERAIEQVLQSEHIQLLGVHCHIGSQIFDTAGFVLAAEKIFKKLDEWRDSYSFVSKVLNLGGGFGIRYTEDDEPLHATEYVEKIIEAVKENASRYGFDIPEIWIEPGRSLVGDAGTTLYTVGSQKEVDKLYNRFIIRRAN

SEQ ID NO: 40150 - protein, 380 aa, Washingtonia robusta
MSSTAGKVIKCRAAVAWEAGKPLVIEEVEVAPPQAMEVRMKILYTALCHTDVFFWEAKGQNPLFPRILGHEAGGIVESVGEGVTDLAPGDHVLPVFTGECRECAHCLSEESNMCELLRINTDRGVMINDGKSRFSINGKPIYHFVGTSTFSEYTVVHSGCVAKINPLAPLNIVCILSCGISTGLGATLNVAKPTKGSTVAVFGLGAVGLAAAEGARLAGASRIIGVDLNPRRFHEAKKFGVNEFVNPKDYNKPVQEVIAEMTNGGVDRSIECVGNIDAMVSAFECVRDGWGVAVLVGVPHKDAMFKSHPVNFLNERTLKGTFFGNYKPRSDLPAVVEMYMNKELELEKFITHEVPFSEINKAFDYMASRGQLRCIIRMDG

SEQ ID NO: 40151 - protein, 380 aa, Bradyrhizobium japonicum USDA 110
MTERIQEFLRNRRSEGRDTEPCLVVDLEVVRDNYQTFSKALPDSRVFYAVKANPAPEVLALLASMGSCFDTATVAEIEMALAAGATPDRISFGNTIKKERDIARAFALGIRLFAVDCAAEVEKIARAAPGAKVFCRILYDCAGAEWPLSRKFGCDPEMAVDVLDVAKRLGLEPCGISFHVGSQQRKVKAWDRALAMASQVFRDCAERGINLSMVNMGGGFPTKYLKDVPPVVTYGRSIFRALRKHFGNQIPETIIEPGRGMVGNAGIIESEVVLISKKSDEDEVRWVYLDIGKFGGLAETMDESIRYAIRTAHDGADMTPCVLAGPTCDSADVLYEKNPYPLPVTLEIGDKVLIEGTGAYTSTYSSVAFNGIPPLKTYHI

SEQ ID NO: 40152 - protein, 306 aa, Washingtonia robusta
  misc_feature (10)..(10): Xaa can be any naturally occurring amino acid
  misc_feature (300)..(300): Xaa can be any naturally occurring amino acid
  unsure (1)..(306): unsure at all Xaa locations
IVESVGEGGXDLSPGDHVLPVFTGECKECAHCKREESNMCDLLRIDTERGVMISDGQSRFSINGKPIYHFVGTSTFSEYTVIHSGCVAKINPLAPLDKVCVLSCGISTGLGATLNVAKPPMGSTVAIFGLGAVGLAAAEGARIAGASRIIGVDRNPARFDEAKNFGITEFVNPKDYDRPVQEVLAEMTGGGVDRSIECTGNINAMISAFECVHDGWGVAVLVGVPHKEAEFKTHPINFLNERTLKGTFFGNYKPRTDLPLVVEKYMNKELELEKFITHSVPFSEINKAFDYMLKGDGLRXIIHMDG

SEQ ID NO: 40153 - protein, 295 aa, Haemophilus ducreyi 35000HP
MSVILGSDLVKRGMAQMQKGGVIMDVVNAEQARIAEAAGAVAVMALERVPSDIRAAGGVARMANPRIVKEVMEAVSIPVMAKARIGHITEARVLEAMGVDYIDESEVLTPADEEFHLLKSEYTVPFVCGCRDLGEALRRIGEGASMLRTKGEPGTGNIVEAVRHMRKVNSQVRKVVNMSTDELMTEAKILGAPFELLLQIKQLGKLPVVNFAAGGVATPADAALMMELGADGVFVGSGIFKAENPEKFARAIVQATTHYQDYDLIARLSEELGEPMRGLEISKLSVQDRMQERGW

SEQ ID NO: 40154 - protein, 489 aa, Bacillus cereus G9241
MPQDRKEEVQNDTYEEKEIMPDNPQYLPRRVQMELPPEFSINPLFARKGESVVPRFNMPDEGMLPETAYQIVHDEITLDGNARLNLAMFVSTWMEPTAERLYAKSFDKNMIDKDEYPQTAEIEERCVRILANLWHSPSPLTTMGVSTTGSSEACMLGGLALKRRWQNARKREGKSVDRPNIVFSSAVQVVWEKFANYWEVEPRYVKVSPEHSLLDPQGVIAAVDENTIGVVPILGETYTGRYEPVAAIAKALDDLQERTGLDIPMHVDAASGGFIAPFLQPDLVWDFQLPRVKSINVSGHKYGLVYPGLGWIIWREADDLPEDLIFRVSYLGGNMPTFALNFSRPGAQVLLQYYNYLRLGKRGYYDVQRASQKVALFLSKAIQKMEPFELLSNGSDIPVFAWRLKNGHTSNWNLYDLSRQLRVFGWQVPAYPLPPDLEAVTIMRVVVRNGFSVDLAHLFLRNLKQAVAFLDSLDGPMPHDTKCDNGFHH

SEQ ID NO: 40155 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKEGQ

SEQ ID NO: 40156 - protein, 433 aa, Campylobacter lari RM2100
MNKTQMKFAKEGIFTKQMQIVAQKEQVSEDFLLENIACGKIIIPANINHKALDPNGIGFGLRTKVNVNLGVSNDCADYSEEMQKVNLAHKFNIEAIMDLSNYGKTSRFRDELIATSKAMIGTVPVYDAVGFLEKDLKDIKAKDFLDVVYHHAKSGVDFMTIHAGINSRAARVFKECNRITNIVSRGGSVLYAWMQMNNAENPFFEYYDDLLAICKEFDVTLSLGDALRPGCTHDASDGAQIAELIELSLLTKRAWAQDVQVMIEGPGHMAINEIEANMQIEKRICNGAPFYVLGPLVTDIGAGYDHISGAIGGAVAAANGADMLCYVTPAEHLRLPNLEDVRDGIVATKIAAHAGDIAKLPKERKIDDEMSKARQDIDWEKMFKLAIDGEKAKKMFNERKPEELNSCSMCGKMCAMNTMNKILKGEDVSLIKE

SEQ ID NO: 40157 - protein, 542 aa, Prochlorococcus marinus str. NATL1A
MSGSNPAVSINKRKVAPVVLAILDGWGYREEIEHNAVRQASTPVIDALWHAYPHTLIEASGADVGLPDEQMGNSEVGHLTIGAGRIIQQELVRISNTVKENKLITNPALNQFSQSLKKGGGTLHIMGLCSDGGVHSHINHLCGLIEWAASKGLKSVSLHLFTDGRDTSAKSANKYINTIEAKIKSTGVGEISSLCGRYWAMDRDNRWERTSKAYELLTDPRFALSKLSAAESINKSYQEGITDEFIEPVRLSSSFLKDGDGVVFFNFRPDRARQLVKALKLKDFDGFERKNRADIDVLTFTQYESGLPVSVAFPPEPLNDLLGQVISDHGLNQYRTAETEKYPHVTYFLNGGIEKPLKGEVRHLVPSPRVATYDLQPEMSADELTDSCIKAIDSGIYSLVVINFANPDMVGHSGIMTAAIKANEKVDSCVGKLLNSIGKLGGSLLITADHGNSEMMIGPDGQPWTAHTTNPVPVILIEGEKRKLSGYGNDIKLRQSGGGLADLAPTLLHLLNLPKPKAMTGKTLIEPINLPKKPNLIPQPAY

SEQ ID NO: 40158 - protein, 764 aa, Oryza sativa
  misc_feature (457)..(457): Xaa can be any naturally occurring amino acid
  unsure (1)..(764): unsure at all Xaa locations
VLCAYMILGHPSVVFNERGEREKLLVESAENFVKEFELLIKTILDGSSGACILKQPILDDLSPGSSNYQESSAVVADRKKFRSQLASFDKAWCAYLYHFVVWKAKDAKSLEEDLVRAACKLELSMMQTCKFTAEGQPENLNDNLKAIQKEVMVDQTLLREKVRHLGGEAGIERMEVALSEARTKFFEAKGNRSPLATTIKNVAATCSSGESPISDMKENSNINDKRPSQAVQSMFRVPSSPSESNTAGITMSNPMTVSSTLSEKRPTENEQMVNEILHGFLADSSSNIGTVEGGFKEKVRETMEKAFWDVVVDSLRGDMPDYSYLVQLVKEVRDTLYEMVPKGWKEEIINNIDLEILLQVLESGTQDMQYLGQILQYSLGMLRKLSSPAKEDEMKRSHDKLLGELTEHSECNNSGSNSFVIAVIKGLRFTMEELKALKTEVSRARIQLLEPIIKGSXGGVEYLQKAFADRYGFPSNASVALRSTAQWISTSKDRNRYEWNEHVSSFSALPETDHAQPLVATLRSGHGVPDQRQSTIPVSDDTGLPECTGQRLDQLIRIGLLQLISGIEGVQMQSVTETFKLNWLRLRSVQSQFQQVIVIATSMLVQRQVLATDDPNITPTELESATSQLFNTLAELLDNFPDVSTAKIMEVMLRSSSSSSSGSTTGSPSDERTESRKQILARVFLKSLQTDDPVFKKVSRSVDCAFRAITLGGSGARGRKLADAALRRIGATKLTDRVVRSAEILIRAASISQQVHGPWYNHLV

SEQ ID NO: 40159 - protein, 398 aa, Burkholderia sp. 383
MHDATQRFDVIVVGGGPMGLATAYHLGKRKARTLVLEQFTFVNQLGSSAGVSRQFRIPYPDAYMVKLVKQSIPYWDELQSLTPVPLMDTVGTLWFGDPSVKSTEGNIPAAEQELKAEGVAYETLDAHELEKRFHFRNLPSTYTGLFQAQGASIDLAATQRTLLDWNERSPFVQLLQEAPVIGIERRQGLFEVKTPLGTFSAEKLVLTPGPYADDVFRLLGFRIAATYWNMASAYYRKTRPDIQYPTWFVFQNPVGDNGNQFYGFPEVAWNYPGYIRVASDFVLAPLTSPDQRTPIPNPQELAFTAEWVGEHMEGLEPVPRFTSTCLVALSKIANKELLIDFAPDYVPNHRDIVIYATGWAGKFVPLLGEILCQLTLDGHTPFDISHFSTGSRYFNKLA

SEQ ID NO: 40160 - protein, 317 aa, Haemophilus influenzae Rd KW20
MTTQLDSLRNMTVVVADTGDIDAIKKYQPQDATTNPSLILSASALPQYAPLIDEAVAYAKAQSADKAQQLIDAEDKLAVNIGLEILKIVPGRISTEVDARLSYDTQATVEKARKLIALYNAAGISNDRILIKIASTWQGIRAAEILEKEGINCNLTLLFSEAQARACAEAGVYLISPFVGRILDWYKANSDKKEYAPAEDPGVISVTKIYNYYKEYGYNTVVMGASFRNVGEITELAGCDRLTIAPALLKELQENSTALVRKLEYKGEVKAKPQPLTEAEFYWQHNSDAMAVEKLAEGIRKFAIDQEKLETMLSAKL

SEQ ID NO: 40161 - protein, 406 aa, Brucella suis 1330
MSEEFHKIRRLPPYVFEQVNRLKASARAAGADIIDLGMGNPDLPTPQNIVDKLCEAVQDPRAHRYSASKGIPGLRRAQAQYYARRFGVKLNPDTQVVATLGSKEGFANMAQAITAPGDVVLCPDPTYPIHSFGFIMSGGVIRSVQAKPDDNFIPTLERGVKHSIPKPIALILNFPSNPTAYVATLDFYKDVVAFARKHDIVILSDLAYSEIYFDGNPPPSVLEVPGAMDVTVEFTSMSKTFSMPGWRMGFAVGNERLIAALTRVKSYLDYGAFTPIQVAATAALNGDGSDIAYVRNVYKQRRDVLVESFGRAGWDVPPPAATMFAWVPIPERFRSLGSLEFSKLLVEQADVAVAPGVGFGEHGDDYVRIALVENEHRIRQAARNIKRFFSAKDENLQNVIPLEGHR

SEQ ID NO: 40162 - protein, 370 aa, Scherffelia dubia
MFGKAVTARPACAPCAPAPSPCAPGKFDEELIKTAKHIASPGKGILAMDESNATCGKRLDSIGVGNTEENRRTYRELLLTAPGLGNYISGAILFEETLYQKASNGKSFVDVMRSTGIAPGIKVDKGLVPCGTATTSWCTGLDGLAGAAEYYKQGARFAKWRSTVAVGAGPSIIHARHAYGLARYAAICQDNGLVPIVKPEILLDGDHTIDETLDVAKATWAETFKYMADNKVMFEGILLKPSMVTPGAECKVRADPQTVASYTLGLSQPRAPPVPGIMFLSGGQSELEASLNLNAMNQSPNPWHVSFSYARALQNTVLKTWKGEPGNVKAAQEALIVRAAANSAAQMGKYDPAKEAESAKAGMFEKGYVY

SEQ ID NO: 40163 - protein, 411 aa, Pseudomonas aeruginosa UCBPP-PA14
MAESRPARRFARIDRLPPYVFNITAELKMAARRRGEDIIDLSMGNPDGPTPPHIVEKLCTVAQREDTHGYSTSRGIPRLRRAISHWYRDRYDVQIDPESEAIVTIGSKEGLAHLMLATLDHGDTILVPNPSYPIHIYGAVIAGAQVRSVPLVPGIDFFNELERAIRESIPKPRMMILGFPSNPTAQCVELDFFERVVALAKQYDVMVVHDLAYADIVYDGWKAPSIMQVPGAKDIAVEFFTLSKSYNMAGWRIGFMVGNPELVSALARIKSYHDYGTFTPLQVAAIAALEGDQQCVRDIARQYQQRRDVLVKGLREAGWMVENPKASMYVWAKIPEPYAHLGSLEFAKKLLQDAKVSVSPGIGFGDYGDDHVRFALIENRDRLRQAVRGIKSMFRADGLLSPQRKVDSLAE

SEQ ID NO: 40164 - protein, 188 aa, Cenchrus ciliaris
MESAAPPAAAKPSLSKKPSPSFRLRNGSLNALRLRRVFDLFDRNGDGEITLDEMASALDTLGLGADRSGLEAAVGSYIPAGAAGLRFEDFESLHRALGDALFGPIPEEVPEEDDEGDMKEAFRVFDEDGDGYISAAELQAVLKKLGLPEARNLATVQEMICNVDADRDGRVDFGEFKNMMQGITVWGA

SEQ ID NO: 40165 - protein, 390 aa, Pseudomonas aeruginosa UCBPP-PA14
MATSYSARSRAIEPFHVMALLARANELQAAGHDVIHLEIGEPDFTTAEPIVEAGRAALAAGHTRYTAARGLPALREAIAKFYGERYGVDLDPQRVLVTPGGSGALLLASSLLVDPGRHWLLADPGYPCNRHFLRLVEGAAQLVPVGPDSRYQLTPDLIERHWDSDSVGALVATPANPTGTLLDRDELAGLSGALKARGGHLVVDEIYHGLTYGVDAASVLEVDDDAFVLNSFSKYFGMTGWRLGWLVAPAAAVPELEKLAQNLYISAPSMAQQAALACFEPTTIAILEERREEFARRRDFLLPALRELGFGIAVEPEGAFYLYADISAFGGDAYAFCKHFIETEHVAFTPGLDFGRHQAGHHVRFAYTQNLSRLQEAVERIARGLKNWRP

SEQ ID NO: 40166 - protein, 432 aa, Prochlorococcus marinus str. MIT 9313
MASSDDAKLRPLPNTAALSGVLEAFAFFRDPAFAQKRFERHGNVFETSLLGQPMVFIQGGQAIRDLLAQPNAVEGWWPESVRQLLGSHSLANRNGASHRARRRVIGQLFSASALQRYSAGIISMVQDLADELQAAKTALPLAERMRRFAFSVIATTVLGLEGTDRDELFVDFEIWTRALFSIPIALPGSSFAKALKARERLLRRLQKVLLKASNGNGGLDLLAGGLDEAGIPLTDEDMVEQLLLLLFAGYETTASSLSCLMRELLLNPQVETWLREEINGVDWPPAPEQATTAYDQVNAPKLDAVVSEVMRLTPAVGGFFRRTKCALVIDGVEVPKNRVVQVALAASNRHGAGDLEAFRPQRHLEDGCSATLLPFGGGERVCLGKPLAELEIRLMVVGLFHQLRLHLIPDQDLTLQMLPSPTPRDGLLTKVL

SEQ ID NO: 40167 - protein, 246 aa, Mesembryanthemum crystallinum
EFLARRKKISRAQTETQILRMLDHPFLPTLYCQFTSDNLSCLVMEYCPGGDLHVLRQRQPGRCFTEQAARFYLAEVLLALEYLHMLGVVYRDLKPENILVREDSHIMLSDFDLSLRCAVSPTLLVSSSMSATSKKMSGPCVDSRCVQPLCIQPSCQVTCFTPRLLASSSKLRKMKSDLEMKPLLQLVAEHTDAMLTNSFVGTHEYLAPEIYKGEGHGSAVDWWTFGISSTSFYMENSPLKEGNDRT

SEQ ID NO: 40168 - protein, 418 aa, Rhodococcus sp. CIR2
MQEPTARPVGPYASGPPPAALTVHSASLDHFRAARLWRALVIGVVVVAYTLFALVTWPVRRRGRTLADAASEGLVNGFEVLGPTFVKVGQLMASSSGVFPAPLANACLRCLDDVPPVPAEEARRVIEADLGHPVDALFASFDDVPLAAASVAQVHGCVLPDGREAVIKVQRPDIFRRMVVDLRTAYWGARIPTLIRLDQRQQRRHQLRIQRVRTLAAPTRTADPTRRRRLLAGLQLEHAPANRGLADTDRPGHRPHPAMPQRPGLRRQRQTPLPLVQMRQQDLEPLPQPPVDLAHNRPTAPTRLKPQNTMLLPYSHSAFGSVATRPRAGWRRSPTRGRRARRRSPTAPRTNRGRPATGRTPTTRHHPRWRSRPGPGSLGSPRRSRRPRRARARSPPGAGPPGSATRWLSRRNPNWRRR

SEQ ID NO: 40169 - protein, 107 aa, Acinetobacter sp. ADP1
MISTHILDTHLGKPATQVDVRLYNAKTRDLIGQGVTDQDGRIKNFGREDLEAGAYLLEYDVAPYFSQKQLKTFFPQVLIQFAIENPAEHYHVPLLISPFAYSTYRGS

SEQ ID NO: 40170 - protein, 572 aa, Mesembryanthemum crystallinum
SFDGNGNTDDEDDFYDDDDDDGRPDSVDDKVRKKEMRKGIDLATTLERIEKNFVITDPRLPDNPIIFASDSFLELTEFSRAEILARNRRFLQGPETDPATVAKIRDAIDNETDVTVQLINYTKTGKKFWNVFHLQPMRDQKGEVQYFIGVQLDGSEHVEPVQNSIPVASVMDSEKQVKETATNVDVAVRELPDANKKPEDLWANHSKVVQPKPHRKECSSWKAIEKIKESGEQIGLKHFRPVKPLGAGDTGSVHLVELCGTGEYFAMKAMDKNVMLNRNKVHRACAEREILDMLDHPFLPALYASFQTNTHICLITEYCPGGELFLLLDRQPTKVLKEDAVRFYAAEVIIALEYLHCQGIIYRDLKPENILLQSNGHVSLTDFDLSCLTSCKPQLLIPEIRDKKKQQKAQHQQTPIFMAEPMRASNSFVGTEEYIAPEIIAGAGIQGAVDWWALGILLYEMLYGFTPFRGKTRQKTFSNVLRKDLKFPATKQVSLDASQLIYQLLQKDPKDRLGACEGANEIKRHPFFRGANWALVRCMKPPVLDAPPLLGDPEKEANIVDPDMLDLQTNVF

SEQ ID NO: 40171 - protein, 170 aa, Helicobacter pylori
GSGMHTHVSIWKNNENLFSGETYKGLSELALHFLGGVLHHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 40172 - protein, 437 aa, Alkaliphilus metalliredigenes QYMF
MEKKSSVYELEGVPPLKEAIPLGMQHVLAMFAGNITPIMVIAGALSISVQDRTFLIQASMFIAGVVTLLQLYFGAKLPIVMGTSSGFIGTSLAIGAKYGLAGILGASLIGGVFEGVLGFFIKPLRKFFPPLVTGTVVLTIGLSLIPIGVRSFGGGSGAADFGSLSNLFLGTVVLVTILMLKQFTKGFSSASAILIGIIVGYLIAIPMGKVDFGTVQGAGWFSFPTPLKFGLAFHWDAIVAMGVMYIVTAVETVGDISGITMGGLKRDATDKELSSGVIMDGIGSSLAALFGVLPNTSFSQNVGIVALTGVVNRFAIATGAIFLIIAGLFPKVGALISIMPSSVLGGAAIIMFSMITISGINLVTQEPLDGRNGIILATALALGLGMSSVPEILVNMPEGIRLLFGGSGIVIAATVALVLNIVFPKTSTPEKAKESAV

SEQ ID NO: 40173 - protein, 301 aa, Triticum aestivum
MALVVMCGQPCSGKSEAAACLAAALRSSVLDVTVRVIDESSLHLGRDESYKDMVVEKNLRGVLRSEVDRSVSRDGIIIVDSLNNIKGYRYELWCLARASGIRYCVFFCDTEVDHCRDWNVKRQEKGEPSYDSNIFEDLARRFERPDSRSRWDSPLFELFPSREEIVESSPVIAEAVSYLTKKVDSKTRDVKVLQPTIATQSVRTTEGNSLYEMDKATQEVVSAIVEAQSGGLGLAMNKISLGPDLPTINLRRPVGLPELRSLRRTFIKLAGQYSLSGRPPPTDADSAKRMFVDYLNREIGG

SEQ ID NO: 40174 - protein, 124 aa, Zea mays
  misc_feature (85)..(85): Xaa can be any naturally occurring amino acid
  unsure (1)..(124): unsure at all Xaa locations
MGGDLYALDFDGVLCDSCGESSLSAIKAAKVRWPSLFEQVDAAMEEWIVEQMYTLRPVVETGYENLLLVRLLVEIQIHSVRKSSXFYPGTADALKLSSSEAYIVTTKQSRFAEALLKELAGIDF

SEQ ID NO: 40175 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGH

SEQ ID NO: 40176 - protein, 153 aa, Streptococcus dysgalactiae subsp. equisimilis
PMAYTCLPSKCASIQKCQIGSIADRFVLSAGHGSMLLYALLHLSGFKDVTMEEIKNFRQWGSKTPGHPEFGHTTGVDATTGPLGQGISMATGFAQAERFLAAKYNREGYNIFDHYTYVICGDGDLMEGVSSEAASYAGLQKLDKLIVLYDSND

SEQ ID NO: 40177 - protein, 498 aa, delta proteobacterium MLMS-1
ADYRCRGGGVELIYFGQRVNGQVLEALGELAAQAGVLEQYDLMRQGAVLNQIAGYASENRQVLHCSNRDIFAESPRQPEATARTANELAKLREFLEDLEAGRLANPAGKPFEAMLQVGIGGSDLGPRALYLALRAYAKPGRQVRFISNVDPDDAAAVLQELDLSRTLVKVVSKSGTTLETLANEELVRRAYQDAGLDPKDFFIAVTGQGSPMDNPEHYLRSFYMFDYIGGRYSATSMVGLVMLGFALGYEQVLEILRGAYEMDEAATQPDPTRNPPLLLALLGIWNRNFLGSQDVAILPYSQALSRFAAHLQQLDMESNGKGVSRAGEPLGWDSGPVVWGEPGTNGQHAFYQLLHQGTAVVPIEFIGFKESQYRRDLTVKGTTAQEKLLANLLAQSLALAVGQEEENPNRRFPGNRPSSILLADRLTPATMGALLALYEAKVVFQGFLWNINSFDQEGVQLGKRLADGLLAQYEARRRGTTPPEDPLGRALLALAASE

SEQ ID NO: 40178 - protein, 468 aa, Medicago truncatula
MGKKGNWFSTVKKALSPDSKKSSKSKKKWFGKQKLQTSDPSVEIDTALPLPPPEDIKLTDIENQNNHHNVAEITTVVDVEEPVRSVQTAVVKTQAATVSRFAGKPKDEVAAIKIQTAFRGYLARRALRALRGLVRLKTLMEGPAVKRQAMSTLRSMQTLARVQSQIRSRRVRMLEENQALQRQLLQKHAKELETMRIGEEWDDSLQSKEQIEAKLLSKYEATMRRERALAYAFTHQQNSKNSSRSMNPMFVDPTNPTWGWSWIERWMAARPWESRGLVDKELNDHSSVKSSSRSIIGGEISKSFARFQLNSEIHSPVASQNPGSPSFQSNSTPTKPASASVARKLKKASPKGSWVMDDDSKSMASVQSDRFRRHSIAGSSVRDDESLASSPSVPSYMVPTQSAKARLRTQSQSPLAKENGKQEKGSFGTAKKRLSFPASPARPRRHSGPPKVETAINAELPVPNGVAS

SEQ ID NO: 40179 - protein, 371 aa, Blastopirellula marina DSM 3645
MTSRILPIFLLAFALLSVVSLAETPETVLTLPSGPNNPRNTEGGFVTLKDGKILYIYSRFSGVSGGDDAQGYLAACTSADGGQTWSENDAAIFPREGKENDMSASLLRLADGRIALFYLVKNSIKDCKMRMRTSSDEAETWSEPIDCMPGEENYFVVNNDRVIQTKSGRLIAPAAIHVRDGKWQGAADIVCFLSDDNGKTWRRSQQTVIGKRDDGSRFVTQEPGVIELKDGRILMWIRSNLGRQAVCYSSDGGETFSDPQPWNFKSPVSPASIKRIPSTGDLLLVWNDNVKRRTPLNVAISADEGATWTHAKSIETDPNGWFCYTAIHCVDDRVLLSYWLTEQLKHPLLIGTKIVSVPVKWLYEDETPAPK

SEQ ID NO: 40180 - protein, 315 aa, Cenchrus ciliaris
MACSTASLAANAPGVRPDVPGVPRREAAHRARAGAGHHHEVPQGRAPVGPHRRQLHLVRQLLRAAAGRHHRLRLVALRGPSGGGGTTGAVGRHLVQYGAQVLRQLQRARFPALHVGSHCPRTRPTPSASASRTGNLLKLAASGSPSHAINVVLTADDVAVDGFCMSRCGTHGASRRSRSGRFAYVWVGNPATQCPGQCAWPFHQPVYGPQAAPLTPPNGDVGADGMVISLASMIVGTVTNPFGNGFYQEGSADAPLEAATACAGVYGKGAYPGYAGSLLVDQASGASFNANGAHGRKYLVPALVDPDTSSCATLG

SEQ ID NO: 40181 - protein, 525 aa, Debaryomyces hansenii
GGLLFGYDTGVISGIVTMESFAAKFPRIYMDPDYKGWFVSTFLLCAWFGSLINSPIVDKFGRRDTIRIACVVFVIGSVFQCAGISVSMLFAGRAVAGIGVGQLTMVVPMYMSELAPPSVRGGLVVIQQLSITIGILISFWINYGTQFIGGTKCAPGRNYQGDVFDPYVDVPKQGCNGQQDASWRIPFGLQIAPAFLLGIGMTFFPRSPRWLLSKNREEEAWKSLHYLRRRNNPDMIEAEFNEIRSDVIFEKKYNEKRFPGKEGISLYVSSYWDLFSTKSNFKRVFIGSAVMFFQQFIGCNAIIYYAPTIFSQLGMDSNTTALLGTGVYGIVNCISTIPAIFAIDKFGRKTLLMAGAAGTFVSLVIVGAIVGKYGEKLSKHKVAGRAAIAFIFIYDFNFSYSWAPIGWVLPSEIFSIGMRSKAISITTSSTWMNNFIIGLITPRMLNTMKWGTYIFFAAFAIIAFVFTWYMIPETKGVPLEEMDFVFGDLDALEEKQRFSDTNAISKIHINTGTKVDSFKASTDFL

SEQ ID NO: 40182 - protein, 529 aa, Metroxylon sagu
MAATGISRIPLLKTLIPSTSPSPSSDRGSNDLPLCLKPSLNWRLSSSFHFSGEALFSKAVLGSGKTAAGGRTPVLVSPKAVSDSKSSQTCLDPDASRSVLGIILGGGAGTRLYPLTKKRAKPAVPLGANYRLIDIPVSNCLNSNISKIYVLTQFNSASLNRHLSRAYGSNMGGYKNEGFVEVLAAQQSPENPNWFQGTADAVRQYLWLFEEHNVMEFLVLAGDHLYRMDYERFIQAHRETDADITVAALPVDERRATAFGLMKIDEEGRIIEFSEKPKGEQLKAMKVDTTILGLDEERAKEMPYIASMGIYVISKDIMLQLLRDKFPGANDFGSEVIPGATNIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDSLLMGADYYETDQEKRFLAAKGSIPIGIGKNSHIKRAIIDKNARIGENVQIVNNDNVQEAARETDGYFIKSGIVTVIKDALIPSGTLI

SEQ ID NO: 40183 - protein, 170 aa, Metroxylon sagu
MGIYVFKTDVPLKLLRWHYPTANDFGSEIIPMAAKDYNVQAYLFDEYWEDIGTIKSFFDANLALTDQSPKFRFHDPKKPIFTSPRFLPPTKIEKCRVVDSIISHGCFLTQCSVEHSVIGIRSRLEHGVELKDTMMIGADYYQTGAERASLLAEGKVPVGVGENTKIRNCI

SEQ ID NO: 40184 - protein, 170 aa, Metroxylon sagu
MGVYVFKRDVLLKLLRWRYPKSNDFGSEILPSAVKERNVQAYLFNDYWEDIGTIKSFFDANLALTDQLPKFQFYDPRTPFFTSPRFLPPTKIKKCRILDAIISHGCFLRECSVQHSIVGVRSRLDYGADLKDTMMMGADSYETEAEIASLLAEGKVPIGVGQNTKISNCI

SEQ ID NO: 40185 - protein, 362 aa, Nostoc punctiforme PCC 73102
MTQNYRITLLPGDGIGPEIMAVAVDVLKVVGKQFDLKFEFQEALIGGAAIDATGEPLPSATLETCRNSDAVLLAAIGGYKWDSLPSNLRPEAGLLGLRAGLGLFANLRPAKILPQLIDASTLKREVVEGVDIMVVRELTGGIYFGKPKGIFATETGEKRGVNTMVYTESEIERIGRVAFEAARKRGGKLCSVDKANVLEVSQLWRDRITQLSQEYPDIELSHLYVDNAAMQLVRAPKQFDTIVTGNLFGDILSDAAAMLTGSIGMLPSASLGASGPGVFEPVHGSAPDIAGQDKANPLAQVLSAAMMLRYALDQPKAADRIEQAVFQVLEQGDRTGDIISPGKNLLGCRAMGDSLIKALEQK

SEQ ID NO: 40186 - protein, 170 aa, Metroxylon sagu
MGVYVFKRDVLLKLLRWRYPKCNDFGSEILPLAVKEHNVQAYLFNDYWEDIGTIKSFFDANLALTDQPPKFQFYDPKTPFFTSPRFLPPTKIEKCRILDAIISHGCFLRECSVQHSIIGVRSRLDYSAELKDTLMMGADYYETEAEIASLLSEGKVPIGVGQNTKISNCI

SEQ ID NO: 40187 - protein, 515 aa, Bacillus cereus G9241
MVVAYKHEPFTDFSVEANKLAFEEGLKKVESYLGQDYPLIIGGEKITTEDKIVSVNPANKEELVGRVSKASRELAEKAMQVADETFQTWRKSKPEMRADILFRAAAIVRRRKHEFSAILVKEAGKPWNEADADTAEAIDFMEYYGRQMLKLKDGIPVESRPIEYNRFSYIPLGVGVIISPWNFPFAIMAGMTTAALVSGNTVLLKPASTTPVVAAKFMEVLEEAGLPAGVVNFVPGNGSEVGDYLVDHPRTRFVSFTGSRDVGIRIYERAAKVNPGQIWLKRVIAEMGGKDTIVVDKEADLELAAKSIVASAFGFSGQKCSACSRAVIHEDVYDHVLNRAVELTKELTVANPAVLGTNMGPVNDQAAFDKVMSYVAIGKEEGRILAGGEGDDSKGWFIQPTIVADVAEDARLMKEEIFGPVVAFCKAKDFDHALAIANNTEYGLTGAVISNNRDHIEKAREDFHVGNLYFNRGCTGAIVGYQPFGGFNMSGTDSKAGGPDYLALHMQAKTTSETL

SEQ ID NO: 40188 - protein, 384 aa, Oryza sativa (japonica cultivar-group)
MEKALVLIVGAGPSGLATAACLGQLSIPYVIIEREDCTASLWRKHTYDRLKLHLAKEFCEMPHMPYPEDTPTYIPKIQFLRYMDDYVEHFNICPKFNSSVESCLYDDVQKYWVVTTHDQVNGMVSKYAARFLVVASGENSAGNIPSIPGLEDFSGHVIHSSSFRSADSYAAQRVLVVGCGNSGMEIAYDLSSHGANTSIVIRSPLHVMTKELIHMGMKLASWSLPVKFVDFILVVLAYLWFGNLSKYGIVRPNKGPLLLKANTGRSAVIDVGTVELIKKGDIKVFGTISCIKGNVVEFDDGKESYFDAIVFATGYTSTANNWLKNGEDMMNKEGMPKKDFPNHWKGSNGLYCVGFARRGLSGIAHDAKNVANDVKAFLDLMAPF

SEQ ID NO: 40189 - protein, 474 aa, Haemophilus ducreyi 35000HP
MSKEIKTQVVVLGAGPAGYSAAFRCADLGLETVIVERYSTLGGVCLNVGCIPSKALLHVAKVIEEAKHADKNGITFGEPIIDLDKVRKGKEAVVSKLTGGLAGMAKARKVTVVEGLAAFTDSHTLVARDRDGNPTTIKFDNAIIAGGSRPIELPFIPHEDPRIWNSTDALKLKEIPKKLLIMGGGIIGLEMGTVYQSLGSEIEVVEMFDQVIPAADKDVVSIYSKQVEKKFKLMLETKVTAVKAEDDGIYVSMEGKACNDTKRYDAVLVAIGRVPNGKLIDVGKAGVEVDERGFIHTDKQMRTNVPHIFAIGDVVGQPMLAHKGVHEGHVAAEVIAGKKRYFDPKVIPSIAYTEPEVAWVGKTEKECKQEGLNYEVAKFPWAASGRAIASECSEGMTKLIFDKDTHRLLGGAIVGSNGGELLGEIGLAIEMGCDAEDIALTIHAHPTLHESVGLAAEVFEGSITDLPNAKAKKR

SEQ ID NO: 40190 - protein, 323 aa, Deinococcus radiodurans R1
MVRPDFFLLGEPMPVDPNLYQLLLQLSQAPEPAGLEELRAGVIANAARSPKRPVTIGEVRDLSVAGAEGSLPARLYHPAGQAPASGWPLTVFFHGGGFVVYDLDTHDALCRELCATSGAAVLSVAYRLAPEARFPAPVDDALASVVWAAAHAAELGADAGRLAVAGDSAGANLATVTALRSRDEGGPALRAQLLIYPAADFEHPERYPSRQENGRGYFLTDERMRFFGQMYLARPEDAAHPHASPLNAESLAGLPPALVLTAEFDPLRDEGALRRSSQGRWRNAEYRPGPGMIHGYANMTAFSPVAAQLIDEAGVWLGEQLRG

SEQ ID NO: 40191 - protein, 282 aa, Kluyveromyces lactis NRRL Y-1140
MSDSPEYELTYKVGVAENNNSKFRKTMEDVHTYVENFASRLDWGYFAIFDGHVGSEASKWCGANLHRYLEQKILEDEARDLRDVLNDSFVHADNEINNALKGNSGCTAAVCVLRWEIPDTTVPSEDETINLQQHKRMLYTANVGDTRVVLFRNGNSIRLTYDHKASDILELQRVENAGGLIMKSRVNGMLAVTRSLGDKFFDSLVVANPFTTSVEITTSDQFLIIACDGLWDVIEDHEACEMIKDINNPNEAARVLVRYALENGTTDNVTVMVIFLDTSQEN

SEQ ID NO: 40192 - protein, 205 aa, Actinobacillus pleuropneumoniae serovar 1 str. 4074
MVNVLFLGVIMQISRRKFFKVCAGGMAGTSAAMLGFAPATALAAPREYKLLRAKETRQTCTYCSVGCGMLMYSLGDGAMNSRGKLFHVEGDPDHPVSRGALCPKGAGVLDYVNSPNRLQYPEYRAPGSDKWERISWHDAIHRIAKLMKEDRDANWQDVNEEGTVVNRWTTTGLLCGSATSNETSLVSQKWARALGLVVIDQVAST

SEQ ID NO: 40193 - protein, 297 aa, Actinobacillus pleuropneumoniae serovar 1 str. 4074
MIMATPLFHGSIVALVTPMTHGEVNYEELKKLVEYHVQAGTHGIVSVGTTGESTTLSIDENVKVIKKTVEFADGRIPIIAGTGSNATSEAIILTKLLTNSGVAGCLSVVPYYNKPTQEGMYLHYKAIAESTDLPQILYNVPSRTGSDLKPETIGRLAEIPNIVGVKEATGDLTRLPLIKKLAGEDFIFLSGDDATGLESMKLGGQGVISVTNNVAAADMAKMCELALAGKFDEAEAINQRLMALHHDLFIEANPIPVKWAAYKLGLISEPNLRLPLTTLSESAQPTVLAALQKAGLI

SEQ ID NO: 40194 - protein, 375 aa, Yarrowia lipolytica
MEDETVALVIDNGSGMCKAGFAGDDAPRAVFPSIVGRPRHQGVMVGMGQKDSYVGDEAQSKRGILTLRYPIEHGIVTNWDDMEKIWHHTFYNELRVAPEEHPVLLTEGPINPKSNREKMTQIFFETFNAPAFYVSIQAVLSLYASGRVTGIVLDSGDGVTHVVPIYSGFSLPHAIMRLDMAGRDLTDYLMKILSERGYSFTNSAEREIVRDIKEKLCYVALDFEQELQTASQSSSLEKSYELPDGRVITIGNERFRAPEALFHPSMLGLEAAGIHETTFNSIMKCDVDVRKDLYGNIVMSGGTTMYPGIAERMHKEISALAPTSIKVKITAPLERKYSVWIGGSILASLGTFQQMWISKQEYDEAGPTIVHRKCY

SEQ ID NO: 40195 - protein, 402 aa, Cryptococcus neoformans var. neoformans
MPSTKGVILVGGPSKGTRMRPLTLDCPKPLLPVAGKPMIWHPLQALSKVPDLTEVIIIGFYDDSQMAAFVKEAKREFPNIAISYLREYKALGTAGGLYHFRDSILRPPVPQHIFICNIDICCSFPFAEMLELHTSHGGTGTIMGVNVKKETATQYGCIVTDPETNQMVHYVEKPEGWISNIVNGGVYLFDKSLFDVIKVAMDEKTARAAEDPLVKPDEILRLEQDVIVPLAAARKMYVYQTHDFWRQIKTAASAVTATALYLSNYKLTNPSLLAPAAPNIIAPTFIDPSATIDPSAKIGPNVAIGPNVTVGPGVRIKDAIVLEGSTLEKHSCALNSIVGTNSHIGAWSRVDGEQEFEREVKGKISVTILASEVSLAPETMVRSCIVLPNKTLTKNATNQVLL

SEQ ID NO: 40196 - protein, 885 aa, Haemophilus ducreyi 35000HP
MSELERDVDPFETKEWLESLDSLIRVEGAERAQFIIDELLNQARAEGVPVQSGVTTAYVNTIPVSAQPAYPGDHAIERRIRSAVRWNAIAMVLRSQKKDLDLGGHISTFQSAATMYEVCYNHFFKAATDKNGGDLIFSQGHAAPGIYARAFLEGRLSEQQMDNFRQEAFTDGLSSYPHPKLMPEFWQFSTVSMGLGPVNAIYQARFLKYLENRGLKDTADQKVYAFLGDGEMDEIESKGALTFAAREKLDNLIFTISCNLQRLDGPVNGNGKIIQELEGLFVGAGWEVIKVLWGSNWDKLFAKDTSGKLTQLMMEVLDGDYLTFKSKNGAYIREHFFGRYPETAALVADMSDDEIWELRRGAHDSEKLYAAYAKAQHATKPVVILAHQVKGYKIPEAESKNTAHQSKKMSYDSLKGFRDYFELPLTDEQVENLEYIKFAEGSAEYEYLHAHRKALNGYVPARRKAFNIDYQVPALEEFQALLEAQPRGISTTMAFSRVLNTLLKNKNIGKTIVPIIADEARTFGMEGLFRQIGIYNPHGQNYVPSDRDLVAYYREAKDGQVLQEGINELGATSSWVAAATSYSVSNQPMIPFFIYYSMFGFQRVGDMMWLAGDQLARGFMIGGTSGRTTLNGEGLQHEDGHSHIQASVIPNCVTYDPSFAFEVAVIVQDGINRMYGEKQEDVFYYITTLNEVTEQPAMPSGAEEGIRKGLYKFETVEGKKGKGHVQLLGSGAIMRHVREAAQILAKEYGITSDVFSAPSFNELGRDGADCARWNLLHLTEAPRVPYVGQVLADLPTVASTDYMKLYAEQIRAYVPTRHYHVLGTDGFGRSDSRANLREHFEINEHYVVVAALAQLAKEGSVDAKVVEEAIKKFGLNVDRINPLYA

SEQ ID NO: 40197 - protein, 496 aa, Mycobacterium avium 104
MSSPAVPDHHTLIIGAGFSGIGAAIKLDKAGLPDYRVIEAGDGVGGTWHWNTYPGIAVDIPSFSYQFSFEQSRHWSRTYAPGRELKAYAEHCADKYGIRSRIRFNTKVLAAEFDDEQRLWRVQTDPGGEVTARFLISACGVLTVPNLPDIDGVDSFAGITMHTARWDHGQDLRGKRVAVIGTGASAVQVIPEIAPIVSSLTVFQRTPIWCFPKLDVPLPAPARWAMRFPGGKALQRLLSQAYVELTFPISAHYFTVIPLAKRMAALGRAYLRRQVRDPAVREQLTPRYAVGCKRPGFHNGYLATFNRDNVRLVTEPIDKITPDAVATTDGETHEIDVLILATGFKVMDPDSVPTFAVTGSGGRSLSRFWDEHRLQAYEGVTVPGFPNLFTVFGPYGYVGSSYFALIEAQTHHIVRCLKRAQRLGATRVEVSEEANDRYFAEMMRRRHRQIFWQDSCRLANSYYFDKNGDVPLRPGTTPEVYWRSRRFDLDDYRFTG

SEQ ID NO: 40198 - protein, 116 aa, Oryza sativa (japonica cultivar-group)
MATSSASTVSFSARPSAASAVRPCAAAGRARARAAAGETGKWWAPLLGWSGKADYIEAPAPAVVAAAEESEARRRPFVGGLTEEKARELRARMVETESFHDAMYHSAIASRLARSA

SEQ ID NO: 40199 - protein, 567 aa, Candida glabrata CBS 138
MQVETVPTKPYQDQKPGTSGLRKKTKVFMEEPNYTENFIQAIMDAIPEGAKDAVLVVGGDGRFYNDVIMQKIAAIGAANGVRKLIIGQNGLLSTPAASHVIRSYAEKCTGGIILTASHNPGGPENDLGIKYNLANGGPAPEPVTNKMWEVSKQLTHYKIIKDFPQVDFSKIGKDQQYGPLLVDIIDTTEDYVKFMKEIFDFKLIKEFIHKQREAKNWKLLFDSLNGITGPYGKAIFVDEFDLPADEVLQNWHPQPDFGGLHPDPNLTYAHTLVERVDREKIEFGAASDGDGDRNMIYGAGPAFVSPGDSVAIIAEYAKEIPYFQKQGIYGLARSFPTSGAIDRVAKAQGLNCYEVPTGWKFFCALFDAKKLSICGEESFGTGSNHIREKDGVWAICAWLNILALYNKHNPEKEASIKTIQEEFWAKYGRTFFTRYDYEGITTEKANKVVDLLDKFVNDPKSKNAPFPGDESLTVSDCGDFSYTDLDGSVSDHQGLFVKLSNGARFVLRLSGTGSAGATIRLYIEEYSDDKSTYTQSADQYLQKMIKSVTSFLNFKELIGTDEPTVRT

SEQ ID NO: 40200 - protein, 444 aa, Coccidioides immitis RS
MVAALFYVRAESGILRFSKLRNQFKLIILTGYPCSGLTYRANQLSTLLEDLQNRLHPPSQASEEVPQVQQQKGRYKIHIVTSHDVSHPRTVYDTARSEKEARAVVYGRVKRLLGKDSIVIVDGMNYIKGWRYQLWCESKAASTTCCVVHVGTPIDQCVKNNEARLQKVQNGDDELKQNLQGPTSQSAEEIPTAKVTFTNDDEPYPPELLQNLIFRFEEPSTSSRWDKPLFTVPWSDPTPPIESIWAALTGQTISDASTASSYLTITSNPSNLSEQNSSTSVRDTASTATTTPRTRVSRPKIVPHQATMQPPTTDPGALYALEKRTSEIVTHIRNFTQTHPTISSLGVSSTLTDPTAPGISVPIPDISIPVFIPSTALAASPTEELAGAGGVLALPRLQRLRRQWVGMNRAYLGQGHGKGPGSMGSEQVGEAFVRFLNGEFEGVE

SEQ ID NO: 40201 - protein, 448 aa, Blastopirellula marina DSM 3645
MNVVTKVSRVPRSLQLYQKALEIIPGGTQLISRRADRFAHGVSPIYASRAKGARFWDVDGHEYIDWVSGIGSILLGYADDVVDAAVCQQISTGTIYSVNHELEIELAEVLCEAIPCAEMVRYSKTGGEACAMAVRIARGATGRDKVLFCGYHGWHDWYLAANLAEEASLSQHLFPGIEPIGVPQGLRGTAIPFVYGDLVGLGELLDEHRGQIAAVVMEPLRSELPQEGYLAAVAKMTREHGAVFVMDEVSAGLRFSSGGAQKYLGVTPDVAVFAKSLANGYPMAAVVGKREVMEASARMFISSTYWSDTIGLRAALTTLQEVQSRDVPAQLWSFGAKLKSGLNQAGMEYGFDQCCRGVDVHPHLHLEINDADLKSKVNTLYIQEMAKRGCHGFTSFYLNAAQQTKELDQTVNAARETFAIIRNGLEDGNLDAKLECGVQQESFRRLVR

SEQ ID NO: 40202 - protein, 606 aa, Roseovarius nubinhibens ISM
MNVPNPKITTGALPASRKIYVAGEIHKDIRVPMREISVHPTAGEPPLPVYDSSGPYTDPDVLTDIRQGLAPLRRDWIVARGDVEEYEGREVKPEDNGFVQGDRLTPEFPVRPKPLRAKDGVAVTQLAYARAGIVTPEMEYIAIRENQLREAVKEERDGHDWGANIPDYVTPEFVRDEVAAGRAIIPANINHPELEPMIIGRNFLVKINANMGTSAVSSSMEEEVDKLVWSIRWGADTVMDLSTGRNIHNTREWIVRNSPVPIGTVPIYQALEKVNGIAEDLTWEVFRDTLIEQAEQGVDYFTIHAGVRLHMVPMTAKRVTGIVSRGGSIMAKWCLHHHKESFLYDHFDEICDICRKYDVSFSLGDGLRPGSIADANDEAQFAELETLGELTKIAWAKDCQVMIEGPGHVAMHKIKENMDKQLECCHEAPFYTLGPLTTDIAPGYDHITSGIGAAMIGWFGCAMLCYVTPKEHLGLPDRDDVKTGVITYKIAAHAADLAKGLPGAQRRDDALSRARFEFRWEDQFNLALDPETARDFHDQTLPKEAHKVAHFCSMCGPKFCSMRISHDIRAEAQKEGMEAMAAKFREGGELYVPAPEASDAKAEPAE

SEQ ID NO: 40203 - protein, 80 aa, Coprinopsis cinerea okayama7#130
MTSSTTLSQEEMKAHRIPLGWRDNCSALLVPLNICRRKNNFKPWECDHERHTYEKCQYDDYVRRMKELSKQKASAAEEDS

SEQ ID NO: 40204 - protein, 336 aa, Shigella flexneri 2a str. 301
MKTAVVTKDHHVDVTDKTLRSLKHGEALLKMECCGVCHTDLHVKNGDFGDKTGVILGHEGIGVVAEVGPGVTSLKPGDRASVAWFYEGCGHCEYCNSGNETLCRSVKNAGYSVDGGMEEECIVVADYAVKVPDGLDSAAPSSITCAGVTTYKAVKLSKIRPGQWIAIYGLGGLGNLALQYAKNVFNAKVIAIDVNDEQLKLATEMDADLAINSRTEDAAKIVQEKTGGAHAAVVTAVAKAAFNSAVDAVRAGGRVVAVGLPPESMSLDIPRLVLDGIEVVGSLVGTRQDLTEAFQFAAEGKVVPKVALRPLADINTIFTEMEEGKIRGRMVIDFRH

SEQ ID NO: 40205 - protein, 254 aa, Chlamydophila pneumoniae J138
MTRQSYVLGNWKMHKTIQEAKEYVQTLASLLQGEPLSCTIGIASPFTSLRAIHEMINTTGAFLWLGAQNVHPELSGAFTGEISLPMLKEVGVEFVLVGHSERRHIFGESDALIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 40206 - protein, 395 aa, Roseovarius nubinhibens ISM
MSTDAPITQDVMTIPRKLPEGPVNLVGLTRDKMRDVLIAHGTPEKQAKMRVSQIWQWIYQWGVRDFDAMTNLAKAYRAELAEKFVIEIPEVVSKQVSSDGTRKYLVRIAGGHEVEVVYIPEEDRGTLCVSSQVGCTLTCSFCHTGTQKLVRNLTAGEIIGQVMMARDDLGEWPEQGAPKDETRLLSNIVLMGMGEPLYNFDNVRDAMKIAMDAEGIQLSRRRITLSTSGVVPEIARTAQEIGCQLAISFHATTDETRNKLVPINKRWNIEELLQALASYPKVSNSERITFEYVMLDGVNDTDDDARRLIQMIKDHAIPAKINLIPFNEWPGAPYKRSSNNRIRAFADIIYKAGYASPIRTPRGEDIMAACGQLKSATERARKSRREIEAETRGAP

SEQ ID NO: 40207 - protein, 113 aa, Prochlorococcus marinus str. MIT 9313
MAGDTIFGQMLRGEIPFDEVYSDERCLAFRDIQPQAPVHVLVIPRKPLDSLRAADSTDSELLGHLLLVAARVAKQEGLDDFRTVINSGLEAGQTVFHLHVHVIGGRPLAWPPG

SEQ ID NO: 40208 - protein, 454 aa, Bacillus cereus G9241
MNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFMIEEFKNFFISEVAPETIAAVVMEPVQGEGGFIVPSKKFVQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKAPDKTLTANLCAEANKRGLLLLSAGTYGNVIRVLMPLVITDEQIEEGLTIIEESLQVCYEKANIARV

SEQ ID NO: 40209 - protein, 469 aa, Bacillus cereus G9241
MYINGEWITLQEQIEVNNPATKEIFATVPKGGVTEAKQAVDAAHEAFKSWSKLTAADRAVKLKKWFTLIDENKEEIAAIMTREQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADKWMEDGRVRKVSFTGSTEIGKELMASAAQTMKKVSLELGGHAPFIVMNDADLDKAVEAVIGSKFRNAGQTCICTNRVFVQEEVYEAFVEKFQKAVGQLKVGDGFGDGTTVGPLIDENAVSKVQEHIEDAIQKGGTVLYGGQKVAELDGHFIQPTVIGLANDTMLCMNEETFGPVAPVAKFKTVDEVIERANHTPYGLAAYIFTKDISQAFQISEALEYGIIGLNDGLPSVAQAPFGGFKESGIGREGGHFGIEEYLEIKYISLGL

SEQ ID NO: 40210 - protein, 230 aa, Triticum aestivum
  misc_feature (60)..(60): Xaa can be any naturally occurring amino acid
  misc_feature (83)..(83): Xaa can be any naturally occurring amino acid
  unsure (1)..(230): unsure at all Xaa locations
GRFGADAVRYFFLREVEFGNDGDYSEERFINTVNAHLANTIGNLLNRTLGLLKKNCNSTXVFDSIAAADGNSFKNNVENLVDXKAKGHYENLSLTSACETVLEIGNLGNLYIDEQAPWSCFKQGGEIAEKAAKDLVIILETMRIIAIALSPITPSLSLRIYTQLGFTEDQFRTSRWDDTKWGALKAGQAMMEPKPIFAKIETEIEEKDQASPKEGKGGKKKARSKGLVEA

SEQ ID NO: 40211 - protein, 423 aa, Mycobacterium avium 104
MRLMRTLRKPRPLARATLELANAANGFRPLARKGYSTVLVFWFGWPASEVPGIYFSASLLDALRRGRRGDFAGRRGKAALALTAASWAILGVIKYRGITTPGPVLEVGLRDQLGDDYTEALNKLPQSRPTRSGRRTLPLGNIVARRRYVEKTNVVSYGPHGRANLADIWRRRDLPRDGKAPVLLQVPGGAWAIGMRRPQAYPLMSHLAARGWVCVSIGYRVSPRHTWPDHIVDVKRALAWVKENIARYGGDPNFVAITGGSAGGHLCSLAALTPNDPKYQPGFEDADTSVVAAVPVYGRYDWFTTEGEGRREFVQLLEKFVVKKKFATHRDIYVDASPIRRLRADAPPFFVLHGRDDSLIPVGEAQEFVEELRAVSKSPVAYAELPHAQHAFDIFSSPRAHRSAEAVARFLSWVYATNPPERD

SEQ ID NO: 40212 - protein, 720 aa, Shewanella sp. MR-7
MSSLESSSESIAVNAQGQTSRRAARAQAQAFIDTLKPLQHPNSQKLYLQGSREDLRVGMRQILQTDTRIGGTATAPIVEKNPPIPVYDCAGPYSDPAAQINVRQGLAKLRLPWIIERQDTEVLDCATSDFTQQRLKDDGLDHLRFEAGSSAIVRPRRALPGKRVSQLHYARQGIITPEMEYVAIRENMALAEVQDEILNRRGQGESFGAVIGKPITPEFVRDEIARGRAIIPLNINHPEAEPMIIGRNFLVKVNANIGNSAVTSSIEEEVEKLVWSTRWGADTVMDLSTGRYIHETREWIIRNSPVPIGTVPIYQALEKVNGVAEHLTWEVFRDTLIEQAEQGVDYFTIHAGVLLRYVPMTAKRVTGIVSRGGSIMAKWCLSHHQENFLYTHFRKICELCVAYDVSLSLGDGMRPGSIADANDEAQFAELETLGELVKIAWEYDVQTIIEGPGHIPMQLIKENMEKQLIHCAEAPFYTLGPQITDIAPGYDHFTSGIGAAMIAWYGCAMLCYVTPKEHLGLPNKQDVKQGLIAYKIAAHAADIAKGHPGAQIRDNALSKARFEFRWEDQYNLGLDPDTARAYHDESLPQESAKVAHFCSMCGPKFCSMKITQDVRDYAASLTAGTLSVASSNQNVESAEALASINPAQQGQSNTEAIQQIRVKTQDELAAAMAQKSAEFAASGAKLYLPLGDANAANTANESAKQQDGTELKPTAQVAEV

SEQ ID NO: 40213 - protein, 546 aa, Pyrobaculum aerophilum str. IM2
MEKYQLTLNNIWKYVKEVFGDVEVAYLPPHGNNIRSTYGREYERTLRLADSLRQLGIGPGDKVATMDWNTIWHFELYWAVPGMGAVLHPLNVRLAPEDLVYIVNHAQDKALIYHRDFAPLVEKLKPHLKSVKVYIQISDGQGAATRDPEIEDVIRQGEPKPFPEISEDSVATIGYTSGTTGRPKGAYFTHRALTLHTLVSAVAFAGYRGFARPECAEHLCTFLQLVPMFHVHGWGTPWTFALLGWRQVYPGRFDPNHVVKLIAEEKVKSLAGVPTMLYMLLTAPDLHKYIEKIREIRPIFTVGGAALPKELARKASEAGFIPRVGYGMTETAPILTLGFFRHTEEMPRDLDEYYSLLTATGLPIPLVDLMVVDENLNPVPRDGKSIGEIVVRAPWVTPEYLGDLEKTKEAWRGGWFHTGDVAVWLPDGRVRIVDRAKDVIKSGGEWISSLQLEDLISTHPAVAQVAVIGVPHEKWGERPVAVVVLKPGATATEQDIIKHLEKFVEAGKIPKWWLPDKIIFTNQLPLTGTGKIDKKILKEQYKDVLR

SEQ ID NO: 40214 - protein, 568 aa, Kluyveromyces lactis NRRL Y-1140
MTSKAVRAVSKFHITTPIFYPNAKPHLGHLYSSLLCDVQNRWKKLAGQDTCFTTGVDEHGLKIQLAAQQKGYSNPKAFVDELCEHFVHLDKDANIKFTRFIRTTDPDHVNNVKKLWNLCYNNGYIYKGEHKGWYSVSDETFYPDTKILKLTIDGPPIPYDGSFDPDAKYINSESRNEVTYQSELNYFFKLSAFQEPLIKLLRENPTFIYPPLRHSQILRELESNELRDISVSRPATRLQWGIPVPEDESQKVYVWFDALCNYLTSIGGIDAIRNDVDSTQVLHNNRSFIEKPKEWWENTEHVIGKDIIKFHTVYWPAFLLAAKLPLPNRVVVHGHWLSGGVKMSKSLGNVVDPIQIISYYGADTTRWYLLENSNIESDGNFIEKNLWETRELLCSKLGNLINRCGGKKFSLASGVELFSGKPIEELSSVFPKESQAEFTALLKSLDNCTESVNNCFQQYDITGAQKILWNIINEANSFIQSTEPWSKKGLEKDLIVYSAMEAARISLIFSQPIIPNIAERLLNRLDVSSDRRTLSYTSYGSDDSYGMTTNQRHKEVPIQRVPFRLHNE

SEQ ID NO: 40215 - protein, 477 aa, Desulfitobacterium hafniense Y51
MTYNREYFYVTSVTLIGTEDGKLKQRRLGGKLNMTYVQEVLEQAVKRNPGEAEFHQALREVLESLEPVLEKRPDLKEAGILERIVEPERQILFRVPWVDDQGKVQVNRGFRVEYNSAIGPYKGGLRFHPSVYLGIIKFLGFEQIFKNSLTGLPIGGGKGGSDFDPKGKSEGEIMRFCQSFITELYRYLGADTDVPAGDIGVGGREVGYMFGQYKRITNRYEGVLTGKGLTFGGSLGRTEATGYGLVYFMEEALKAVGKSFSGATVVVSGSGNVAIYATQKATQLGGTVVAMSDSNGYIYDKDGINLDTVRQLKEVERKRLKDYVSIHPTAEYYEGCAGIWTIPCAIALPCATQNELDGEAAEVLVKNGCYAVGEGANMPSTPEAVDVFLQHKIIYGPGKAANAGGVAVSALEMSQNSMRYSWTFEEVDAKLKNIMVNIYHNASKAAQEFGFEGNLVAGANIAGFLKVAEAMKAQGTV

SEQ ID NO: 40216 - protein, 256 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 40217 - protein, 867 aa, Oryza sativa
MSSFILPFLLPPSLSSLPLFSSPFERLGGSGGRGPEWRRRPRHRLPCLQAGLPSRKLRQGLRRGRGMGARAQPTPSWAREPLFEKAVTPSDVGKLNRLLVPKQHAEKHFPLRRTSSDASATAAAATCNSARACSSTSRTARGSSQSYVLTKGWSRFVREKGLRAGDTIVFSGSAYGPDKLLFIDCKKNNTAAATGDEKPITSGEATRVVRLFGMDITGGGGDCRKRERAVEMGQEAFLMKRQCVCTTLHRPLSEGDITAMQVQQRKPKACAESAAAARGADQQQCDGRPLEAGEESLERSVPRKRKPAAAVAAAEKRWSSVAYVVLAAFVMATVFAVLGGRRPAVWIAATKALRRGSDDKSIPLARSAADKLLGGLLPEGFDEKSCRSRYESYLYRRNPGRRPSPHLVARLRMHEELQRRCGPNTESYNRAVQRLRDGGAAEADAHSPDDEQCKYVVSISYRGLGNRILAAASAFLYAVLTGRVLLVDPSNEMDELFCEPFPGTTWLLPRDFPLASSYANFSADTAESYGNMLKNKVLGTDGSTDGDMPAAQMPAFAYLHLDHDYGDGDKMFFCDDDQRLLSNIQWLVMRTDTYIVPSLFLVTTFQDELDALFPERDAVFHHLGRYLFHPANHVWGLVARYYRAYLATARQLVGVQVRVFDHRQAKSPHVVLEQITSCAWKEKLLPEVLDAVEDAAMPTPPTTPHGGSNNSKAVLITSLRPWFYERVKAMYWERATATGEDVSVHQPSHEEYQHFGEKSHDGKAWAEMYLLSLCDVLVTSGWSTFGYVAQGLGGLRPWVMYKPVNITAVPDPPCGRDVSMEPCFHSPPFYDCKTKRGVDTGTILPHVRHCDDVSWGLKLVDPNGSPN

SEQ ID NO: 40218 - protein, 373 aa, Streptomyces hygroscopicus subsp. yingchengensis
MDGVRAVLLAGGEGRRMGPLGRGRLKPLVPFGGTSRLIDFSIANVHRSGLRDVLLLSQYEERRLMDDLHLVWNGRHRGFRIDFGPYDAVYRHSPGKLPEQLPERTWPLERGTADALLTKAEYVFRQGDAEASEILVLHADHVYRFDYGDMIREHRASKAALTVSYQRIERRYVHLFGMVEFDGDGLLTAFEEKPDDPTSDLVFAAFCLFDAATLRRYLEQLRGTDWQHDISRDVIPAMLAGGELIRGYEVKSYWEDIGTVDRYHRAHRGLLRADPTLALSDMPLTVAPEVPRHLVPGGPGRRASVVAADVANEGEIVSSVVYPGARIGVDAHVVDCVVLPGARVPDGTHLASAIVLEDGSVQQCEAEREEVAL

SEQ ID NO: 40219 - protein, 451 aa, Oryza sativa (japonica cultivar-group)
MGGILVPYVCGACGPGRTGGKRGFAIRGSEATKSRHDAPQSPASTVARGVGGVPGASWGWFFQAAAGSPELDPAEERISGKGAAKLLDGRLVVALRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGTLVDRKPIGAEHESSVEDNGSMPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNEQLQSCLE

SEQ ID NO: 40220 - protein, 244 aa, Brassica napus
  misc_feature (144)..(144): Xaa can be any naturally occurring amino acid
  misc_feature (188)..(188): Xaa can be any naturally occurring amino acid
  unsure (1)..(244): unsure at all Xaa locations
FYKDFRPLDVYKSKTLVSLKLVNVGLLKPEFVVSLPCLKIMHLEDIQYSDDDGSLIIQKLVSGCPVLEDLTLCRSFDDKLPVVLRVVSHTLKRFCVKSGPGIESDAPGLKCIDFRDDDRVVGKNLSFFLMVDIDTKFTLHEFLXGVSSARRSMIISQRTIMELYRCLNMEPISKFHNLSRLEVSFSSXSILQVLTNFLEITPNLKYLTLCLVFSTKIERENLELTSVPRCLLSTLECVEIKEMI

SEQ ID NO: 40221 - protein, 359 aa, Prochlorococcus marinus str. NATL1A
MTKLPKLSSNSSLLGLSSEDLEEFARQEGEKSFRGRQIHEWIYQRGAKSLDSISVLPKKWRDSLVRKGIQIGRLDEINRVVAEDETLKLLMGTFDGEIVETVGIPTDKRLTVCVSSQIGCPMGCKFCATGKGGLNRSLDVNEIVDQVISVRETMNRRPTHVVFMGMGEPLLNIQNVLDSIECLTSDIGIGQRKITVSTVGIPNTLSDLAKLAQDRLGRVQFTLAVSLHAPNQTLRELIIPSASSYPINSLLKDCKKYIDLTGRRVSFEYILLGGLNDKDIHAEQLANLMRGFQSHVNLIAYNPIAEENFKRPSQSRVNAFRELLENRGVAVSVRASRGRDKDAACGQLRRQTIDKIKIN

SEQ ID NO: 40222 - protein, 227 aa, Haemophilus ducreyi 35000HP
MELVFIRHGFSEWNAKNLFTGWRDVNLTERGVEEAKAAGQKLLAAGYEFDIAFTSVLTRAIKTCNIVLEESNQLWIPQVKHWRLNERHYGELQGLDKKATAEKYGDEQVHIWRRSYDTLPPLLAPSDPNSAHNDRRYAHLPKEVVPNGENLKVTLERVLPFWEDQIAPALLSGKRVLVTAHGNSLRALAKHIIGISDAEIMDFEIPTGQPLVLKLDSKLNFIEKFYL

SEQ ID NO: 40223 - protein, 421 aa, Xanthobacter autotrophicus Py2
MTASPSPVWHPFTQHALAPEPPVVVRGNGAWLETASGGRILDAISSWWVITHGHCHPRIVAAIAEQAGQLDQVIFAGHTHPAAEALARGLVAMTPEGLDHVFFSDSGSTAVEVALKMAAGYWRHTGEQRTRILALEHGYHGDTIGTMSVGARGVYNAAYEPFLFEVTRLPFPEKGREQATLDALEAACREAPAALLVEPLILGAGGMYIYGPGVLAEMAAICARHGVLFIADEVMTGFGRTGTLFACEQAGVVPDIACYAKGLTGGSLPLAVTLCRSAIFDAHYSTDRARTFFHSSSFTANPIACAAAVANLKIWAEEPVRGRITALGDAQEERLANFRDDRRFANVRRIGTIAALDLVAPDPGYLADVGPRLAAFFRDEGLLIRPLGNTLYVMPPYCTTAEDLDLVYGAIATAADRFGRA

SEQ ID NO: 40224 - protein, 837 aa, Pseudomonas fluorescens PfO-1
MHNNNKELTLSAPLSGPVLTLAKVPDAVFASGAMGDGIAIDPLNDTLYSPCAGVVIHVARTGHALTVRADNGAELLLHLGLDTVELQGEGFSMLVKEGARVSNGQPLLRYDLDKVGRQCKSLVSLLILTNSQDFQARPITLKTVKVGEPLLHIVARHSAAANTEELGGPQVHGHVKVAHRGGLHARPAALIRQTAQGFKSQSQLHFAGKSAPCNSLIGLMGLAIGEQDEVQVSCQGPDAQAALQALLVALATALPEDHHAAAPLAATPRNRPAEAGVLHGVCAAPGLVGGPLFRLNAISLPADSGNHQPEQQLQILDTALNQVRSEIDGTLAQAKKQRNADEEAIFAAHLALLEDPALLDAARQSIETGTAATHAWSQSIDAQCQVLQNTGSPLLAERANDLRDLKQRVLRALLGEAWHYDVPAGAIVAAHELTPSDLLQLSAQGVAGLCMAEGGATSHVAILARGKGLPCMVALGSVLLDQTQGQSVVLDADGGRLELTPNAERLAEVQQAQIDRQQRRDAQQAQAHLPAETRNGVAIEVVANVASSHEAADAFANGADGVGLLRTEFLFVDRHTAPDVEEQRAAYQAVIDAMGDKSVIIRTIDVGGDKQLDYLPLPVEANPVLGLRGIRLAQARPEILDQQLRALLQVSPLQRCRILLPMVTEVDELLHIRQRVDALCLELGINQRPEIGVMIEVPAAALQAEQLAEHADFLSIGTNDLSQYTLAMDRDHAGLAARVDALHPALLRLIAMTCEGAAVHKRWVGVCGALASDPLATPVLIGLGVSELSVSPVQIGEIKDRVRQLHEAECQRLARDLLKLSSAAAVRHACHQHWPLR

SEQ ID NO: 40225 - protein, 395 aa, Medicago truncatula
MAQGSNDVASSLSLAEETTSTKRKQLITSSGALTSQPLPTLPFDLLPEILCRLPVKLLVQLRCLCKFFNSLISDPEFAKKHLHLSTMRHHLIVSSKNDKSRELLLFDFPISSVFSSSIGTHTQLNLPISLKTNGYGKHLAVCSCDGILCISATSVDHRYAILWNPSIRKFKILPPQEDYRWKRVLDSFYSFGYDHFIHNYKVIVIYLCIRSKTNEVCVHTLGTDKWRRIHDFPFCGIIRGSGIFVSGTVNWFAFDVPNKCCREIVSFDLEKESYKILSQPNLEKKSWNLGVLKDCLCIFSHNDIFVDVWIMKEYGNKESWTKLYNISYMGVPISHAYGNVLYNSEDNQMLVDLMREGNKRKVVLYNSKNGILNFREIEIGHLMSPNVYIESLVSP

SEQ ID NO: 40226 - protein, 398 aa, Shigella flexneri 2a str. 301
MLQRGCDGCKQNQSREPATIDGFMPKAQESIMGQQKQRNRRWVLPSRPHGAPVPENFRLEEDDVATPGEGQVLLRTVYLSLDPYMRGRMSDEPSYSPPVDIGGVMVGGTVSRVVESNHPDYQPGDWVLGYSGWQDYDISSGDDLVKLGDHPQNPSWSLGVLGMPGFTAYMGLLDIGQPKEGETLVVAAATEPVGATVGQIGKLKGCRVVGVAGGAEKCRHATEVLGFDVCLDHHADDFAEQLAKACPKGIDIYYENVGGKVFDAVLPLLNTSARIPVCGLVSSYNATELPPGPDRLPLLMATVLKKRIRLQGFIIAQDYGHRIHEFQKEMGQWVKEDKIHYREDITDGLENAPQTFIGLLKGKNFGKVVIRVAGDDKSFNGGVSRHKNPGKKLIFSFN

SEQ ID NO: 40227 - protein, 344 aa, Bacteroides fragilis YCH46
MPKYPLLGMTLTELQSVTKDLGMPAFAAKQIASWLYDKKVTSIDEMTNLSLKHRELLKGEYDLGISAPVDEMRSVDGTVKYLYQVSDNHFVEAVYIPDEDRATLCVSSQVGCKMNCKFCMTGKQGFTASLTANQILNQIAALPEWDKLTNVVMMGMGEPLDNLDEVLKALHILTASYGYGWSPKRITLSSVGLRKGLQRFIEESECHLAISLHSPFPSQRSELMPAERAFSIKEMVDLLKNYDFSKQRRLSFEYIVFKGVNDSLIYAKELLKLLRGLDCRVNLIRFHAIPGVDLEGAGMETMTSFRDYLTSHGLFTTIRASRGEDIFAACGMLSTAKQEESNKN

SEQ ID NO: 40228 - protein, 566 aa, Prochlorococcus marinus str. MIT 9313
MRLIRFDEELPSSLMTSSAQTGPTQRQVHLNTPFNDQKPGTSGLRKSSKQFEQTNYLESFIEAIFQTLPGVEGGTLILGGDGRYGNHRAIDVILRMGAAHGLSRVITTTNGILSTPAASHLIRANKAIGGIILSASHNQGGPDGDFGVKVNGANGGPAAESLTNAIYACSQALEKYSLVDADVIPLETPGHHAIGGMTVDVIDGVEDYVELMQKLFDFGRIKDLIKTDFPVVFDAMHAVTGPYAKRLLEGLLGAPTGTVRNGVPLEDFGGGHPDPNLTYAAELADLLLNGKAYSFGAACDGDGDRNMILGRGCFVNPSDSLAILAANANVAPAYADGLAGVARSMPTSAAVDVVAKQLNIDCFETPTGWKFFGNLLDAGRITLCGEESFGTGSNHVREKDGLWAVLFWLQILAERRCSVADVMTQHWSRFGRHYYSRHDYEAIASENAHGLYNRLESMLPRLIGQPFAGRQVSQADNFSYSDPVDGSETQSQGLRILLEDGSRVVVRLSGTGTKGATLRVYLECYEPSHGNLNQDPQHALADLINGIDALAEIQKRTGMQRPTVIT

SEQ ID NO: 40229 - protein, 203 aa, Acidobacteria bacterium Ellin345
MRVLTRFMLSAADARQFPAAGAPEIAFLGRSNVGKSSLINAIVGSKIAKTSSTPGRTQTINFFEIRRPGKPRPDWIFADLPGYGYARVPKELTAEWPKFIDPYLHERPTLALCVSIVDVSVPPQKKDLELLNWLRHVGRPFVVVGTKIDRVSGNQLRNNLLKLKEELLVEEVVPFSAKGTTGHNELWKKIFEAAGTDAPATAG

SEQ ID NO: 40230 - protein, 474 aa, Shigella flexneri 2a str. 301
MQHKLLINGERVSGEGEKQPVYNPATGDVLLEIAEVSAEQVDAAVRAADAAFAEWGQTTPKARAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVSKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 40231 - protein, 384 aa, Oryza sativa
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPPELGDQSIQDKLIEMTDGGCDYTFDCTGNVGVMRAALEACHKGWGESIVIGVAAAGQEISTRPFQLVTGRVWRGCAFGGVKGRSQLNDLVADYKKGDLKVDEFITHRKTLGEINNAFDTMKQGDCIRAVVDMQKLEPKI

SEQ ID NO: 40232 - protein, 120 aa, Oryza sativa
  misc_feature (11)..(11): Xaa can be any naturally occurring amino acid
  unsure (1)..(120): unsure at all Xaa locations
EGEGEEEKMGXGLSMSQKITLAYAALVGAGGAMGYMKSGSQKSLAAGGISALVLYFVHTQLPVRPVFASSIGSGISAALLSVMGSRFKKSGKIFPAGVVSLVSLVMVGSSLLFWYNMAYG

SEQ ID NO: 40233 - protein, 236 aa, Prochlorococcus marinus str. NATL1A
MDLQNQMKKAVAQAAVDQIQNGMILGLGSGSTAALMIEALAIKIKSGEIKDVVGVTTSFQGEVLASELGIPLKSLSSVSEIDLAIDGADEVDPKFQLIKGGGACHVQEKLVAALAKKFIVVVDSTKLVEKLNLDFKLPVEVLPSAWKQVQKTLINLGGEGNLRMAQKKAGPIVTDQGNLILDLTFRNGIDQPELLETQINNIPGVLENGLFVNLTDEVLVGKVESDVVGVESLKKI

SEQ ID NO: 40234 - protein, 544 aa, Methanocaldococcus jannaschii DSM 2661
MRDMCSISGIIVKDNQISAKYSIDMMKILKHRGRDNSGLLLDDEVIYFNDFEDVEDLEEEMIGNLSLAHNRLAIVGRYGVQPIPNEDETIWLVCNGEIYNYIELREYLKQNHEFRTDSDNEVIIHLYEEEKLEELDGDYAFAIYDKSKNVVRLARDMFGVKPLFYVDRDKYFAFASERKALWHLLINIDGCERDLDELNSKIKTLKPNSQLIYYLDDNRFEIIEGFKKLELNYMKERSYEEAKEYLDRALKNSVLKRVRGLDKVGIICSGGVDSSLIAKLASLYCEVILYAVGTENSEDLIYAERLAKDLNLKLRKKIISEEEYEEYVFKVAKAIDEVDLMKIGVGIPIYVASEMANEDGLKVVLSGQGADELFGGYARHERIYRERGEEELKKELLKDVYNLYKVNLERDDHCTMANGVELRVPFLDEEVVEIALSIPIEYKMSELSNRPYAESNISLKSEPINGLKNTNLNIKCVRSVRKKILRDVASQYLPDYIAYRPKKAAQYGSGGEKMIYKVAKKYGFSKKRINEFLDMLKRKIVSEF

SEQ ID NO: 40235 - protein, 332 aa, Desulfotalea psychrophila LSv54
MILAGDIGGTKTNLALYTCSCPAGNGSLIDSSAKTYLNADFASGEELVCGYLAGIDTTIKRAVFAVAGPIRDGQVKITNLPWLISVEQLSVATGIATIHLMNDLEATAYAVPFLSRDELYTLNQGISVERGNIALIAPGTGLGESFLTWEGTRYSAHATEGSHVDFAPTNALQIKLLDYLLRGYEHVSYERICSGIGIPNIYGFLKHSQNIEEPEWLREQLSQEKDHTAVIVNAALDAQRPCPICRMTVEIFLSVLGAEAGNIALKVMAAGGVYVGGGIVPRILSLLGNGLFMETFNSKGRMSELLVDVPVHIILNPKVAVFGAARYGMEIC

SEQ ID NO: 40236 - protein, 440 aa, Mycobacterium tuberculosis H37Rv
MRRPLDPRDIPDELRRRLGLLDAVVIGLGSMIGAGIFAALAPAAYAAGSGLLLGLAVAAVVAYCNAISSARLAARYPASGGTYVYGRMRLGDFWGYLAGWGFVVGKTASCAAMALTVGFYVWPAQAHAVAVAVVVALTAVNYAGIQKSAWLTRSIVAVVLVVLTAVVVAAYGSGAADPARLDIGVDAHVWGMLQAAGLLFFAFAGYARIATLGEEVRDPARTIPRAIPLALGITLAVYALVAVAVIAVLGPQRLARAAAPLSEAMRVAGVNWLIPVVQIGAAVAALGSLLALILGVSRTTLAMARDRHLPRWLAAVHPRFKVPFRAELVVGAVVAALAATADIRGAIGFSSFGVLVYYAIANASALTLGLDEGRPRRLIPLVGLIGCVVLAFALPLSSVAAGAAVLGVGVAAYGVRRIITRRARQTDSGDTQRSGHPSAT

SEQ ID NO: 40237 - protein, 526 aa, Triticum aestivum
MAAQLVAALLSPQALSLYLLLLPIVLLYYSATKTKRSGSEQAAAVGHGEERPLPAPPSKLPLIGHLHLIGTNPHVSLAALTAQHGDGGILLLHLGQVRNLVVTTPGAAEAVLRTHDHVFASRRQNAFADTLLDGSDIAFAPYGKFWRQLRRLVTTHLLSARKVLSLRAGREEEARLVMAKIRDAAAAGAAVDVSTLLATFTNDVACRAVSGKFFREEGRNELFREVIDGNVAAFGGFNPQDYFPSLAKVDALARVLFPKMTRLRKRWDGLLDRIIDDHATKSSLQQEEDEEETDFVDVLLARQHEYSLTRQHIKAILVDMFVAGTDTSYVVLEFAMAELMRKPHLMAKLQAEVREKTPKGQPMVMEDDLGGMTYLKAVLKETLRLHPPLPLLLPHFSVDKCVINGYTVPAETRVIINVWAIGRDPGSWEDAEEFIPERFEDIASPDYKGRDFGILPFGAGRRICPGINFGMASVEIMLANLAYCFDWELPGGMQHKDLNMSEVFGMTIHREEKLILVPTTRDVSHE

SEQ ID NO: 40238 - protein, 491 aa, Roseovarius nubinhibens ISM
MMTDTNLKSLLKDPSLLAEKSYVNGEWIDGEGGTFDVTNPARGDVIAQVTDLSRAQVSKAIDAAVTAQKDWASWTGKERAAVLRKWFDLMMENADDLATILTAEQGKPLAEAKGEIAYGASFFEFFGEEAKRIYGETIPGHQRDKRITVIKQPIGVAASITPWNFPNAMITRKAAPALAAGCAFVGRPAAETPLSATAMAVLAERAGVPAGVFNIVTSSRSSEIGKEFCENPGIRKLTFTGSTEVGRILLRQAADQVMKCSMELGGNAPFIVFDDADLDAAVEGAIMCKFRNNGQTCVCANRIYVQSGVYDAFSKKLAEAVSKLKIGDGLDDGTQLGPLINSDAITKVQEHVADAKSKGAEVILGGGEPMEGEGYFLPPTIITGATQDMAVATDETFGPLAPLFKFDDVDDVIAMANDTIFGLASYFYAKDLSRVYKVAEALEYGIVGVNTGIISTEVAPFGGVKQSGLGREGSHHGIEDYLEMKYICMSV

SEQ ID NO: 40239 - protein, 169 aa, Oryza sativa
  misc_feature (91)..(91): Xaa can be any naturally occurring amino acid
  misc_feature (126)..(126): Xaa can be any naturally occurring amino acid
  misc_feature (156)..(156): Xaa can be any naturally occurring amino acid
  unsure (1)..(169): unsure at all Xaa locations
GGGTRAAAAAAAASRRWSAGRAGRAAGRRRRERASMALVPNSARGTIELFVERYKDKGITVIAGVEARGFIFGPPIALALGARLVPFRWPXWVPDKIEMHVGPVEPNDRAVVVDDLIATGGTLSAXAVKLIERAGPEVVECAWCHLNYQNLKGRDXLGNKPVFVLVKPD

SEQ ID NO: 40240 - protein, 410 aa, Burkholderia sp. PS12
MATHVAIIGNGVAGFTTAQALRAEGFEGRISLIGNEPHLPYDRPSLSKAVLGGSLEHPPVLAEADWYGEARIDMLSGRSVTNLNVDARTISLDDGSTFAADAIVIATGSRARTLALPGSQLTGVVTLRTNDDVRPLCRGWTPATRLVIAGGGLIGCEVATTARKLGLAVTILESADELLVRVLGRRIGAWLRGLLTELGVRVELGTGVAGFSGDDRLEEVLASDGRRFAADNALVCIGAEPEDQLARQAGLSCDRGVIVDDHGATHAEGVFAVGDAASWPLRDGGRRSLETYMNAQRQAAAVAAAILGKHGSAPQVPVSWTEIAGHRMQMAGDIEGPGEFVLRGTLGDGAALLFRLRDGRIQAVVAVDAPRDFAMAARLVEARAAIEPARLADFSNSMRDLVRAQQGDSA

SEQ ID NO: 40241 - protein, 503 aa, Bacteroides fragilis YCH46
MKIFPSSSIKKLDAYTIEHEPIASIDLMERAAQALTKAITERWDITTPVTVFAGPGNNGGDALAVARMLAEKEYKVEAYLFNPKGELSADCQTNKELVEMMDNVKFSEVSTQFVPPALTMDHLVVDGLFGSGLNKPLSGGFAAVVKYINASPATVVAIDIPSGLMGEENTFNVKANIIRAQLTLSLQLPKLAFLFAENSEFVGEWKLLDINLSREAIEETESNYALLEAEEIHALIKPRNTFSHKGNFGHALLIAGSYGMAGASILAARACMRSGVGLLTVHAPIRNNDILQISVPEAIIESDASDTYFACPTDTDDYQAVGIGPGIGRSEETEAALLEQLSGCQTPLVLDADALNILANHRHALTTLPKGSILTPHPKELERMVGKCQNSYERLMKACELARTAKVHIILKGAYSAIITPSGKCYFNSTGNPGMATAGSGDVLTGVVLALLAQGYPAEEAAKIGTYVHGLAGDFARKKQGVISMTAGDIISNLPLAWRLVSE

SEQ ID NO: 40242 - protein, 116 aa, Pseudomonas fluorescens PfO-1
MTNKIILALEAEQMTKEIPTFAPGDTIVVQVKVKEGDRSRLQAFEGVVIAKRNRGVNSAFTVRKISNGVGVERTFQTYSPQIDSMAVKRRGDVRKAKLYYLRDLSGKAARIKEKLA

SEQ ID NO: 40243 - protein, 440 aa, Oryza sativa (japonica cultivar-group)
MAFSARRSLASGLSRHLSRRLHPSVSHLLPSHHDDHSENPSPPAQPPPLPSALRSPSRSQALGLPLPFGLLHASRRSLSTSPRSNDELDASAEVLSDAASSVSVPADVLADAAASVPVSAPAPFPGEVAAAAADSFAPVAALQHLIDGVHSLTGLNWWACIALTSLLIRTLTVPLLLNQMKATVKLNAMRPEIEAINLEMRTISSTRIAGNEKSSTRVTDEGSMSTDPQSMLEGKRKLGELFLRHGVTPLTPLKGLFIQAPIFMSFFFAISNMVEKVPSFKGGGIYWFTDLTTPDELLILPMLTSLTFLVTVELNMQDGMEGNPMLKTMKNFSRVMAVLTIPFTMSFPKAIFFYWVTSNLFSLGYGFVLRKPAVRSFLDLPPIETQFAPAQQPTFNLFGASKSVPAAGSSIAESDRSSSVLSQRFSDLENRAKSRRESQD

SEQ ID NO: 40244 - protein, 738 aa, Prunus persica
MEACNCIEPQWPADELLMKYQYISDFFIALAYFSIPLELIYFVKKSAVFPYRWVLVQFGAFIVLCGATHLINLWTFSMHSRTVAIVMTTAKVLTAVVSCATALMLVHIIPDLLSVKTRELFLKNKAAELDREMGLIRTQEETGRHVRMLTHEIRSTFDRHTILKTTLVELGRTLALEECALWMPTRTGLELQLSYTLRQQNPVGYTVPIHLPVINQVFSSNRALKISPNSPVARMRPLAGKHMPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILKSSHLLATLINDVLDLSRLEDGSLQLEIATFNLHSVFREVHNLIKPVASVKKLSVSLNLAADLPVQAVGDEKRLMQIVLNVVGNAVKFSKEGSISITAFVAKSESLRDFRAPEFFPAQSDNHFYLRVQVKDSRSGINPQDIPKLFTKFAQTQSLATRNSGGSGLGLAICKRFVNLMEGHIWIESEGPGKGCTAIFIVKLGFAERSNESKLPFVTKVQANHVQTNFPGLKVLVMDDNGSVTKGLLVHLGCDVTTVSSIDEFLHVISQEHKVVFMDVCMPGIDGYELAVRIHEKFTKRHERPVLVALTGNIDKMTKENCMRVGMDGVILKPVSVDKMRSVLSELLEHRVLFEAM

SEQ ID NO: 40245 - protein, 152 aa, Arabidopsis thaliana
MAFVKLLVSIAITTAITIAVITTITNNTTTIREYTSFDAPSTPTIRPNRLLAQKEVGERNPNAADHCNRNPEICTPYGGGGSNSTMTCCNNKCIDVSSDDNNCGACKNKCKFSQTCCRGQCVYVAYDKRHCGQCNHPCELGEFCVYGLCNYA

SEQ ID NO: 40246 - protein, 488 aa, Oceanicola granulosus HTCC2516
MIDKIAHRGPDEVHVTTLADAPVTMAHCRLSIIGTEDGAQPIRQAGNMLVANGEIYNHADLRAILGEAAFETASDSETILHLFRSGRSRWIDRLDGMFAFVLATKDRIIATRDPLGIKPLYVANMGGGAIFASELKAFDGVPVDGIEAIPPGHLIDSRDGWRQWYRTPQGAASAEPGFDIGRASRELRLVLEAAVAKWMVADVEVGSFLSGGLDSSIIAAIAQKVRLAQGLGPLKTFAVGTDGSPDLRAARAVAAHIGADHHEAVFTAQDVVGALPHVIYHLESADVDLVRSALPTLFAARLARAQVKAVLTGEGADELFAGYTYHHGYADDPRALADELTRSLGTMHNINLQRVDRVTMSESLEARTPFLDRDLIDFAQSIPAELKMRHTDPEARDATGPTTEKWILRKACEDLLPADLVWRKKAQFDEGSGTVDALSGALASLIDGPVNRQSEGALYERILGETYADPDRILAAAGTWEADRVLGG

SEQ ID NO: 40247 - protein, 100 aa, Nostoc punctiforme PCC 73102
MSIYVGNLSYEVKEEDLRHVFAEYGTVKNVQLPIDRETGRMRGFGFVEMESDAQETAAIEALDNAEWMGRSLKVNKAKPKTDGGSSGGRRGGDGGSSRRY

SEQ ID NO: 40248 - protein, 166 aa, Oryza sativa (japonica cultivar-group)
  misc_feature (157)..(157): Xaa can be any naturally occurring amino acid
  unsure (1)..(166): unsure at all Xaa locations
MAAAAEEKNMKMIKVISSDGEAFEMTEAAASMSRILLHMIEDGCTGDGGAGITLPNVAGSALAKVIEYCTKHAIAAAEGSSSSRKAKEELKKFDVEFMEVGIDMLYDLIMAANFMGVEGLLSLAAQRTAELIKGKSPEQIREMFGIKNDHTPEEEEXIRKEYEWAF

SEQ ID NO: 40249 - protein, 442 aa, Medicago truncatula
MEVSYVSPESSKVVSPRTLRKSIVEKVFGKSYSIKGSGSFKKRSESQSSINEDNEGGMELMEIGAERTKNVLILMSDTGGGHRASAEAIRDAFQIEFGDEYKIFVKDVWKEYTGWPLNDMEGQYKFMVKHVQLWKVAFHSTSPKWIHSVYLAAVAAYYAREVEAGLMEYKPDIIISVHPMMQHIPLWVLKWQGLEKKVIFVTVITDLSTCHPTWFHPWVNRCYCSSEEVAKKALLEGLEESQTRTYGLPIRPSFARAVLVKDELRKELKMDPDLPAVLLMGGGEGMGPVKKTAKALAESLYDKENEKPIGQIVVICGRNKNLVASVEAIEWKIPVKVRGFETIMAKWMGACDCIISKEKGNVPYVVNNGAGVFTRSPKETARIVAGWFTTKQDELKTMSENALKLANPEAVFNIVRDIHELAKQREPGNFPYELTSSFTSII

SEQ ID NO: 40250 - protein, 1195 aa, Methanocaldococcus jannaschii DSM 2661
MDKILEILKDFGIVELRPPQKKALERGLLDKNKNFLISIPTASGKTLIGEMALINHLLDGNKNPTNKKGIFIVPLKALASEKYEEFKSKYERYGLRIALSIGDYDEDEDLSKYHLIITTAEKLDSLWRHKIDWINDVSVVVVDEIHLINDETRGGTLEILLTKLKEFNVQIIGLSATIGNPDELAEWLNAELIVDDWRPVELKKGIYKNEAIEFINGEIREIKAVDNNDIYNLVVDCVKEGGCCLVFCNTKRNAVNEAKKLNLKKFLTEEEKIRLKEIAEEILSILEPPTEMCKTLAECILNGSAFHHAGLTYQHRKIVEDAFRKRLIKVICCTPTLCLNANTEILQESGFRKITELNKDEKVFALCGKEIKPVDGWKVHKTPQHEYNIVVKTVNGLEITTTPNHIFLVKENGSLKEKEAKDLKVGDYVATVDRIRVKEKDIDLSNGDLYFIGYFIGDGYTGVIEKNTLKATPDLAFNPKYPPNFDDSELHKKYFLKCRISKGVAHYIYSKKLRKIFNKLNMLTKDNKNIDAFCNLPLDKLAYLIAGLFDSDGYIYLNRKNIEFYSISEKLVEQLQFVLLRFGIHSSIRKKKTKTMVSPTNGKEYKCKDIYVLTIRDFMSIKRFYENIPLRHEEKRRKLEEIIKNKEIGQIPSEFVALRFTPIAKIWCDCGFSVDLTMFKPRTKRQRELNKKRVKLLFELLDGKKLITNYKEYYSKRKNPYFDFIVREKINGNNYYSLNEKGRVLMSLLNKHIKDKENLEEMYNFLVNLEKCPICGKPIHKEMRYSWKKECYDGDIYWDRIKEIKKIKVNDKYAYDIELPDDGSNSHYIVANGFIVHNSAGLNLPCRRAIVKDLTRFTNKGMRYIPIMEIQQCIGRAGRPGLDPYGEGIIVAKNDRDYLRAYQALTQKPEPIYSKLSNQAVLRTQLLGLIATGEIRDEYDLEWFIRNTFYAHQYGNLREVAKNINEVIRFLEENEFIIDFMPTELGKRVSELYIDPLSAKFIIDGLEEMENEEEIYYLYLISKTLEMMPNLRVYNSEELNLIDEMDSLGIKSFEIEDLEAFKTAKMLYDWINEVPEDEILKRYKIEPGILRYKVENAVWIMHALKEIAKLIGKSSDIPEKLEIRLEYGAKEDIIELLSIKYIGRVRARKLYNAGIRSIEDIINNPSKVASIIGEKIAKKILDELGVKFGQQKLSF

SEQ ID NO: 40251 - protein, 210 aa, Medicago truncatula
MVYHSSFVDDEGINRACGCPLLPLKSHIKGPAPVSDQDRTDIVDEAITFFRANVFFRNFDIKSPADKLLIYLTFYINVALKKLEGCRTLAEGTKAIINLGLENVPVPGESGFPFPGLFPLPQSHKEAELFRNYLKQIREETSGRLLSVAYRPNGTPNKWWLAFAKRKFMNLGRIHNGNRFHVYFAPHAEVSDHNWAITLTFACAGGAGHV

SEQ ID NO: 40252 - protein, 407 aa, Oryza sativa (japonica cultivar-group)
MAMSFLSTTAASSSQPPLPARRLPRRNPSLPFPLRPPHRLSPFSAPPPEPHRLTYRTHSTSSSSRTPTAAGLLSPVISTSRTLIFLLVASLLSLSGVRPLPSLASPPPPTQQPQETEEQEQQQESEEKQQQQQEEEGVEAEVEEAWLRQDEEEEVEEKEEEEEEADDEVQMYMEILSRDPGDVDALKCALFAKMRRAEWGGALGFARRLREAEPGEVEWRLMEALLHELKGDLAEAERLFNEVLAEKPLLVRALHIAELVLAFSNVEGFVGLALCMHKRSEGPTVFEMLEKALQLAISGERVPEERNIKLLIAQMHVVKGQLDVASEKLQNLINEDPRDFRPHLCQGIVYALLDKKEEADELFDTYRSLVPDEFPDKSFISDVIQAARVESKDRLQKDFGSEFLSKK

SEQ ID NO: 40253 - protein, 205 aa, Populus tremula x Populus alba
MRRVYDTFLIVLLCLIGGAAGEQCGKQAGGQTCPNNLCCSQYGWCGDTDDYCSPSKNCQSNCKGGGGGESASNVRATYHLYNPQDHGWDLNAVSAYCSTWDASKPYSWRSKYGWTAFCGPAGPRGQASCGKCLRVTNTRTGAQTTARIVDQCSNGGLDLDVNVFRTIDTDGDGYAKGHLIVNYQFVDCGDSINSPKPLLSIVDDQ

SEQ ID NO: 40254 - protein, 535 aa, Methanocaldococcus jannaschii DSM 2661
MICLGLEGTAEKTGVGIVTSDGEVLFNKTIMYKPPKQGINPREAADHHAETFPKLIKEAFEVVDKNEIDLIAFSQGPGLGPSLRVTATVARTLSLTLKKPIIGVNHCIAHIEIGKLTTEAEDPLTLYVSGGNTQVIAYVSKKYRVFGETLDIAVGNCLDQFARYVNLPHPGGPYIEELARKGKKLVDLPYTVKGMDIAFSGLLTAAMRAYDAGERLEDICYSLQEYAFSMLTEITERALAHTNKGEVMLVGGVAANNRLREMLKAMCEGQNVDFYVPPKEFCGDNGAMIAWLGLLMHKNGRWMSLDETKIIPNYRTDMVEVNWIKEIKGKKRKIPEHLIGKGAEADIKRDSYLDFDVIIKERVKKGYRDERLDENIRKSRTAREARYLALVKDFGIPAPYIFDVDLDNKRIMMSYINGKLAKDVIEDNLDIAYKIGEIVGKLHKNDVIHNDLTTSNFIFDKDLYIIDFGLGKISNLDEDKAVDLIVFKKAVLSTHHEKFDEIWERFLEGYKSVYDRWEIILELMKDVERRARYVE

SEQ ID NO: 40255 - protein, 310 aa, Methanocaldococcus jannaschii DSM 2661
MFDPKKFIDEAVEEIKQQISDRKAIIALSGGVDSSVAAVLTHKAIGDKLTAVFVDTGLMRKGEREEVEKTFRDKLGLNLIVVDAKDRFLNALKGVTDPEEKRKIIGKLFIDVFEEIAEDIKAEVLVQGTIAPDWIETQGKIKSHHNVALPHGMVLEVVEPLRELYKDEVRLLAKELGLPDSIVYRQPFPGPGLAVRVLGEVTEEKLNICREANAIVEEEVKKANLDKDLWQYFAVVLDCKATGVKGDEREYNWIVALRMVKSLDAMTAHVPEIPFDLLKRISKRITSEIPNVARVVFDITDKPPATIEFE

SEQ ID NO: 40256 - protein, 204 aa, Schizosaccharomyces pombe
GPCKTVRHLNWLHCMLIFGLPMIAIYGVFTTPLQTKTLIFAIIYYAYSGLGITAGYHRLWSHRAYKAKKPLEYFLAAGGAAAFEGSIRWWSRDHRAHHRYTDTDKDPYNVKKGFWYAHVGWMIILQNPRRIGRSDVSDLNSDPFVMFNHRHFLPIASFMAFIFPSLFCGLLWGDYRGGYFYAGVCRLVFVHHATFCVNSLAHLI

SEQ ID NO: 40257 - protein, 300 aa, Sinorhizobium meliloti
MALRTDWNGVFPAMVTPFRENGSFDEASFKALIELYISEGVKGVVVTGSTGEWYSMSDAERATVWEVAVEASSGRITVIAGTSAVGTREALALTRTAKAVGVDGCMLLPPGGIFAARNEVVNYFHTLAGVGLPIMVYNNPPRTGVNMDADMVAEIAKSEEIVSFKDINRYLYAASEIIYRVCDKLAVFTGLEPYASSVLPRGAVGVVSTISNICAANMVSYYNAVISGDSATAYKTQKLIDQLYHFLPTLGAPAFVSVKAAMKLLGRPGGEIRLPHLPANEALIGKLREELRRLKMMTLN

SEQ ID NO: 40258 - protein, 429 aa, Arabidopsis thaliana
MNPSKATGGIVEDLTKQLPKSMFLSMDADKTLLHIIQKKITSAKNVNCILGYCRCPRSLKSLHETDGIKFRVFHDAGNKLISTLRRVKTCAGARVLNMQMEEVDRAFTMSGQLHLTTWTRRRTKTTPQRSMCDPIREDGSNKRGAVSKEKRPYIHREWSWADIIRALTVINVHFLCLLAPFNYKWEALRFGFVLYALTSLSITFSYHRNLAHRSFKLPKWLEYPLAYFAVFALQGDPLDWVSIHRFHHQFTDSDRDPHSPIEGFWFSHVWWICDTRYIKYKCGGRNNVMDLKQQWFYWFLRMTIGFHVLMFWTVLYLYGGLPYLTCGGGVGGVIGYHVTWLVNSACHIWGSRSWKTKDTSRNVWWLSLFTMGESWHNNHHAFESSARQGLEWWQIDITWYLIRLFEVLGLATDVKLPSEIQKQKLALTR

SEQ ID NO: 40259 - protein, 392 aa, Candidatus Desulfococcus oleovorans Hxd3
MKGDKDWGISTKAVHAGEIRYNEYGSVTTPIVQTSTFIFKNIDEIKKLAVGAVERFEYGRYGHPTQIAAEHKLAFLEGAEDAVLFSSGMSAITTTLFGLLKSGDHIIITDDAYRRTLEFCKACLVKFDIECTVVKMCDYEAMEKAIKPNTRLFFSESPTNPYLNIMDLERLIGIFKDKGILVVSDSTFATPYNQKPLEYGVDIVIHSATKYLAGHNDLLSGVVLGSKKLVEPVREFLKITGGVIDPNSAYLLIRGLKTFGLRMERLNENGQIVAEGLERHPKISRVYYPGLPSHPHHDVAKAQMKGFGAVVTFEVEGDCEYVLNFLSRLKIINIGPSLGGVESLITHPATISYYDKTRKERLALGIKDGLIRLAVGVENAEDIIADIEQALA

SEQ ID NO: 40260 - protein, 382 aa, Aspergillus oryzae
MATATVLEKANIGVYTNTNHDLWVAESKPTLEEVKSGESLKPGEVTVQVRSTGICGSDVHFWHAGCIGPMIVTGDHILGHESAGEVIAVASDVTHLKPGDRVAVEPNIPCHACEPCLTGRYNGCEKVLFLSTPPVDGLLRRYVNHPAVWCHKIGDMSYEDGALLEPLSVSLAAIERSGLRLGDPVLVTGAGPIGLITLLSARAAGATPIVITDIDEGRLAFAKSLVPDVITYKVQTNLSAEDNAAGIIDAFNDGQGSAPDALKPKLALECTGVESSVASAIWSVKFGGKVFVIGVGKNEMKIPFMRLSTQEIDLQYQYRYCNTWPRAIRLVRNGVISLKKLVTHRFLLEDALKAFETAADPKTGAIKVQIMSNEEDVKGASA

SEQ ID NO: 40261 - protein, 464 aa, Roseovarius nubinhibens ISM
MASQSFDLIVIGAGPGGYVAAIRGAQLGLKVAVVEREHMGGICLNWGCIPTKALLRSSEVFHLMHRAKEFGLSAEKIDYDIDAVVKRSRGVAKQLSGGVAHLLKKNKVTAIMGEATIPAKGKVTVKTEKGSEELTAKHIVLATGARARELPGLEADGDLVWTYKHALMPPRMPKKLLVIGSGAIGIEFASFYNTLGADTTVVEVMDRVLPVEDAEISAFAKKQFEKQGMTIMEKSTVKKLDRAKGKVTAHIERGGKTETLEFDTVISAVGIVGNTEGLGLEALGVEVDRTHVVVDEYCRTKVEGLYAIGDIAGAPWLAHKASHEGVMVAELIAGGHPHPVRPESIAGCTYCHPQVASVGLTEAKAKEAGYDIKVGRFPFIGNGKAIALGEPEGMVKTVFDAKTGELLGAHMVGAEVTELIQGYVVGRQLETTEEDLMNTVFPHPTLSEMMHESVLDAYGRAIHF

SEQ ID NO: 40262 - protein, 211 aa, Brassica napus
MVVAAAAASTPFSLSSAVFTRRRSFRVSATLSREPSPLLRAAQHTVDSYVESGMVVGLGSGEASDLAIRYLGHQLRSGSIQGVVGVPMSARSASEAAKYGVPLKHFRDDFQIDFAFHDADAVEEGTLVSVIGRRTSTTQEDDYILLQKSIVKAADEAVFLIKDEQYKSGLEGSIPVLVQSLNWLAVAEEIDDLYLGDAEVWRRASVGDAGP

SEQ ID NO: 40263 - protein, 496 aa, Arabidopsis thaliana
MDLGKLIQLSALLCPFLLSLHFRIAGASAHIYSSQPFHDVGNSLLLYGGSEGIFASSRSLIRFENITLWRTITGKGHRSNGLVQAVIFEASDRNNIGGSAYGGQRSICCTPDLAKLQGCKQGEIIRIPSPHDPQWPILLPVRFKGKRSSAKMADTEILITKTGIYNLLFISCDPQLKGLKMTGKTVWKNPDGYLPGRMAPLVNFYVYMSLAYLLLSAVWFFQYLRFRMDILPLQHCITAVILLGLLEMLFWYLDYANFNHTGMRPLALTTWVVTIGALRKTVSRILILCVSMGFGVVKSTLGGLTSKVLLVGVTYFIASEILDIAEHVGIIDDMSGRSKLFLVLPDAFLDAFLILWIFTSLSKTLEQLQMKRTSVKLEIYRKFSNALAVMVVASVAWIVYEVYFKATDPFNERWQTAWTITAFWDVIVFLLLCIICYLWTPSQNSQRYAYSGDVDEENEEAQSLTGGKQDGDISLVKQEKNAESDREEDVEEDKRE

SEQ ID NO: 40264 - protein, 148 aa, Nicotiana tabacum
MEQTFIMIKPDGVQRGLVGEIIGRFEKKGFSLKGLKLITVDRAFAEKHYSDLSAKPFFNGLVDYIISGPVVAMVWEGKGVVTTGRKIIGATNPLESAPGTIRGDYAIDIGRNVIHGSDAVESARKEIALWFPEGVAEWQSSLHSWIYE

SEQ ID NO: 40265 - protein, 563 aa, Oryza sativa (japonica cultivar-group)
MSLWKHPAAAGDGEVVETVVELLARVRGMVPPALGAAGAAEGFPGRWKAIAAKLEGLPACLSDLSSHPCFAKNALCRELLQSVAATLAEAAELAARCREPPAAGKLQMQSAIDALAGKLDLNLRDCALLVKTGVLSDAFTPPPPTDEATSTATAAQADVRELLARLQIGHTEAKSLAVDGLLEALNKDEKSVLSVLGRANVAALVQLLTAPATKVREKAATVICQLAESGGCEGLLVSEGALPPLIRLAESGSLLGREKAVITLQRLSMSSDTARAIAGHGGARPLIEMCQTGDSISQSAAAGALKNLSAVPEVRQALADEGIVRVMVGLLDCGTVLGSKEHAADCLQNLTSSSDSFRRAVVSDGGLRSLLVYLDGPLPQESAVSALRNLVSAVSPDSLVSLGVLPRLAHVLRVGSTGAQQAAAAAICRISTTTDMKRVVGEHGCVPLLVRMLDAKSNGAREVAAQAMASLVGYPPNAREVRRDGKSVPCLVQLLDPSPANTAKKYAIACLLSLAAAKRCKKLMISHGAIGYLKKLSDMDVAGAKKLLERLERGKLRSLFSRD

SEQ ID NO: 40266 - protein, 479 aa, Shigella flexneri 2a str. 301
MSVPVQHPMYIDGQFVTWRGDAWIDVVNPATEAVISRIPDGQAEDARKAIDAAERAQPEWEALPAIERASWLCKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNLLGEALQAVQFGNPAERNDIAMGPLINAAALERVEQKVARAVEEGARVALGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 40267 - protein, 202 aa, Oryza sativa (japonica cultivar-group)
MATWSKPSLIAAVIFLLVSLLSSASVANGGRSGGRRLVRSYDEPCKEMRLYLHDILYDYSNSTSNSTSAAATKPTALSAAVSNPGFFFGRMVVFNDPVTEGRALPPSLEETVVRAQGLYLYDGKVVFDAWFAFTVVFNSTAHHGTLNLMGADPNTEMRDISVVGGTGDFFMSRGVATLRTDAFEGFTYFRLQMDIKLYECYV

SEQ ID NO: 40268 - protein, 252 aa, Listeria monocytogenes str. 4b H7858
MNAATRAVVRKAIYEGLEVYGINYGFLGLVNGDIRKLELGSVGDLLHRGGTFLYSARYPEFATEEGQLKGIEQLKKHQIDGLVVIGGDGSYHGAEALTKRGFPTIGIPGTIDNDISGTDFTIGFDTALNTVLDALDKIRDTATSHERTFIIEVMGRDAGDIALWSGLAGGAEAIIVPEESFNMDDVVDRLNKGRERGKKHSIIVVAEGVMSGNEFAKQLAEYGDYHARVTVLGHVQRGGSPTAFDRVLASRL

SEQ ID NO: 40269 - protein, 255 aa, Phanerochaete chrysosporium
MAQSREDSVYLAKLAEQAERYEEMVENMKRVASSDQELTVEERNLLSAAYKNVIGARRASWRIVSSIEQKEESKGNEAQVAMIKGYREKIESELAKICEDILDVLEKHLIPSAASGESKVFYHKMMGDYHRYLAEFATGDKRKESADKSLEAYKAASDVAVTELPPTHPIRLGLALNFSVFYYEILNSPDRACHLAKQAFDDAIAELDTLSEESYKDSTLIMQLPRDNLTLWTSDMQDSDKPADEKPSDEADNES

SEQ ID NO: 40270 - protein, 443 aa, Triticum aestivum
MYGGDEVSAIVIDVGSYSCKAGYAGDDTPKCVFPSVVGSTEQTGDTDEAKPEKEADSGSDPKNGSKPMDVDKAKTKRKYYVGQELEFRRDHMEVISPLKDGTVTDWEVVDNIWNHAFRQRLLINPEEHPMLIAEPSTNSGQQREKAAELMFEKYKVPALFLAKNAVLTSFASGRATSLVVDCGGGSTVVSAVHDGYVLQKSVATSPIGGEFLTDCMMKSLESKGVVIRPKYSFKKKEVSPGDYKVVDLDFPNTTDSYRLYCMRAIASDIKESVCRVPDTPFDEVAYANVPTTSYELPDGQTIEVGADRFKIPDILFNPYLSQTIPGIDGFGDSTSIRGLPRMVLDSVNRCDVDIRKELLSNILLSGGSSSILQIKERLEKEVLEESPQNARVKVLASGSSMERRFSVWIGGSILASLGSFQQMWFSKAEYEEHGVSYIQRKCP

SEQ ID NO: 40271 - protein, 276 aa, Pseudomonas aeruginosa
MGSSHHHHHHSSGLVPRGSHMHPYFSLAGRIALVTGGSRGIGQMIAQGLLEAGARVFICARDAEACADTATRLSAYGDCQAIPADLSSEAGARRLAQALGELSARLDILVNNAGTSWGAALESYPVSGWEKVMQLNVTSVFSCIQQLLPLLRRSASAENPARVINIGSVAGISAMGEQAYAYGPSKAALHQLSRMLAKELVGEHINVNVIAPGRFPSRMTRHIANDPQALEADSASIPMGRWGRPEEMAALAISLAGTAGAYMTGNVIPIDGGFHL

SEQ ID NO: 40272 - protein, 319 aa, Escherichia coli
MGWDTETKMSTYEKETEVMKKFSGIIPPVSSTFHRDGTLDKKAMREVADFLINKGVDGLFYLGTGGEFSQMNTAQRMALAEEAVTIVDGRVPVLIGVGSPSTDEAVKLAQHAQAYGADGIVAINPYYWKVAPRNLDDYYQQIARSVTLPVILYNFPDLTGQDLTPETVTRLALQNENIVGIKDTIDSVGHLRTMINTVKSVRPSFSVFCGYDDHLLNTMLLGGDGAITASANFAPELSVGIYRAWREGDLATAATLNKKLLQLPAIYALETPFVSLIKYSMQCVGLPVETYCLPPILEASEEAKDKVHVLLTAQGILPV

SEQ ID NO: 40273 - protein, 362 aa, Gloeobacter violaceus PCC 7421
MGGRYKIAVLPGDGIGTEIVQVGVAMLEAAARRFDFAFDFEEAPIGGAAIDATGEPLPAATLELCKASDAVFLGAVGGPQWDTLPSDKRPEKALLGLRAGLGLFANLRPARILPQLVAASALKPEVVEGVDILVVRELTGGLYFGIPKGIFPEKKGGRRGVNTMSYSAFEIERIGRVAFEAARERRGKLCSVDKANVLEVSQLWREVLVGLAPEYPDVELTHMYVDNCAMQLVRRPRQFDTIVTENMFGDILSDEAAMLTGSIGMLPSASLGSGGPGLYEPVHGSAPDIAGQDKANPLAQVLSGAMLLRHSLRQPEAAQAVERAVQTVLEQGYRTGDIAAPGAQIVGCRAMGEQLLAAFERA

SEQ ID NO: 40274 - protein, 702 aa, Arabidopsis thaliana
MTETKLFKVSSGEVSPLGVSQVDKGINFALFSQNATSVTLCLSLSQRYITSSGKDDTDDDGMIELVLDPSVNKTGDTWHICVEDLPLNNVLYGYRVDGPGEWQQGHRFDRSILLLDPYAKLVKGHSSFGDSSQKFAQFYGTYDFESSPFDWGDDYKFPNIPEKDLVIYEMNVRAFTADESSGMDPAIGGSYLGFIEKIPHLQDLGINAVELLPVFEFDELELQRRSNPRDHMVNTWGYSTVNFFAPMSRYASGEGDPIKASKEFKEMVKALHSAGIEKYSYKFSLQVILDVVYNHTNEADDKYPYTTSFRGIDNKVYYMLDPNNQLLNFSGCGNTLNCNHPVVMELILDSLRHWVTEYHVDGFRFDLASVLCRATDGSPLSAPPLIRAIAKDSVLSRCKIIAEPWDCGGLYLVGKFPNWDRWAEWNGMYRDDVRRFIKGDSGMKGSFATRVSGSSDLYQVNQRKPYHGVNFVIAHDGFTLRDLVSYNFKHNEANGEGGNDGCNDNHSWNCGFEGETGDAHIKSLRTRQMKNFHLALMISQGTPMMLMGDEYGHTRYGNNNSYGHDTSLNNFQWKELDAKKQNHFRFFSEVIKFRHSHHVLKHENFLTQGEITWHEDNWDNSESKFLAFTLHDGIGGRDIYVAFNAHDYFVKALIPQPPPGKQWFRVADTNLESPDDFVREGVAGVADTYNVAPFSSILLQSK

SEQ ID NO: 40275 - protein, 686 aa, Kluyveromyces lactis NRRL Y-1140
MSNATKSNDASPFIKRDQMRREFLRARQRSNNPKPIVKKEDPEQAAEEARKLLQPEALSRRVKREPGKSGYSEFPLRAIDMRDKENVKTNLVKFQSKKPIDPEDFHLPIRLHRKDTRNLQFQLTRAEIVQRQKEIAEFKQRQLEEAGGAGPGTGGSNSTPTASKGNSTGGSFSQSNGKPYNSKQGTPVPGTLNGPKVGVTNYNNTDGPNVNNNGSSSSELKTGTDSGSPPNGKEGTPSNTVTILEEAGVAEDPTKVGMVKYDGKAEPEIHEEGTIDPMADVAPHGGGRFRRGNSKRKTRQLKRLDEEAKRLRFEEFYPWVMEDFDGFNTWVGSYEAGNSDSYVLLSVEDDGSFTMIPADKVYRFTARNKYNTLTIEEAEKRMEKNKEGAPRWFMKHLDESSKTTTRYDRTLRRLRAVDGNTRQAEDDEDRGDNSEVELDYDEEFADDEEAPIIDGNEEENKESEQRIKKEMLQANALGLRDDDGEESDDELFGEKKIDEEGEKVKKALLKTDLGALYESDAEENPYLSHSEEDEEQADSDKKDSEKDNEKQSRRSSPKKKASDTPSGPPKLVVKSINQNIVVLTGEKSVLSNFPAGAWNPNLKKRPAESQPQESMDNKRAKSDHSADDLLTEDDIINAIEGKQLTLKQLIRQLKEKVGRHPDNKERMKVFVKKLVKLNGKFLELSK

SEQ ID NO: 40276 - protein, 411 aa, Israeli tick typhus rickettsia
DSEFAELKIRGKIFKLPILKASIGEDVIDISRVSAEADCFTYDPGFMSTASCQSTITYIDGDKGILRYRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKALGQLDNNPLLQIAIELEAIALKDEYFIERKLYPNVDFYSGIIYKAMGIPSQMFTVLFVIARIVGWMAQWKEMHEDPEQKISRPR

SEQ ID NO: 40277 - protein, 548 aa, Alteromonadales bacterium TW-7
MSNRTQLASWQALEQSAAKMKQTHLKTLFAQDGTRFSKFSTQIPGVLFDYSKQLIDNDVFANLVSLAKECDIASWRDKMFSGEKINITEERSVLHTALRNRAHTPLIVDGENVTQAVDNELAKIKVFVEKVRSGQWLGYTGKAVKDVVSIGVGGSNLGPQMATEALKALADNTLNVHYVSNADGVQIASVLKNIDPETTLFVISSKTFTTSETMTNAKTAVAWFLKTTKDESTIAKHFVAVSTNLEKTAAFGIADENVFTMWDWVGGRFSLWSAIGLPIALYLGYDAFEEILTGAFEVDEHFKNAPLEQNIPLIMALLSVWNTSFLGYTSQAILPYDQSLHMLPAYLQQGEMESNGKHVNFAGKVVPYTTVPIIWGMTGINGQHAFYQCLHQGNVIVPADFIASVKPQINVDKHHDILLSNFFAQTEAMMSGVDAEQVTADLTAKGKSQAQIDELLNHKIHQGNRPTTSMLLDTVDAKTVGRLIALYEHKIFCQGIILDICSFDQWGVELGKGLASKIESELTDDSVNHDHDSSTSGLMAYYKQHRTQ

SEQ ID NO: 40278 - protein, 386 aa, Kluyveromyces lactis NRRL Y-1140
MSTELEELVSFLHSDQPAVRQIALDNLVGFSTGASAVIFKCNNYKAIEDLKVLAKDKSKVIVQQSTTILANLCDDVTMRKLIVKDTEFLQYLSWKICDLANASADIMCILLSNLAKEDNITELFSFVKKEDDGIPLNIEVFKSNKVMDCLMDCFVKGYDRKLNRYATYDYLAYFFADISRFKIGREYFIEQQEYDGVIPISKLLVFTEKYDAKTRREGVAYTIKNSLFDSEKHENLLTNEEINLLPYILLPIASAKDSEIDEEDMFNLPDELQLLPADKERDPIPEIICVHLESILLLCTTKAGREYLRSKSVYPLVRELHKNIGNDDIGELSHRIVNMLMRGEPENQVIEEIVAKSAEDGEIAEIEEEEEEEESDDDDDAIVEVL

SEQ ID NO: 40279 - protein, 144 aa, Roseovarius nubinhibens ISM
MLVQQILKAKGDDKVITIKPGTLVSDAARILAERRIGGLVVSEDGKQIQGILSERDIVRSLAVRGATCLSDRIDDMMTRNPVCCARGDTSDQVLTRMTEGRFRHMPVVEDGELVGIVTIGDVVSSRLSELAMEKDALQGMIMGH

SEQ ID NO: 40280 - protein, 483 aa, Mycobacterium sp. JLS
MTYVPKWSTIPEMVLSAADRFGDAEAVVDGPLRFSFAEVVHRIRCAAGAFADLGIGKGDRVAIWAPNSAEWIIAAFGLLTAGGVLVPVNTRFKSEEAADVITRSGAKAVLVQQGFLGVEYAAPEGVPVIDLKSDFLAGGEPFSRTVDGSDISDIIFTSGTTGRPKGVMMNHRQNLRLYEEWCNLADLRQGDRYLMVNPYFHTFGYKAGLIASFIRGATMVPVPVFDVDRVVDLIAAERITMLPGPPTLYHSLLSVADKSKLATLRAGVTGAADIPVELVRRVLEELPFQTLATGYGLTEAGTATLSRPGDSFADIATTVGTACDGVEVRIADDGEVLVRGYSVMQGYLDDPAATAEAIDPHGWLHTGDLGTLDDAGRLRIVGRKKDMFIVGGFNAYPAEIEGFLLEHPDVAQAAVIGVPDERMGQVGKAFVVRREGHAEPLSAEGLIAWSRERMAGFKVPRYVEFLDELPLNATGKVMKDQLR

SEQ ID NO: 40281 - protein, 399 aa, Acidobacteria bacterium Ellin345
MANVTKKKGVIGILTGGGDVPGLNPAIRGVTFRALREGYDVIGLRRGWGGLVDIVRDKDHDNSENFVHLSETVVNRAARTGGTFLHTSRTNPSRVAKDKVPAHLQGQFNAEKNDLTSEMLKNLEWLGIDYLIPIGGDDTLSYGVRLYQEGVKVVAIPKTMDNDVPGTDYCIGFSTCVTRTIQMVNSLRTSAGSHERFLVVEVFGRYAGFTALLPTMAGAANRCVIPEFKFNIESLAELMANDRKRNPSRYSVVLISEGAMFEGGEMVFQSESTDAFGHKKLGGIGDLIAAKLTELSPKYCGKTVNCLTQKLGYLVRGGDPDAIDSIVPMAYGNLALDLILNKIHGRLVVLKNGRYDNVPVDVVTSSKKVIKVKEHYNTERLRPHYESFEMKPLFIMTSE

SEQ ID NO: 40282 - protein, 315 aa, Zea mays
MGEEEKAKEAAPPADKVKEAEEKKGEGGGGEEKKNEAPSLPPPPPEEVVMRVFMHCEGCARKVKKILKGFDGVEDVIADTKAHKVVVKGKKAAADPMKVVERVQKKTGRKVELLSPMPPPKEEKKEEEKKEEPEPPKTEKKEEATVLAVVLKVHMHCEACTQVIKKRILKMKGVQSVEADLKASQVTVKGVFEEAKLSDYVYRRTGKHAAIVKSEPVAAENVDDGNAKDDKKAAEGGEEKKDDGKEEKKDEDKKEADKQKDDGNAGDEGKDKDPGAVANMYMHYPRSNHLSEYGYAYQYPPQLFSDENPNACSLM

SEQ ID NO: 40283 - protein, 224 aa, Gossypium hirsutum
MAFVSEEEKTEDYLFKIVLVGDSAVGKSNLLARFARNEFYPNSKSTIGVEFQTQKLDINGKEVKAQIWDTAGQERFRAVTSAYYRGAVGALLVYDISRRQTFDSIGRWLNELQTHSDMNVVTILVGNKSDLRDAREVSTAEGKALAEAQGLFFMETSALDSSNVAAAFQTVVKEIYNILSRKVMMSHELKKQDAPLDGKTVVLQGDENQERATESPKSGGCCSS

SEQ ID NO: 40284 - protein, 422 aa, Sinorhizobium meliloti 1021
MTSLTDRKNAAISRGVGMTTQVYADRAENAEIWDKEGNRYIDFAAGIAVVNTGHRHPKVIAAVKAQLDRFTHTCHQVVPYENYVHLAERLNAIVPGDFAKKTIFVTTGAEAVENAVKIARAATGRQAVVAFGGGFHGRTFMGMALTGKVVPYKVGFGAMPADVFHAPFPIELHGVTVEQSLSALKKLFAADVDPARVAAIIIEPVQGEGGFYPVPTAFMKALREVCDQHGILLIADEVQTGFARTGKLFAMEHHGVAPDLTTMAKSLAGGFPLAAVTGRAEIMDAPGPGGLGGTYGGNPLGIAAAHAVLDVIAEENLCERANQLGNRLKQRLAAIREKAPEIVDIRGPGFMNAVEFNDVRTNLPSAEFANKVRLLALEKGLILLTCGVHGNVIRFLAPITIQDEVFAEALDTIEASILEARG

SEQ ID NO: 40285 - protein, 865 aa, Zea mays
  misc_feature (128)..(128): Xaa can be any naturally occurring amino acid
  unsure (1)..(865): unsure at all Xaa locations
LEKIHTLLPPLRCARVPASLPPPSFPSLKRPATLSLSLSLSLSLHPHSPSRPPPHLTNLAHAPPRKNLPDPATSTASASSSLPSQSRPRIASRAGQQHHQCSAADARTQCRRSRPPTWPEPPPPPPRXPLLLLHHLLLLADHAAAVRFDYASLTLGSLRLLGDAHLKNGTIRLSRDLPVPTSGAGRALYATAVPLRGGFSTQFAFTVATLNPSSVGGGLAFVLATDGATLGDAGAYIGVSVATDAAAVEFDTLMDAQFADPNGNHVALDLGSMVSAAAADLGAAGVVLPSGRTVNAWIDYRPSASPGSGGTLEVFVSYAPKRPPRPVLSAPLDLSEDVKDAAFVGFSAATQGSTEAHAIEWWSFSTASPAPPPRSAPPESPALPPPVSNQVLPGVTTTAPPPPPPIGSAAAPVGSIAPSGAAARRNAGQRPPVHAAVAGAATAGAFVAASFAGVALWVLARRARARRRQTALAVGTKRDSNVVSAAALARSPREFSYKELSAATRGFDASRVIGNGAFGTVYKGIVPDTGAMVAVKRCSSTGARGGGNASGEQARSEFLSELSIIAGLRHRNLLRLQGWCYEKGEILLVYDYMRNGSLDRALFDASAPVLPWRHRREALAGVASALAYLHHECERRVVHRDVKSSNVMLDEAYRARLGDFGLARQAEHGESPDATAAAGTMGYLAPEYLLTGRATECTDVFSFGVLALEVACGRRPIGAAGTAEGGNLVEWVWSLHGEARLLDAVDPRLGGEFEEGEARRVLLLGLACSSPEPALRPGMRAVVQVLGGEADPPFVPAARPSMSLSSANNQQLLLSLQDSVSDYNAMLGLALSDSSSDSLSSSSLTSTLRRGGHDIGFSSTAGDAR

SEQ ID NO: 40286 - protein, 421 aa, Klebsiella pneumoniae
MNTNSYPVVIIGGGQAGLAMSWSLTQKNIRHIVLERHRLAWAWREQRWDNFCLVTPNWQCKLPGFPYDGDDPHGFMLRDDIVAYLERYARSFNAPLREGVNVQRVVKRDSRFTLFTSLGELQADQVVVAVGNYHRPRFPELAARLPERIVQIHSAHYKSAQQMPEGEVLVVGSAQSGAQIAEDLHLAGRQVHLCVGSAPRVARFYRGRDVVDWLEDMGHYRLTVEDHPQGEEARRKTNHYVTGRDGGRDIDLRAFALQGMRLHGRLLAYADGKLHTADDLRANLDGADATAQKIKDSIDAWIAQQGIDAPVEARYQAPWQPDGPAEPIDLAAISAIIWAVGFHTDFSWIEVPAFDEKGYPRHQRGVSVEAGLYFLGLPWLWTWGSGRFEGVGDDALWQAEIIARRAGHIAAQEAVDANSAE

SEQ ID NO: 40287 - protein, 466 aa, Streptomyces avermitilis MA-4680
MSVSVPSSLPSALPPSVPALPPSDPQTLSRLLGDTDGLSVWPRSARPEADGDVCVGGVSLTEAADRFGTPVYVLDEQEVRERCRTYRTAFPEADVVYAAKAFLCRAMAHWVQEEGLGLDVCSAGELALAVTTGFPPEKIVMHGNAKSPEDLRTALRLGVGRIVVDSASEIARLAAITPCDTRQKVMVRVVPGIAAGGHTKIRTGTDDQNFGLSLTDGSAQHAITRILDQPHLELVGLHCHIGSQIAAVKPYVAAVRRMVGLMARVRDQHGVILPQLNIGGGHAIAYRPGDETMNVGVLAGRVRAELEDGCARARLPVPRLTIEPGRAVVGPAGVAVYRVLAVKRTGEHTFVAVDGGMSDNPRPALYGVRYAPRLIGRPSSAPSRFVTVVGRHCEAGDVLADGVALPGDVRPGDLLAVPAAGAYHLSMTSGYNLVGRPPVVAVSDGIARVLVRRESLDDMSRRDVGL

SEQ ID NO: 40288 - protein, 430 aa, Desulfotalea psychrophila LSv54
MSEKFATLSLDGKQYSLPIIESTTGEKAIDIRSLLKDTGHITLDRGFMNTASCFSSITYLDGDKGILNYRGYSIEDLAANCSFVEVSYLILHGELPNYQELEHFRHDMNRFALLHEDMIHFFDHFPPNASPMSILSTTINSLHNFYPEMTAKTDPYGGISVTTARLLAKVRTIAAFSYKKSNGYPLVYPSHKLNYCENFLNMMFDRPNIPYEIKPEVTAALNKLLILHADHEQNCSTSTVRLVGSAQVNLYASISAGVSALWGPLHGGANQAVIEMLEEIHESGDDYNYYIEKAKDKNDPFRLAGFGHRVYKTFDPRARIIKEACHEMLASMNVHDPLLDIAFELEERVLRDDYFISRNLYPNVDFYSGIIYRAMGIPTDMFTVMFALGRLPGWIAQWTEMHADPNTKIGRPRQIYTGYKQRAFVPMYER

SEQ ID NO: 40289 - protein, 598 aa, Coccidioides immitis RS
MVASHSGNARKPARSFPRTVHPTPSFPEVSLDYDDDPPQKNAWQRLLDSFKRNPHAQVSKLGQIDTNGKLFDLEEAVANIALSPLKRKLKGRHLQMIAIGGSVGTGLFVSSGRSLAIGGPASLVIAFSLVGIMVYSTIHALGEMAVLFPVAGSFSSFSTRFLDPAWGFAMGWNYALQWLVVLPLEIVAASLTVSYWPSHISPAAWVAIFYTMVITINLFGVQGYGEAEFIFSIIKVVAIVGFIILGIVINIGGGDNGSYIGFRYWRDPGAFNHGFKGLCSCFVNAAFAFTGTELVGLAAAEASNPVKALPSAVRQVFWRITLFYIVALIIVGLLVPYTEARLLNPASQADTKASPFVIAIRDAGIQGLDSVMNVVIMLAVLSVGNSAIYGSSRTLAALAEQHQAPRFLAYIDRRGRPLFAIIVASAIGLLSFLAASSKQEEVFIWMMAISGLSSILNWASICLAHIRFRRGWALQGHSLDELAFTSQPGVVGSWIGFIFNILVLMAQFWVGVAPIIQEMDGDPTVAGVKNWFSVYLAAPIVILFYVPYKIRFKTKIVRAKDMDLKTGRRDLHLAHLIAEERAERAEWPLWKKVYRFFC

SEQ ID NO: 40290 - protein, 261 aa, Streptomyces galilaeus
MPPAAERVAIVTGATSGIGLAVARSLAERGARVFVCARDGDRVAHTVKELREAGHDVDGASCDVRDTARVRAFVQEARDRFGPVDVLVNNAGRSGGGHTAQIPDELWLDVIETNLNSVFRMTREVLTTGGMLERGAGRIVNIASTGGKQGVALGAPYSASKHGVVGFTKALGLELAKTGITVNAVCPGYVETPMAERVRQGYAGAWDITEDEVLERFEAKIPLGRYSTPDEVAGLVGYLLSSTAASITAQAMNVCGGLGNY

SEQ ID NO: 40291 - protein, 204 aa, Glycine max
MASAGDVFRQGLPEVCAAGKLHVLAVDDSHVDRKVIERLLKISSCKVTVVESGSRALQYLGLDGEKSSIGLDSVKVNLIMTDYSMPGMTGYELLKKIKESSVFREVPVVVMSSENILTRIDSCLEEGAEEFLLKPVKLSDVKRVTDFIMRGEGMKGVKISKKRSRSDDCIPSLSTAFSSVSHPCDISSPPSPCVLQPKKSRLSI

SEQ ID NO: 40292 - protein, 411 aa, Rickettsia conorii
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMIKEIGSSEYIPKYIAKAKDKNDPFRLMGFGHRVYKNYDPRAAVLKETCKEVLKELGQLDNNPFLQIAIELEAIALKDEYFIERKLYPNVDFYSGIIYKAMGIPSQMFTVLFAIARTVGWMAQWKEMHEDPEQKISRPR

SEQ ID NO: 40293 - protein, 474 aa, Pseudomonas fluorescens PfO-1
MQTKLLINGQLVNGEGPAQPVLNPARGEVLVEINEATEAQVDAAVRAADSAFAEWSQTTPKDRSLLLLKLADAIEAHGEELAKLESDNCGKPYNAALNDEIPAIADVFRFFAGASRCMSGSAGGEYLPGHTSMIRRDPVGVIASIAPWNYPLMMVAWKIAPALAAGNTVVLKPSEQTPLTALRLAELASDIFPAGVLNLVFGRGPSVGSPLVTHPKVRMVSLTGSIATGSNIISSTADSVKRMHMELGGKAPVIIFDDADIDAAVEGIRTFGFYNAGQDCTAACRIYAQQGIYDKFVEKLGAAVSSIKYGLQDDPSTELGPLITAQHRDRVAGFVERAVAQPHIRLITGGKAVDGNGFFFEPTVLADAQQDDEIVRREVFGPVVSVTKFTDEAQALEWANDSDYGLASSVWTADVGRAHRLSARLQYGCTWVNTHFMLVSEMPHGGQKLSGYGKDMSMYGLEDYTTVRHVMFKH

SEQ ID NO: 40294 - protein, 550 aa, Xanthobacter autotrophicus Py2
MLGTMMDVPLLLSSILRHAEAYHSDSEVVSATVEGGLHRYTYGEMSKRSRKLANALARLGLKTGDRVGTLAWNGYCHLELYYGVSGSGFVCHTINPRLFREQIAYIIAHAEDSVLFFDLTFLPIVEELADQLKGLKALVAMTDEAHMPASQVLPGLQCYETLIAGEPDTFDWPAFSENTASGLCYTSGTTGDPKGVLYSHRSCVLHAMAIAMPDALGLSASDVVCPIVPMFHVNAWGLPFAAPMVGAKLVLPGAHLDGASLHALFEGEGVSFTAGVPTVWLGLLDWMDTHARSFSALKRVVIGGSAIPPIMISRFHNMGVEVRQAWGMTETSPVGLSAALKPKHRTLPPEERLALECKQGRPLFGMEFRVAGSGGSEVAHDGRSFGSMLVRGPWVAQAYFNTPTSAAHADYPGWFDTGDVVTMDQEGFIQIVDRTKDVVKSGGEWISSIDLENIAQAHPAIQEAAIVARPDARWGERPVLVAVLKPGATFSRADMRAHYEGKISKWCMPDDVLIVPELPHTATGKLSKKAIREIILDEIKHRSPDLGIGS

SEQ ID NO: 40295 - protein, 333 aa, Roseovarius nubinhibens ISM
MTITVGINGFGRIGRCTLAHIAQSTRDDIKVVKVNATGPLETAAHLLKYDSVHGRFANEITLGDGTMDLGRGPMQMFSTYDMDELDWSGCDVVLECTGKFNDGEKAKKHLERGAKKVLLSAPGKNVDRTIVFGVNDNELQASDTMISNGSCTTNCLAPVAKVLDDSFGIESGIMTTIHAYTGDQPTLDRRHKDLYRARAAAMSMIPTSTGAAKALGEVLPALKGKLDGSAIRVPTPNVSAVDLTFVAKTDVTEDEVNAAMRAAAEGPMKGVLGYDPEPKVSIDFNHTEESSIFAPAQTKVIGGRLVRVLSWYDNEWGFSCRMADVAVAMGKLG

SEQ ID NO: 40296 - protein, 487 aa, Glycine max
  misc_feature (181)..(181): Xaa can be any naturally occurring amino acid
  unsure (1)..(487): unsure at all Xaa locations
MDRPAAIFSDTVNLNGTVTQLSLLADGRLWWPEGGQRNLSIEKEVLGFTGDGPDIRLKTIVETEDGCCGGASRAKLVRNDVVFRPSSEETHRLWCQKLGEFIDSLGRPKRLFVFVNPFGGTKSAVIVFRDQVKPLLEDAQVQLTVQETKHQLHAKQVVQSLDFSKYDGIVCVSGDGILVEXVVNGLLQRQDWDTAIKMPLGVVPAGTGNGMAKSLLDSVGDPCTVPNAVLAIIRGRKRKLDVATITQGETRFFSVLMLAWGLVADIDIESEKYRWMGSARIDFYALTRILHLRHYIGCLYFVPAPGFEAYGDPTSYPGSSNNKGSNSELIDEEPLKLQRLGYQGPEIDLENQSWRVLNGPFISVWLHNVAWGAENTKAAPDAKFSDGYLDLIITKNCPKLPLLSLMSDLNNGGHVKSPYVMYLKVKVLVLEPGPRLGDQEKEGIIDADGEVLARGKGSYQCEQKALMAYDKLQITVDQGLATIFSPI

SEQ ID NO: 40297 - protein, 510 aa, Zea mays
  misc_feature (94)..(94): Xaa can be any naturally occurring amino acid
  unsure (1)..(510): unsure at all Xaa locations
MAYPAAPHTSAAFLASFATPLPARCASPPTRRRAVSAAAIATTTTCVFADAPRGIKEEQADSGAQAAAAAAARRDVSPDTVASIILGGGAGTRXLFPLTRTRAKPAVPVGGCYRLIDIPMSNCINSKINKIYVLTQFNSQSLNRHIARTYNFGEGVGFSGGSVEVLAATQTAGESGKKWFQGTADAVRQFLWLFEDARLKCIENILILSGDHLYRMDYMDFVQKHVDSGADISVACVPMDESRASDFGLMKADRNGHITDFLEKPKGADLESMQVDMGLFGLSPEFASTYKYMASMGIYVFKADVLRKLLRGHYPTANDFGLEVIPMAAKDYDVQAYLFDGYWEDIGTIKSFFEANLALTDQSPNFYFYDPVKPIFTSPRFLPPTKVLNSIVSHGCFLTECSVEHSVIGIRSRLEPGVQLKDTMMMGADYYQTEAERLSELSVGKVPVGVGENTKIRNCIIDKNARIGKNVVIMNSENVQEADRPAEGYYIRSGITVVLKNAVILNGTKI

SEQ ID NO: 40298 - protein, 364 aa, Oryza sativa (japonica cultivar-group)
MRKGAAGMACTCSAAAAASALVKLLVLVAAVAATTSAGGGDEPTYETKSIDPSLAVMTLPAPVTGPESLAFDGRGDGPYTGGSDGRILRWRGGRLGWTEFAYNSRHKSVGVCSPEKKLVVPESVCGRPLGLQFHHASGDLYVADAYLGLLRVPARGGLAEVVATEAAGVPFNFLNGLDVDQRTGDVYFTDSSTTYRRSQYLLVVAMGDETGRLLRYDARRRRVTVLHSGLPYPNGVAVSDDGTHVVVAHTGLCELRRYWLRGPRAGKSETFAEVPGYPDNVRRDGDGGYWVALSRGADNDDVAPTVAVRVTAAGKKKGGGAAVVAEALAGFSFVTVSEVAEQNGTLWIGSVDTPYAGAAVRGRR

SEQ ID NO: 40299 - protein, 495 aa, Pseudomonas fluorescens PfO-1
MAIQEKRSRKMAGAQTHMHTALLIDGELVAGQGFVEPILNPATGEVLTQIAEASTEQVEAAILAAHRAFAEWSRTTPQQRSNLLLEIANAVEKHADHLARLEALNCGKPLHLARQDDLTATIDVFRFFAGAVRCQTGQLSGEYVPGYTSMVRRDPIGVVASIAPWNYPIMMAAWKIAPALAAGNTLVFKPSEHTPLSILALAPALAEILPRGVINIVCGGGEGVGSHLVGHPKVRMVSLTGDIVTGQKILQAAAKTLKRTHLELGGKAPVIVCNDADLKAVVEGVRTYGYYNAGQDCTAACRIYAQAGIHDKLVAELGAAVSSLRFAGKRDADNEIGPLISTRQRDRVASFVERALGQPHIERVTGAAVHSGAGFFYQPTLLAGCKQSDEIVQREVFGPVVTVTRFDELAQAVDWANDSEYGLASSVWTQNLDKAMQVAARLQYGCTWINSHFMLASEMPHGGLKRSGYGKDLSSDSLQDYSVVRHIMARHGQHL

SEQ ID NO: 40300 - protein, 368 aa, Prunus armeniaca
MATLVEPPDGIRQRGKHYYSMWQTLFEVDTKYVPIKPIGRGAYGIVCSSINRATNEKVAIKKINNVFENRIDALRTLRELKLLRHIRHENVIALKDVMMPIHRTSFKDVYFVYELMDTDLHQIIKSSQPLSSDHCKYFLFQLLRGLKYLHSANILHRDLKPGNLLINANCDLKICDFGLARTSGGTGQFMTEYVVTRWYRAPELLLCCDNYGTSIDVWSVGCIFAEILGRKPIFPGTECLNQLKLIINVLGSQHEPDLAFIDNPKARKYIKSLPYSRGTHFSRLYPQADPLAIDLLQRMLVFDPTKRISVTEALQHPYMSGLYDPRCNPPAQVPINLDIDENLAEPMIREMMWHEMLHYHPEAAFVNA

SEQ ID NO: 40301 - protein, 963 aa, Arabidopsis thaliana
MLYIRKKMTSMIVKTTPELFKGNGVFRTDHLGENRMVSRSNRLGDGSNRFPRTGTIHCQRLSIAKTGLHRETKARAILSPVSDPAASIAQKRVFTFGKGRSEGNKGMKSLLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKEKKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQGEDVVAGIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTTNEGEWISMNGSTGEVILGKQALAPPALSPDLETFMSWADAIRRLKVMANADTPEDAIAVRKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 40302 - protein, 499 aa, Oryza sativa (japonica cultivar-group)
MGKAARWFRNMWGGGRKEQKGEAPASGGKRWSFGKSSRDSAEAAAAAAAAAAEASGGNAAIARAAEAAWLRSVYADTEREQSKHAIAVAAATAAAADAAVAAAQAAVAVVRLTSKGRSAPVLAATVAGDTRSLAAAAVRIQTAFRGFLAKKALRALKALVKLQALVRGYLVRRQAAATLQSMQALVRAQATVRAHRSGAGAAANLPHLHHAPFWPRRSLVRRWLNLADDIAMYMFDVDVVCWRWMQQERCAGDDTRSEHGVAAYSRRLSASIESSSYGYDRRPQDRGGGHRGGPSRGRRRRGGRAPPLLLDARWVRERRRGLVRQLHVVAAPVLPPRRRAAAPHRRPDVAPLPRLRLVRAGEGPAGDGAEHAAVRARAADADQERVRRRRRRRHPLVAAQLPELHVQHAVVRGRRCRSQSAPKQRPETGGAGAGGGRKRVPLSEVVVVESRASLSGVGMQRSCNRVQEAFNFKTAVVGRLDRSSESGENDRHAFLQRRW

SEQ ID NO: 40303 - protein, 797 aa, Synechococcus sp. WH 5701
MSNAPLLRLFEEVGIGAIAEVGGKNASLGEMIRELTSQGVRVPGGFATTAAAYRLFLKCNGLEVPLRAILGELDSGDLTALQQAGRRARELILGASLPPELVDAVAAAYAELGAGPVAVRSSATAEDLPDASFAGQQETFLNVRGEHDLLAACLRCYSSLFTDRAISYRQINGFDHLEVALSIGVQRMVRSDLGAAGVMFTIDTETGFRNAVLLNAAYGLGENVVQGAVNPDEILLFKPTLREGYAAIVSKRLGSKAIRMVYDDGGTVRNEPVPLSERVRYAISDEEALTLGRWACLIEDHYSARHGTATPMDIEWARDGESGELFILQARPETVESRRSGSVLCRWHLKPHHAELITHGRAIGASISSGRARVILNPSGIDRFEVGDLLVTERTDPDWEPILKKARGVITNQGGRTCHAAIIAREMGITAVVGCGDATERIQDGEAITISCAEGEDGMVYRGLLRYEKEEQKLEHLPPTRTRILMNVGNPEKAFRFAAIPCDGVGLARLEFIIANHIRVHPMALLQPERVSDPAEREAIASLTAGYDDPTEYYVDRLAQGMARIAAAFHPRPVVLRFSDFKSNEYARLLGGRAFEPIEANPMIGWRGAARYTSPGFRAAFGLECSALLRVRRQMGLRNTIPMVPFCRTPEEGERVLEEMARHGLVRGEDDLKVYVMCELPSNVIGAEAFSQHFDGFSIGTNDLTQLTLGIDRDSSLVADLFDERHPIVQEMIHLAIQTAHRCGRPIGLCGQAPSDYPEFARFLVNEGINSISLNPDAVIATRLAIAAIEAELAASS

SEQ ID NO: 40304 - protein, 433 aa, Candida glabrata CBS 138
MGVATLFAELLNGCLAKYSALFSMLAMFMALYTILRHLMNYRKPYEQRLSIRILIVVPIFCITCLLSVLFPFYARRFVDPIREVYEAVVIYTFFSLLITYLGGEYEIISRRGLKHQPVNHFVPLVGQLLKKVDISNPNDFLWIKRGILQYVWFKPIYSISMICIDIWGLKQFEIALVVLFNISVSLSLYELALFWKCLYQDLLPFHPWPKFLCVKLIIFVSYWQGLIIQVLGYYRLLGKSIEYKHSELGYIYRNALLCFEMIGFAYLHQKAFPWEDYSIKSIPMGARMKLRYAIRDCFGIQDLIWDSKQALNGNTYYNYRNFDPSVETSLLGGVNRDTRIDRINEGLRFTNNGESRYWIDYGAIESGAQVSESIRNTDSAKDISADWDDSIDTSRYVQADPNYPVVWNIAGARYTNSTAQLRNEIIGRSSSTN

SEQ ID NO: 40305 - protein, 404 aa, Candida glabrata CBS 138
MSVAATLIEKADLSIEDSNGCNAAKHHLSDPGNHPAEHFKKKMSPLRFKMRQFLTRYTDHQSETLANIQHTLRNPVLDVYFKYSALMGAHTFYIIALPIPIWFGHWELTRDLVYIFGYSIYLSGFLKDYWCLPRPRSPPVERITLSKYTTREYGAPSSHTANATGVSAYFLWRIWVESNFTLTSKALLSIGVMFYYLTLVVGRVYCGMHGLLDLYSGALVGLACFMGRIGFDYLFPTFKASEYNWVPVLSVIVSLFLLYKHIKPVDECPCFEDSVAFIGVVSGLDCSNWLIAKFNLNLVCSFIDFEPKNCLHILARLLVGVLTVIVWKYVISKPLVYFTLVKLVRLKDERKDYHERHEITKLAAECAEHIGVPNIELLGRFIIYAGVPSTVILVCPVIFKALQL

SEQ ID NO: 40306 - protein, 411 aa, Rickettsia prowazekii
NLEFAELKIRGKLFKLPILKASIGKDVIDISRVSAEADYFTYDPGFMSTASCQSTITYIDGDKGILWYRGYDIKDLAEKSDFLEVAYLMIYGELPSSDQYCNFTKKVAHHSLVNERLHYLFQTFCSSSHPMAIMLAAVGSLSAFYPDLLNFNETDYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSENIPKYVAKAKDKNDPFRLMGFGHRVYKSYDPRAAVLKETCKEVLNELGQLDNNPLLQIAIELEALALKDEYFIERKLYPNVDFYSGIIYKAMGIPSQMFTVLFAIARTVGWMAQWKEMHEDPEQKISRPR

SEQ ID NO: 40307 - protein, 197 aa, Petunia integrifolia subsp. inflata
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIVLVGTKLDLRDDKQFFIDHPGAVPITTAQGEELRKTINAPSYIECSSKTQENVKAVFDAAIKVVLQPPKQKKKKGKSQRACSIL

SEQ ID NO: 40308 - protein, 116 aa, Triticum aestivum
MGTNSSLGLSTSFLPGRDTRLRRRRRAAPAAVSFRTEAAYEELGAKVGKHGAKLVASGCKRCMVIGAVECQGCKGTGMNNTNSNMYERWKCFYCQGFGMTKCPTCGKGGLTPEHRG

SEQ ID NO: 40309 - protein, 160 aa, Oryza sativa (japonica cultivar-group)
MAVLVARQGRELQRYTSAGGRIVVGCIPYRVRSGGEMEVLVITSQKGHGMMFPKGGWELDESMDEAARREALEEAGVRGDTETSLGCWYYKSRRYDTTYEGFMFPLRVTDELLQWPEMSSRKRTWATVQQAMDGCQHGWMREALERLVSRHATNKLQSAL

SEQ ID NO: 40310 - protein, 354 aa, Nicotiana tabacum
MAADNIYDFVASNLLCTETKSLCFDDVDSLTISQQNIETKSKDLSFNNGIRSEPLIDLPSLSEECLSFMVQREMEFLPKDDYVERLRSGDLDLSVRKEALDWILKAHMHYGFGELSFCLSINYLDRFLSLYELPRSKTWTVQLLAVACLSLAAKMEEINVPLTVDLQVGDPKFVFEGKTIQRMELLVLSTLKWRMQAYTPYTFIDYFMRKMNGDQIPSRPLISGSMQLILSIIRSIDFLEFRSSEIAASVAMSVSGEIQAKDIDKAMPCFFIHLDKGRVQKCVELIQDLTTATITTAAAASLVPQSPIGVLEAAACLSYKSGDERTVGSCTTSSHTKRRKLDTSSLEHGTSEKL

SEQ ID NO: 40311 - protein, 606 aa, Silicibacter pomeroyi DSS-3
MDLRNIAIIAHVDHGKTTLVDELLKQSGAFRENQAVAERAMDSNDLERERGITILAKATSVEWRGTRVNIVDTPGHADFGGEVERILSMVDGVVLLVDAAEGPMPQTKFVTSKALALGLRPIVVLNKVDKPDAEPDRALDECFDLFANLGANDEQLDFPHLYASGRSGWADTDLDGPRKDLTALFELVVRHVPAPAQIARKDEPFRMLATTLGSDPFIGRILTGRVESGTLKAGETLKALSRDGTQIESFRASKILAFRGLGQQPIDVAEAGDIVTIAGMSKATVADSLVNPQVSEALPAQPIDPPTISVTFGINDSPLAGRDGKKVQSRVIRDRLMKEAESNVAIRVTDTPGGEAFEVAGRGELQMGVLIENMRREGFELSISRPQVLFREEDGQRLEPVEEVTIDVDDEYTGAVIEKVTGPRRGELVEMKPAGAGKTRIIAHVPSRGLIGYHGEFLTDTRGTGVLNRVFHGWTPHKGAIPGRRAGVLISMENGQSVAYALWNLEERGRMFIGPQTDVYEGMIIGEHSRDNDLEVNPLKGKKLTNVRASGTDDAVRLTPHIQFSLEEAIAYIDDDELVEVTPNTIRLRKRYLDPHERKRMARAAS

SEQ ID NO: 40312 - protein, 330 aa, Debaryomyces hansenii CBS767
MTGSSSQFQQLEKLGEGTYATVYKGRNRTNGQLVALKEINLDSEEGTPSTAIREISLMKELDHENIVTLYDVIHTENKLTLVFEFMDKDLKKYMEAHGNQGALDLKIVKSFIFQLLKGIMFCHDNRVLHRDLKPQNLLINNKGELKLGDFGLARAFGIPFNTFSNEVVTLWYRAPDVLLGSRAYTASIDIWSAGCIFAEMCTGKPLFPGTSNDDQLIKIFRLMGTPNERTWPGVSSYANFKNNWQIFVPQDLRLLIPNLDSMGLNLLSSLLQMRPDARITARQALQHPWFHEISNPNPLMQHLADPYQQLQQQLQQQAQQLQQMDPQTYR

SEQ ID NO: 40313 - protein, 347 aa, Catharanthus roseus
MMAVFFMFFLLLLSSSSSSSSSSPILKKIFIESPSYAPNAFTFDSTDKGFYTSVQDGRVIKYEGPNSGFTDFAYASPFWNKAFCENSTDPEKRPLCGRTYDISYDYKNSQMYIVDGHYHLCVVGKEGGYATQLATSVQGVPFKWLYAVTVDQRTGIVYFTDVSSIHDDSPEGVEEIMNTSDRTGRLMKYDPSTKETTLLLKELHVPGGAEISADGSFVVVAEFLSNRIVKYWLEGPKKGSAEFLVTIPNPGNIKRNSDGHFWVSSSEELDGGQHGSVVSRGIKFDGFGNILQVIPLPPPYEGEHFEQIQEHDGLLYIGSLSHSSVGILVYDDHDNKGNSYVSQLVIN

SEQ ID NO: 40314 - protein, 590 aa, Nicotiana tabacum
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMDLPSDSYLLYNIDDIPGDGNKKAKQRLPHSKEFRFLDKAAIKVQDPESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTTPLQRIAVGLILSIIAMVAAALTEVKRLNVAHLHGLTNDANAKVPLSVFWLVPQFLLVGAGEAFTYIGQLDFFLRECPKGMKTMSTGLFLSTLSLGFFFSSILVTIVHKVTVKNPWLADNLNQGRLYDFYWLLATLSVLNLMIFLFISRRYVYKEKRLAECGIEMEDSEPACH

SEQ ID NO: 40315 - protein, 590 aa, Nicotiana tabacum
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMELPSDSSLLYNIDDIPGDGNKKAKQRLPHSKEFRFLDKAAIKVQDPESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTSPLQRIAVGLILSIIAMIAAALTEVKRLNVAHLHGLTNDANAKVPLSVFWLVPQFLLVGAGEAFTYIGQLDFFLRECPKGMKTMSTGLFLSTLSLGFFFSSILVTIVHKVTGKNPWLADNLNQGRLYDFYWLLATLSVLNLMIFLFISRRYVYKEKRLAECGIEMEDSEPACH

SEQ ID NO: 40316 - protein, 336 aa, Streptococcus agalactiae
MVVKVGINGFGRIGRLAFRRIQNVEGVEVTRINDLTDPNMLAHLLKYDTTQGRFDGTVEVKDGGFEVNGSFVKVSAEREPANIDWATDGVDIVLEATGFFASKAAAEQHIHANGAKKVVITAPGGNDVKTVVYNTNHDILDGTETVISGASCTTNCLAPMAKALQDNFGVKQGLMTTIHGYTGDQMVLDGPHRGGDLRRARAAAANIVPNSTGAAKAIGLVIPELNGKLDGAAQRVPVPTGSVTELVAVLEKDTSVEEINAAMKAAANDSYGYTEDAIVSSDIVGISYGSLFDATQTKVQTVDGNQLVKVVSWYDNEMSYTAQLVRTLEYFAKIAK

SEQ ID NO: 40317 - protein, 173 aa, Populus nigra
MAASVDPLVVGRVIGDVVDMFVPAVKMSVYYGSKHVSNGCDIKPSLSVDPPKVTISGHSDELYTLVMTDPDAPSPSEPRMREWVHWIVADIPGGTNPTRGKEILSYVGPRPPVGIHRYILVLFQQKMPLGSMVEPPQNRSHFNTRLYAAHLDLGLPVATVYFNAQKEPANKRR

SEQ ID NO: 40318 - protein, 594 aa, Nicotiana tabacum
MALPETQQDSKALPDAWDYKGRPALRSSSGGWASGAMILGVEAVERLTTLGIAVNLVTYLTGTMHLGNATAANNVTNFLGTSFMLTLFGGFVADTFLGRYLTIGIFATVQAMGVTILTISTIIPSLRPPKCEQVGSSSCIPANSKQLMVLYIALYMTALGTGGLKSSVSGFGTDQFDDADKKEKGQMIKFFDWFFFFINVGSLGAVTVLVYIQDNLGREWGYGICACAIVIGLVVFLSGTRKYRFKKLVGSPLTQIASVIVAAWKKRHLELLSDSSLLFEIDDIFGEGNKKNKQKLPHSKEYRFLDKAAIKEDHDLESNGTNVVINKWKLATLTDVEEVKLLIRMLPTWATTIMFWTVYAQMTTFSVSQATTMDRHIGTFEIPPASLTVFFVGSILLTVIFYDRVIVPICRRFMNKPHGLTPLQRIFTGLVLSILAMIAAALTEVKRLKVAHLHGLTNDANATIPLSVFWLVPQFLLVGAGEAFTYIGQLDFFLRECPKGMKTMSTGLFLSTLALGFFFSSILVTIVHVVTGTTNPWLADNLNQGRLYDFYWLLAILSVLNLMFFLYFSRKYVYKEKRLAEMGIELEDDGPVCH

SEQ ID NO: 40319 - protein, 478 aa, Geobacillus stearothermophilus
MALPGGAAMNITIRLQFEKDIVSFSDIAAAIGKAGGDIVGIDVISSSKVHTVRDITVSALDTKQCDLIIEALKKIRGVKIVNVSDRTFLMHIGGKIETNSKIPVKTRDDLSRVYTPGVARVCTAIAEDPRKAYSLTIKRNTVAVVSDGTAVLGLGDIGPYAAMPVMEGKAMLFKEFAGVDAFPICLDTKDTEEIIQIVKAIAPAFGGINLEDISAPRCFEIEKRLKEELDIPVFHDDQHGTAVVLLAGLLNALKIVDKKLEDIKVVLTGIGAAGIACTKILLAAGVRNIIGVDRHGAIHRDETYENPYWQEYAQLTNPDNLKGSLSDVIAGADVFIGVSAPGILKVEDVKKMARDPIVFAMANPIPEIDPELAEPYVRVMATGRSDYPNQINNVLCFPGIFRGALDCRAREINEEMKLAAAKAIASVVTEDELNETYIIPSVFNSKVVERVRQAVVEAAYRTGVARKDNIPVGGYTGQ

SEQ ID NO: 40320 - protein, 648 aa, Flaveria trinervia
MISLNSSFLERSSVTGGSRTQSQSLRLSARRPVVTSMLNSNSLPERNVSVSVDSAVRDVNAPVAVEVDRSVGEKPFAAVGGGVEDMYGEDTATEDHYITPWSVSVASGYSLLRDPHHNKGLAFTEKERDAHFLRGLLPPVVVNHDLQVKKMMHNIRQYQVPLQRYQAMMDLQQRNERLFYKLLIENVEELLPIVYTPTVGEACQKYGSIFENSQGLFISLKDKGRILEILKNWPHKKIQVIVVTDGERILGLGDLGCQGMGIPVGKLALYTALGGVRPSACLPITIDVGTNNEKLLNDDEFYIGLKQKRAAGQEYAELMNEFMSAVKQNYGENLLIQFEDFANHNAFDLLEKYRTTHLVFNDDIQGTASVVLGGLISALKLVGGSLADQKFLFLGAGEAGTGIAELIALEISKQTNIPLEESRKKVWLVDSKGLIVRSRLDSLQHFKKPWAHDHEPVNEFLDAIKTIRPTVLIGSSGTGQTFTKEVVETMSSLNEKPIILALSNPTSQSECTAEQAYTWSEGRAIFASGSPFKPVEYNGKLYVSGQANNAYIFPGFGLGLIISGAIRVHDDMLLAASEAPAEQVTQEHFDKGLIFPPFTSIRKISAHIAAKVAAKAYELGLASRLPQPENLVAYAESCMYSPKYRIYR

SEQ ID NO: 40321 - protein, 197 aa, Triticum aestivum
  misc_feature (98)..(98): Xaa can be any naturally occurring amino acid
  misc_feature (115)..(115): Xaa can be any naturally occurring amino acid
  misc_feature (167)..(167): Xaa can be any naturally occurring amino acid
  misc_feature (185)..(185): Xaa can be any naturally occurring amino acid
  unsure (1)..(197): unsure at all Xaa locations
ARSAAIVMRAVRKTVDTGRTIVCTIHQPSIEIFESFDELLLMKRGGRIIYSGSLGPHSCNMIDYFEAIPCVPRIKEGQNPAAWMLNVSSNTTEYEIGXWDYAEIYRRSSLYKENXDLVDELGKPTPGIEDLHFPPIYWQNFSAQCMACLWEQRCAYWEKPGHNVARXLNTLSINYVGSCIWQTGXTIKQQQDYHIQP

SEQ ID NO: 40322 - protein, 541 aa, Oenococcus oeni
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVKDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLKWEPKY

SEQ ID NO: 40323 - protein, 481 aa, Cucumis melo
MATPSSSSPELPLKPIPGGYGFPFLGPIKDRYDYFYFQGRDEFFRSRITKYNSTVFRANMPPGPFISSDSRVVVLLDALSFPILFDTAKVEKRNILDGTYMPSLSFTGNIRTCAYLDPSETEHSVLKRLFLSFLASRHDRFIPLFRSSLSEMFVKLEDKLSEKKKIADFNSISDSMSFDYVFRLLSDGTPDSKLAAEGPGMFDLWLVFQLAPLASIGLPKIFSVFEDLVIHTIPLPFFPVKSGYRKLYEAFYSSSGSFLDEAEKQGIDREKACHNLVFLAGFNAYGGMKVLFPTLLKWVGTAGEDLHRKLAEEVRTTVKEEGGLTFSALEKMSLLKSVVYEALRIEPPVPFQYGKAKEDIVIQSHDSSFKIKKGETIFGYQPFATKDPKIFKDSEKFVGDRFVGEEGEKLLKYVYWSNERETVEPTPENKQCPGKNLVVLIGRIMVVEFFLRYDTFTVEVADLPLGPAVKFKSLTRATDMV

SEQ ID NO: 40324 - protein, 519 aa, Caulobacter crescentus CB15
MVVRTTACALIPVTLMSPATKGPTRTSRASTGRYGPMGRTPVASVSNAGPSAGMSADGGKVNMTFVAAIVAVATIGGFMFGYDSGVINGTQEGLESAFNLSKLGTGLNVGAILIGCAIGAFAAGRLADVWGRRTVMIISALLFVISAIGTGAAESSIVFIIFRLIGGLGVGAASVLCPVYISEVTPANIRGRLSSVQQIMIITGLTGAFVANYALAHTAGSSTAEFWLGLPAWRWMFWMQIIPAGVFFLCLLGIPESPRYLVAKGKDAQAEAILSRLFGAGQGAKKVEEIRASLSADHKPTFSDLLDPTTKKLRVILWAGLVLAVFQQLVGINIVFYYGSVLWQSVGFTEDDSLKINILSGTLSILACLLAIGLIDKIGRKPLLLIGSAGMAVTLGVLTWCFSTATTVNGALTLGDQIGLTALIAANLYVIFFNLSWGPVMWVMLGEMFPNQMRGSALAVCGFAQWIANFAISVSFPALAAASLPMTYGFYALSAVVSFFLVQKLVHETRGKELEAMQG

SEQ ID NO: 40325 - protein, 528 aa, Ashbya gossypii ATCC 10895
MPSDASTGYVDDQPGDEAYKRGALYKQTKARRADYDSDKEAKRPCTEDSDVALAGTSEEKEARLPKRKVAVMVGYCGTGYHGMQYNPPNRTIEAELFEAFVKAGAISRANSTDLKKNGFMRAARTDKGVHAGGNVISLKLIIEDPAIKDKINEHLPPGIRVWGISRVNKAFDCRKLCGSRWYEYLLPTYSFIGPKPNTYLARTIEQCGEAASEKPDRDQESLDFWEAFRKAVDEKFTQEEQDAIVNYVAPSKEDFDENSGLYQKVKQYKQMENAHRRSYRVSSAKLARFREAMKQYLGPHNFHNYTLGKDFKDPSTVRFMKDITVSRPFVIGEMKTEWVSIKIHGQSFMLHQIRKMISMATLVARCNCSPERIAQSYGPQKINIPKAPALGLLLESPVYEGYNKRLLEFGYEPIDFRNYQKEMDTFKMVHIYDKIYKEEVDENVFNAFFNYIDAFNQVTGAQGEPTKSHDPAKIQLSIIDFLLPCSSSPQENASPEAQKAPETPAGDNTISAEQPKTATEVPTTQSDA

SEQ ID NO: 40326 - protein, 498 aa, Coccidioides immitis RS
MFSDGVNRMPATSHQSFTSSSHAARPSPQPDAATSSSADAGARAASASITSSNPPRSNPPRRAPGPSSAPDEPRSSMASRSSLAPPSLPDRRRPSSQRHHSFQSSHSQQERHGDRPDAPAVTSQSSPSSPVSHPANRMSRSLGASADTPPERIKVRDLKHIQRFASEEVLSSSREGMATRPFQNSGRQYDIRSMPVIDVIEMIAGLLNKITATNDLQHEHIHRHIPSPECVASLSPQAASVLAFHGKNTPNIGLYDYLIRIYRYCPSSYEIFLCLLVYFDRMAEIVNKGYLQNLQRRHDGKNSQRPTSPAPPLTITPGGRSSHLITPPSSGVNAPLTHSEPPSPMIQDPQQPPASNADSMQVDNNNPDYTHDHNNDDADAVDFSHYFVVDSLNIHRLVIAGITCATKYFSDAFWTNSRYSKVGGIPLRELNHIELQFLLLNDFRLSISPDELQTYATMLVEFYIREILNQRKRLQEQTQGQIPQSPPGTPQTEIRAGA

SEQ ID NO: 40327 - protein, 421 aa, Typha latifolia
  misc_feature (30)..(30): Xaa can be any naturally occurring amino acid
  unsure (1)..(421): unsure at all Xaa locations
MLDCCEPLEKIKAEGITFGKVACLAHCAGXKVEAFRANQSTIDDFRKHVIQCTSSEDCHLVVSYSRKLFKQTGSGHFSPIGGYHSGKDMVLILDVARFKYPPHWVPLELLWEAMNTVDKATGCLRGFMLISRFQKASSSLYTLSCRHESWLSMVKYLIDDVPIILKSGSLGDAPSVLLLLIKSLPANAGDFIKWFAEVRRQEEGQSRISKEEKERLALKEEVLQQVYETELYKVVKNVLSSANSCCTNFSFPNNKDFLPEIAATVCCQGAALLTGKVGGKEEFCCKSTSVKCFTTNGNGPTTIISGTVVSDGKEQGVDMLVPVSPTKSSCCRSGLSNGVAIHPASDNVLTVLLLALPPRTWLDIEDKSLLAEIQGLVSTENLPDVLQHEVLHLRRQFDFLKRCKNNEVDDDPILPPHSQPF

SEQ ID NO: 40328 - protein, 326 aa, Streptococcus agalactiae A909
MSSYWNNYPELKKNIDETNQLIQERIQVRNKDIEAALSQLTAAGGKQLRPAFFYLFSQLGNKENQDTQQLKKIAASLEILHVATLIHDDVIDDSPLRRGNMTIQSKFGKDIAVYTRDLLFTVFFDLILESMADTPFMTINAKSMRKILMGELDQMHLRYNQQQGIHHYLRAISGKTAELFKLASKEGAYFGGAEKEVVRLAGHIGFNIGMTFQILDDILDYTADKKTFNKPVLEDLAQGVYSLPLLLAIEENPDIFKPILDKKTDMATEDMEKIAYLVVSHRGVDKARHLARKFTEKAISDINKLPQSSAKKQLLQLTNYLLKRKI

SEQ ID NO: 40329 - protein, 148 aa, Brassica napus
MPTVNVGRDRLFAALGESYTREEFDDLCFRFGIELDDVTTEKAIIRKEKHIEEEAGKDEETIYKIDIPANRYDLLCLEGIAQALRIFNKKQEIPTYRLSDVGKDNMLRMNVRSDQTSQIRPFVVCAVLRGVTFDEARYNSFIDLQDKL

SEQ ID NO: 40330 - protein, 653 aa, Gloeobacter violaceus PCC 7421
MHNILDLDLEKAGNSKPIGISLISPSISGEDMDILEVGAHPFVGDAGALKVRFGVYLPSITFAKGYEVLVRIIHKSDQFTPEIPPQDYFLTCRDDHPYDLWEATVELTSQPHPANHFGKPGVYLYRYQLRRHGEIVTLWFTDPFARETGVGELAAFHTPDTDPPFVWSDADFRVPPLDDLVVYELQVDEFNNDFAGLIEQLDYLEGLGVNCLELMPITSVRQEFDWGYGPLHFWAPEERYGGKRGFKQLVNACHERGIAVILDSVYEHVEDNFPYARVYRDSGEPNPIIGPFGEGFFGTQIDFAQPFAREYFLECNRYWLREHHVDGFRYDYVPGMYDGPLGQGYAKLVYDTYEDSLAEAQLAARFQDPAGFSRIIQCAEHLPDPRGILRQTFSNCAWQNELLNKVENMAGQRYVDDRFAHLLDTRLIGYPDTRDAEGLAMPVAPFQYFETHDHSRLITRYGLLPPLGGTGDIQYGDRRNFFKLQPFAIALYTCQGIPMLWQGQEFAENYTLPGGGNLRISFRRDIHWEFFYDEQGRALVRLYRILAKLRRQCPALRSRESFYFNEQSRPGDGVIAYLRRTPEDADAQVAVVCLNFSDSPHQIWLPFPSTGTYREQIDAASANPTYDIDVAVAGEFHKVEIPANYGRIYLHGG

SEQ ID NO: 40331 - protein, 956 aa, Arabidopsis thaliana
MTSMIVKTTPELFKGNGVFRTDHLGENRMVSRSNRLGDGSNRFPRTGTIHCQRLSIAKTGLHRETKARAILSPVSDPAASIAQKRVFTFGKGRSEGNKGMKSLLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQGEDVVAGIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 40332 - protein, 541 aa, Coprinopsis cinerea okayama7#130
MTIVLTPYWSNGVQKLKVQPTGKANRGLVPPAFDPAIHVQRALAQLRSKDKPLEKYIFLSGLKHDDAPLFYKLCLENMSEITPIIYTPTVGDACIQFSHIYRRPEGLYVSIKDKGQIKQVIANWPKIHEARISVVTDGSRILGLGDLGVNGMGISIGKLSLYVAGAGIRPESTVPITVDLGTNNETFLNDPFYLGLRQKRITGPEMDEFMDEFMHEMSMAFPKMMIQFEDFSTDNAFRYLERYRRKYPVFNDDIQGTGAVVLSGFLNAAQLSSDASGMPMSEHRILFFGAGSAGVGVATQLMSFFTLQGLSVEEARSRIWLIDSQGLVYDGRGRLAEHKKYFSRKDYNGPPMTNILDIIDYVKPTALLGLSTISGAFTPEVIQAMAAINPRPIIFPLSNPVRLSECSFADAVKYTNGNVLFASGSPFPEQQYGDHILYPGQGNNMYIFPGIGLGAILARASQVTDSMVEASSLGLANSLTEDERALDLLYPRVERIREISAHIARQVIRAAQKAGVDRSEALRKMNDAELLAFVKRKMWKP

SEQ ID NO: 40333 - protein, 172 aa, Brassica napus
PRGPTEGVMALIEEKWDDLVANMPLKICFPALEQEEWRIITGSDPKNTPWSYHNGGSWPPLLWQFTLACIKMEKLDLAKKAVAVAEKRLKEDQWPEYYDTKSGRFVGKQSRLYQTWTIAGFLASKKLIEQPEKASLLFWEEDYQLLETCVCGLNKSSGKKKNKCSRFTPPRS

SEQ ID NO: 40334 - protein, 250 aa, Candidatus Desulfococcus oleovorans Hxd3
MTMPGHQKRVVVVTGGSRGIGRAICLAFADAGTRVYVNYAASVDQAEETKKQVEARGGSAVCIQADVSREADVTALFKTVVAESGRIDVLVNNAGISRDGLVPRMSGADWDDVMAVNLRGAFFCIKAASRQMLKQRGGRIINITSVVGFSGNAGQANYAAAKAGLAGLTRSVALEFASRNITVNAVAPGLVNTDMAAGLSDQDRERIAEKIPLGRMGTSDDVAGVVAFLASDAAAYITGQVVHVNGGLYL

SEQ ID NO: 40335 - protein, 539 aa, Silicibacter pomeroyi DSS-3
MFQDLHALHTRTSGRRILDLFAADLRRAERFSADLGEMRLDYSKTQIDDAIRAGLIALCDRAQLADKREAMFAGAPINETEGRAVLHTALRNLDGGPVHVDGAEVMADVRLTLARMRRFAEALRSGALPGAGGAITDVVNIGIGGSDLGPAMAVLALAPYHDGPRCHFVSNVDGAHIADTLRGLDPARTLVIVASKTFTTIETMTNARTARDWMQRGGGDPERQFAAVSTATDRTAAFGIPGDRVFGFADWVGGRYSLWGPIGLSLMIAIGPDDFDAFLRGAQEMDRHFQSAPWEKNLPVMLALTGIWHHQICGHPSRAVLPYDQRLARLPAYLQQLEMESNGKSVAMDGTALDQAAGPIVWGEPGTNGQHAFYQLIHQGKQVVPCEFMVAARGHEPDLAHHHRLLIANCLAQSEALMRGRPLDEARAIAAARGVAGDELERQARHRVFAGNRPSTTLIYPRLTPAMLGRIIALYEHRVFVEGVILGINSFDQWGVELGKELATSLGPVVDGTESAAAKDGSTAALVDYVLAHRDTDLT

SEQ ID NO: 40336 - protein, 270 aa, Trichodesmium erythraeum IMS101
MTISTSKTLSLDWSIIGFMAFLHIGALFALFPSNFSWTAVGLALLLHWVTGGLGITLGFHRMLTHRSFKTPKWLEYFFIFCGTLACEGGVCDWVGLHRIHHQHSDNEQDPHDSHRGFWWSHMGWMLHKLPMKSEISRYTKDIANDPVYKFLQANFILIQFAFGILLFFIGGWSFVVWGIFVRIVAVFHCTWLVNSATHKFGYRTYDSGDSSTNCWWVAVLTYGEGWHNNHHAFQYSARHGLKWWEIDTTWMMIQLLQAFGLATNVKLATK

SEQ ID NO: 40337 - protein, 396 aa, Synechococcus sp. WH 5701
MLGDMPNLLDQLASMTVVVADTGELEAIKQFTPRDATTNPSLILAAAQIPLYQRLIDESLKASRTVIGATAPAEAVVLEALDEICVTFGKEILQIVPGRVSTEVDARLSYDTEATIEKARKLIGLYADAGISKERVLIKIASTWEGIKAAEALEKEGIHCNLTLLFSFTQALACAEAGVTLISPFVGRILDWYKQDTGREYYPGPEDPGVISVTKIFNYYKTYGYRTEVMGASFRNIEEIIELAGCDLLTISPKLLDQLRQTEAPLPRKLDPLNPGSTEAQFSLDRSSYVTAMAADRMASEKLDEGIRGFSKAIETLEAQLAHRLAELEGEAAFAHAAQEIFLLNDMDGDGCITREEWLGSDAVFDALDTDHDGRLVPEDVRGGLGAPLALAAVAA

SEQ ID NO: 40338 - protein, 879 aa, Penicillium marneffei
MFTSPTESEFSVNNDGLDSVRSWDEKKVADWLHSIRCAQYEPLFKANNFNGDNLLECDQKILQEIGIKKIGDRVRIFVAIKQLRNKALINLKKNNKDPLAALEATAYAPLSNDVYSSSNSRNPLTSKWSRQLDSIGGRSNSRPSSPLTMDDRSRAFRYASNPIDGPRMPGYFSHPSSAGSGSGRHPITPGDSSQFSHLRQNPSIDGYTIGSLPANSHVIRIIYTGGQTKAMNVKGCKNTEEIMVHVLRKLQLPEYQHRSYCFYVLDGLEPDPANCRRVTDSELMRICEGSQKSERGRLILRKIHAGEPDADELRRAAQLALDESQATHLNALSSSNARNQLKIQQLTGEPWHHIKQPISPLTSERSRHLANDEHEASPTSAGMERPSASKLRSFFGARPPSEMIIHELTSYFPSHQREDIEKTMRMSVRRSQRLSRAASRLSVVSNISFASSMKDAPPIPSIADTWLTGGQLARPSRPLSVARSHLPQVSYRDSIASSSLQPLQEESPIEPDRKSYVSFGSGSDPVLGDANSAQRSFLDETLSVAATDGGGSLNERLSMIVAEDGEEEDTGLADFLNGDNFAAKNWMKGSLIGEGSFGSVFLALHSITGELMAVKQVELPSATKGTEFDKRKNTMVTALKHEIELLQGLHHPNIVQYLGTSADDHNLNIFLEYVPGGSIAEMLKQYNTFQEPLIKNFVRQILAGLSYLHSRDIIHRDIKGANILVDNKGGIKISDFGISKRVEASAMLGSSAVSGRGHLHRPSLQGSVYWMAPEVVRQTAHTKKADIWSLGCLVVEMFIGAHPFPDCSQLQAIFKIGNNQARPPAPEHASEEARAFLDVTFEINHEKRPSADELLESCEMSLCMGFGLLGSEMLYNEID

SEQ ID NO: 40339 - protein, 559 aa, Penicillium marneffei
MADAFKPRTMKRKNVKGLALNSTPKPASAPSEGDAQVPGAVGNTESTRSDTLEIGLEFKLDLRSEDLVTLKEVGAGNGGTVAKVMHATTKVVMARKIIRVDVKENIRKQILRELQVGHDCNSPYIVTFYGAFQNESRDIVLCMEYMDCGSLDRISKEFGPVRIDVLGKITESILAGLVYLYENHRIMHRDIKPSNVLVNSRGNIKLCDFGVATETVNSVADTFVGTSTYMAPERIQGGAYTVRSDVWSVGLTVMELAVGRFPFDATDSAAGDRASAGPMGILDLLQQIVHEPAPKLPKSDAFPPILHEFVAKCLLKKSEERPTPRELYDKDAFLQAAKRTPVDLQKWARKMMHAQDRHSYLEPPAPASLKTATTTTSSSPSPDMTPRDTPATTVSAAPSHPTPTFGDIPLRNEVTSAHKQHFSPSSHHIPTSHHGDYSNHNQYAQQQPQHASHNSRSSQSSSRQQSPYLSLEHLSLESEEARNGRGRSPRTYSGEPRSAIDPPSRPHFPRALSSNHQGGLHTATLPMGAAPPPSGPLPPPPQSAGEAWRNQYRARENMT

SEQ ID NO: 40340 - protein, 478 aa, Caulobacter crescentus CB15
MTDTLRHYIGGERVAADAPAESLNPSNTNDVVAKVPMGGQAEVDAAVDAARKAFPAWADASPEVRSDLLDKVGSTIIARSADIGRLLAREEGKTLAEGIGETVRAGRIFKYFAGEALRRHGQNLESTRPGVEIQTYRQAVGVYGLITPWNFPIAIPAWKAAPALAFGNTVVIKPAGPTPATANVLADIMAECGAPAGVFNMLFGRGSMGDALIKHKDVDGVSFTGSQGVGAQVAAAAVARQARVQLEMGGKNPLIVLDDADLERAVAIALDGSFFATGQRCTASSRLIVQDGIHDKFVALLAEKVAALRVGDALDPNTQIGPAVSEDQMETSYRYIDIAASEGGRVVTGGDRIKLDNPGWYVRPTLIADTQAGMRINNEEVFGPVASTIRVKSYEEALEIANGVEFGLSAGIATTSLKHARHFQRYARAGMTMVNLATAGVDYHVPFGGTKSSSYGAREQGFAAVEFFTQTKTSYSWS

SEQ ID NO: 40341 - protein, 715 aa, Penicillium marneffei
MAQGQNSTHGGSRKISFNVSDQYDIQDVIGEGAYGVVCSALHKPSGQKVAIKKITPFDHSMFCLRTLREMKLLRYFNHENIISILDIQRPRSYDSFTEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKHLFPKTTDLALDLLEKLLAFNPAKRITVEEALRHPYLEPYHDPDDEPTADPIPEEFFDFDKNKDTLSKEQLKLCRDNPGSSFTLTQSDLELNPSRYGIKHSKISRSPPTLSELAEKLQGSLSANYERSSVTVVPCLDLREPPFLLAHEGLSGDEKVADVGGQTHLYPRPMRDKTYALISISREMEIEVGESHEQVMIIGAGAGSSDIVGQNCEMAINFGWRYGGGGGGGGGGGGGVPQGSWRHNGGRYVKIEPGTDSVLLEKTDSARWWFGLMGNLFASDGGPGDVLKITARKRVGEEGSFTECIRKALHAAYGDSQIVSLGGVFVIKSGKARYHIMPDFPPEELPFRDRQRFNDWLTYHDFKGPMTCLTVLHSVDPDKKLGLRMEHTHALSTVGENAGGHYHYDVEEEKEEIEYEGYFNTAKALYRIDKPEFSLEQVLQK

SEQ ID NO: 40342 - protein, 386 aa, Rickettsia aeschlimannii
DSEFAELKIRGKIFKLPILKASIGEDVIDISRVSAEADCFTYDPGFMSTASCQSTITYIDGDKGILRHRGYDIKDLAEKSDFLEVAYLLIYGELPNGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEVVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAI

SEQ ID NO: 40343 - protein, 555 aa, Porphyromonas gingivalis W83
MKSDIQIARDIELQRIEQIAESIDLPVEQLEPYGRYTAKVPLSCIDEEKVKKGNLILVTAITPNKAGVGKTTVSIGLALGLNHIGKKAIVALREPSLGPCFGMKGGAAGGGYAQVLPMENINLHFTGDFHAVTSAHNMITALLENYIYQNRNTCDGLSEILWKRVLDVNDRSLRNAVTGLGTISDGIPRQTGFDITPASEIMAILCLAKDFEDLRSRLENILLGYTKEGAPFTVKDLGIAGSIAVLLKDAIKPNLVQTTEHTPAFVHGGPFANIAHGCNSILATKMALSFGEYAVTEAGFGADLGAEKFLDIKCREMGVAPKLTVLVATLRALKLHGGVAETEIKAPNAEALRRGLSNLDRHIYNLKKFGQQVIVAFNRFDTDEEEEISIVREHCIGQNVGFAVNNAFAEGGKGAEELAKLVVEMVENKPSQPLKYAYEPENPVKMKIEKIAKEIYSAGSVVYSSKADGKLKKIAMQSLDHLPVCIAKTQYSFSSDPKAKGDVRGFELKVSDIIINRGAGMLVVIIGEIMRMPGLPKEPQAVHIDIVDGFIEGLS

SEQ ID NO: 40344 - protein, 427 aa, Arabidopsis thaliana
MHSPLQTQQPEQRCWPMTSTVSEIEEVLPDEDSDRTTLLNGEPLRRRVSGKSPVDEGPRRIFRQQSFGRDIGHAAAETYLITGLSFKLLRYLGVGYRWMTKLLALTCYAMLLMPGFLQVAYSYFFSKQVRRSIVYGDQPRNRLDLYLPSNNDGLKPVVVFVTGGAWIIGYKAWGSLLGMQLAERDIIVACLDYRNFPQGTISDMVTDASQGISFVCNNISAFGGDPNRIYLMGQSAGAHIAACALLEQATKELKGESISWTVSQIKAYFGLSGGYNLYKLVDHFHNRGLYRSIFLSIMEGEESFEKFSPEVRLKDPVVGKAASLLPPIILFHGSSDYSIPCDESKTFTDALQAVGAKAELVLYSGKTHTDLFLQDPLRGGKDELFDDIVSVIHAEDNDGLTKDSLAPPRKRLVPELLLKLAREISPF

SEQ ID NO: 40345 - protein, 167 aa, Citrus unshiu
MASADVEFRCFVGGLAWATTDSSLHEAFSAYGDILESKIINDRETGRSRGFGFVTFRDEKSMRDAIEGMNGQNLDGRNITVNEAQSRGSGGGGGGGYGSRGGGGYGGGGRRESGGGGGYGGSRGYGGGGGGYGGRREGGYSRDGGYGGDGGSRYSRSGASDGGSWRN

SEQ ID NO: 40346 - protein, 504 aa, Arabidopsis thaliana
MAGGALTDEGGLKRAHLYEHRITSYFIFACIVGSMGGSLFGYDLGVSGGVTSMDDFLKEFFPGIYKRKQMHLNETDYCKYDNQILTLFTSSLYFAGLISTFGASYVTRIYGRRGSILVGSVSFFLGGVINAAAKNILMLILGRIFLGIGIGFGNQAVPLYLSEMAPAKIRGTVNQLFQLTTCIGILVANLINYKTEQIHPWGWRLSLGLATVPAILMFLGGLVLPETPNSLVEQGKLEKAKAVLIKVRGTNNIEAEFQDLVEASDAARAVKNPFRNLLARRNRPQLVIGAIGLPAFQQLTGMNSILFYAPVMFQSLGFGGSASLISSTITNAALVVAAIMSMYSADKFGRRFLLLEASVEMFCYMVVVGVTLALKFGEGKELPKSLGLILVVLICLFVLAYGRSWGPMGWLVPSELFPLETRSAGQSVVVCVNLFFTALIAQCFLVSLCHLKYGIFLLFAGLILGMGSFVYFLLPETKQVPIEEVYLLWRQHWLWKKYVEDVDE

SEQ ID NO: 40347 - protein, 498 aa, Gluconobacter oxydans
MNVVSKTVSLPLKPREFGFFIDGEWRAGKDFFDRSSPAHDVPVTRIPRCTREDLDEAVAAARRAFENGSWAGLAAADRAAVLLKAAGLLRERRDDIAYWEVLENGKPISQAKGEIDHCIACFEMAAGAARMLHGDTFNNLGEGLFGMVLREPIGVVGLITPWNFPFMILCERAPFILASGCTLVVKPAEVTSATTLLLAEILADAGLPKGVFNVVTGTGRTVGQAMTEHQDIDMLSFTGSTGVGKSCIHAAADSNLKKLGLELGGKNPIVVFADSNLEDAADAVAFGISFNTGQCCVSSSRLIVERSVAEKFERLVVPKMEKIRVGDPFDPETQIGAITTEAQNKTILDYIAKGKAEGAKLLCGGGIVDFGKGQYIQPTLFTDVKPSMGIARDEIFGPVLASFHFDTVDEAIAIANDTVYGLAASVWSKDIDKALAVTRRVRAGRFWVNTIMSGGPETPLGGFKQSGWGREAGLYGVEEYTQIKSVHIETGKRSHWIS

SEQ ID NO: 40348 - protein, 239 aa, Oceanicola granulosus HTCC2516
MRLEGKVAIVTGASRGIGLGIVEAFAAAGAKVIAGSRKLPEAGYPDGVQGVELDVADPDHWARVTDAVLAEHGRIDVLVNNAGIIAYEPLEELDLESWHRVVGVNQTGVFLGMKSVIPAMKKQGKGSIINVSSIWGNAAVPGAHAYHATKGAVLMMTRNAAITYVGDGIRVNSMLPGFIDTPLTQSQDPEVNKYVVGLTPLGRAGTPAEIANGCVFLASDESSFMTGADLVIDGGYLAQ

SEQ ID NO: 40349 - protein, 512 aa, Arabidopsis thaliana
MEISVASVTVSVAVVVVSWWVWRTLQRVWLKPKMLESYLRRQGLAGTPYTPLVGDLKRNFSMLAEARSKPINLTDDITPRIVPYPLQMLKTHGRTFFTWFGPIPTITIMDPEQIKEVFNKVYDFQKAHTFPLGRLIAAGLVSYDGDKWTKHRRIINPAFHLEKIKNMVPAFHQSCSEIVGEWDKLVTDKQSSCEVDIWPWLVSMTADVISRTAFGSSYKEGQRIFELQAELAQLIIQAFRKAIIPGYRYFPTKGNRRMKAAAREIKFILRGIVNKRLRAREAGEAPSDDLLGILLESNLGQTKGNGMSTEELMEECKLFYFAGQETTTVLLVWTMVLLSQHQDWQARAREEVKQVFGDKEPDAEGLNQLKVMTMILYEVLRLYPPVVQLTRAIHKEMQLGDLTLPGGVQISLPILLIQRDRELWGNDAGEFKPDRFKDGLSKATKNQVSFFPFAWGPRICIGQNFALLEAKMAMTLILRKFSFELSPSYVHAPYTVLTTHPQFGAPLIMHKL

SEQ ID NO: 40350 - protein, 350 aa, Synechococcus sp. WH 5701
MTMLADGRSLDVVGIGNAIVDVLVSSNDAFLEEHGLSKGGMALVDAEQAQQLYAAAGPGLETSGGSAANTLAGLAMLGARAGFIGRVRDDQLGAIFSHDIRSVGARFETPAASSGAATARCLILVTPDAQRTMCTYLGASVDLEPADLDLDLVRQAGMLYLEGYLWDGEAAKRAFLAAAEVMRAAGGQVALSLSDAFCVERHRESFLELVDGHVDVLFANEAEITALYQCDGFEAAMEQVRGRCSIAVLTRGALGSVVLGGGEVHRIDPYVLGPLVDTTGAGDLYAAGFLYGLSRGEPLQRCGQLGSLCAGQVITQLGPRPRASLPQLVAEHLGTPPAPATAPVATGLPR

SEQ ID NO: 40351 - protein, 511 aa, Geobacillus stearothermophilus
MSKKPVALIILDGFALRDETYGNAVAQANKPNFDRYWNEYPHTTLKACGEAVGLPEGQMGNAEVGHLNIGAGRIVYQSLTRINIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVAGYVAFKPTNLDNTIGEVLSQHGLRQLRIAETEKYPHVTFFMSGGREEEFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 40352 - protein, 476 aa, Caulobacter crescentus CB15
MTQFSDLGLAKPLLKALAEKGYKEPTPIQAQAIPVVLQGKDLLGIAQTGTGKTAAFALPILQRLAEDRKPAPRRGCRCLVLSPTRELATQIAENFKAYAVHMGLSVHTIYGGVKYGPQMKALAGGIDVLVATPGRLMDHMAEKSAIVSGTEIFVLDEADQMLDLGFVVPIRKIAAQLTKNRQNLFFSATMPSEIGKLAGELLNNPVQVSVAPQATTVERIDQRVLFIEAQRKRPLLAELFADTSFSRTIVFTRTKRGADRVAKYLNAAGIEAASIHGDKTQGQRERALAAFKAGEMRALVATDIAARGIDVNDVSHVINYELPNVPEAYVHRIGRTARKGKDGIAISFCADDERNLLKDIQKATRQTIPSFDRRNDKQLAAAAAVADKLVPAEKYVDPRKADPRNNVPSELRRKRNRNGGGGGGGRAEGAQKAQGRGPGQGKAGAKPGQKAGPGQNEFRGPKRQSATAEKRWSPID

SEQ ID NO: 40353 - protein, 414 aa, Oryza sativa (japonica cultivar-group)
MVGGSPMQAVLMAPGVKDKKVLAFKRGKGKDADAGVTALIRDIVAGGARSAFHVFDLAKVVDLHRGWRRALPDVRPCYAVKCNPDGAMLAALAALGAGFDCASRAEIEAVLALGVRPATIVYANPCKPEAHLEYAAEVGVNLTTYDSEEEVAKVRRCHPRCELLLRIKAPDSGDAKVDLGLKYGANPDEVLPLLRAAQREGVAVAGVSFHVGSGASRADVYRGAIEAAREAFDAAAALGMPPMRVLDIGGGFMAGRTFDEAAAVINRALERHFGDLPCVEVIGEPGRYFAETAFTLAARVIGKRTRGELREYWIDDGLYGSLNCILMDHYVPRPRPLAAAAAGEDTTAATTHASTVFGPTCDSLDTVVTGYQLPEMSVGDWLVFDDMGAYTTAAGSNFNGFATSAIKIHLAYSS

SEQ ID NO: 40354 - protein, 491 aa, Treponema denticola ATCC 35405
MNSITELFPSDFTDDEKALAKTHFLKKLSVLTHSFYGGKLQTVPKCGLYGFNWFNVWYTPGVSAISTTIRDDNETSFALSNKGNLVAVVSDSTRVLGDGDCTPPGGLGVMEGKCMLMKYLGGVDSYPLCIDSIVRVDEEGKRGVKAGKHDPDKIIDFVRMLEPSVGAVNLEDIQQPDCFKVLDTLREVCEIPVWHDDAQGTACITLAGLLNAIKLAGKKMEDCKIVLLGAGASNTTIARLILADGGKPENMIICDSRGALHSGRKDIEEDKRYYRKWELCLQTNPKKIETFDEAMKGADVLIALSTPGPNTVTKEQVASMNKKAIVFTCANPIPEIWPHEAKAAGAFIVGTGRGDFPNQINNSVCFPGILKGALLVRAKKISDGMAIRCSHSIADYSEKKGINPDNIVVTMQDEDVFAVEAADVAMQAIKEGLARVTMTWDEAYKKAKKDIEESRSLTKMLMEKNFIKEPPQEFYEKALEYAIEQIKKNRK

SEQ ID NO: 40355 - protein, 747 aa, Oryza sativa (indica cultivar-group)
MSCQRKCGDIEVPFPFGIDGDQPGCAKPGFELSCGNNTESGVPILLRKVQPLSRSVEVLGISLPKGQLRMRMHMSSHCYNMTTRVMDCVDNGWMDLTGSPFTFSDSANKFTAFGCQVLAYLGAGEQRDIGSNLRIGCAASCGKDDSATIGGGRCSGIGCCQTAIPKGIKYYKAWFDDRFNTSSMYTWNRCAYAALVEESSFNFSMIYDSSSKFNSDTVSSQPPFVVDWVMGNISCKEARKNLGTYPCISNNSICLDSQNGPGYICNCRKGFQGNPYNKGLDSCQDINECDDPKKYPCYGKCINKLGGFDCFCPAGMRGNASVGPCRKDFPLGIGIAIGLGVGFGILLLSLSVVFLIRKQRSDIQRQLRKKYFQKNKGLLLEQLISSDERASDSTKIFSLEELKEATNNFDPTRVLGSGGHGMVYKGILSDQRVVAIKKPNIIREEEISQFINEVVILSQINHRHIVKLFGCCLETEVPLLVYDFVPNGSLNQIIHADKSNRRFSLSWDDCLRIATEAAGALYYLHSAASVSVLHRDVKSSNILLDSNYTAKVSDFGASRLIPNDQTHVFTNIQGTFGYLDPEYYHTGHLNEKSDVYSFGVVLLELLLRKQPIFDDGTGTKKNLSIYFLSEIKGKPITEIVAPEVIKEAIEDEINIFASIAQACLRLRGEERPTMKQVEISLQSIRNKVLSSGSASSESNHEIETPLCESYVDLHQTMGVDINGIANLISSNCYSLEHEFMLSASFGR

SEQ ID NO: 40356 - protein, 488 aa, Oceanicola granulosus HTCC2516
MAAAANVAVALPSGQLYIDGAWVAGEGEFEVTNPADGSRVGAVAHATSAHALRALDAAEAAQAAWGRLAPRARADLMHRAYRLMLDQEDAFARIMTLESGKPLSESRAEFKLSADFLLWFAEQTAHVHGSYAESSHGGFRVMVHHQPIGPCLLITPWNFPLLMIVRKAGAALAAGCTAVVKTAQETPFTGALFTQVLHDAGFPSGVVNLLHTRTSSEISAPLLKDRRIRKVSFTGSTGVGALLMEQGARNIVNCSMELGGDGPFVVLDDADIDLAVAQAVICKFRNAGQACVAANRIIIDKKVEAEFTEKFIAKVKALTVGNGLDAVDVGPMISAKQRDGLAATLTKLTEAGGRTLAGGNPIAGPGYFFEPTVVRFEGPSEVMCSNELFAPIATIFPVDGAAEAIALANDTQFGLASYVFTRDISRAIGFAERLAFGMVGINRGIMADAAAPFGGTKASGIGREAGQDGIYEFMEPKYMALTVADELS

SEQ ID NO: 40357 - protein, 299 aa, Rhizobium leguminosarum bv. viciae
MCTVCGCGTSAIEGHTHEVGDDGHGHHHHDGHHDHDHDHDHHRGDHEHDDHHHAEDGSVHYSKGIAGVHVPGMSQERIIQVEKDILSKNDAYAAENRRHFERQGVFALNFVSSPGSGKTSLLVRTIKDLKDRLSISVIEGDQQTSNDAARIRETGARAIQINTGKGCHLDAHMVGHAVEDLAPEPGSALFIENVGNLVCPAAFDLGEAHKVVVLSVTEGEDKPLKYPDMFAAADLMILNKADLLPHLDFNTGFCIANALRVNPRLQTLTVSARTGEGMEAFYAWLEVSAARRAIRSKVA

SEQ ID NO: 40358 - protein, 538 aa, Ashbya gossypii ATCC 10895
MAVLSKSEVEERIANGEVIVIYKSAVLKLDKWIKYHPGGDKAIYHMVGRDATDEMNAYHSDESVQQFMRWKIGHVEGEWKNLVPPIQRNACETSMQPGTPGDEDTCYEDDACDAKVETMGQAYKNHVVVDPMQLSELFDEERAALDRKLFPSADSETQQRISAEYNKLHQELIDAGFYACPYWKYGVELLRISTLLGASYFTLIRLNWQIVSALLLGVAWQQAVFIAHDAGHISITHNYQVDSVFGMLVSAWFGGLSLGWWKRNHNVHHLVTNDPEHDPDIQHLPFFAVTSRLFTGLKSTYYERDLAFDLPARIFIPLQHILYYPILAFGRFNLYVLSWTHLLGGKGPRHGQAAWFRYFELCGLVFFCYWFCYRLLACSLSTATDRVLYVLVSHLTTMIVHVQITLSHFAMSTADLGVSESFPQRQLRTSMDVACPRWLDFFHGGLQFQVIHHLFPRLPRHNLRDAQPYLLRFCERVGIKYSIYGFSHCNSMVLSHLEQIAQQARTVLACAHTMGPHKDVAMPAPGGDSRQYSNPKHA

SEQ ID NO: 40359 - protein, 237 aa, Ashbya gossypii ATCC 10895
MDGWRSRFKRLHRTLSVGEEQCTPAIKLNSPDATLQTEACAPEDEGGLPPVQLCGYLSSTRDRLLTAELCAELRPLMPSRIQLYTKWCLLYSLEQHGASLHSLYEHVRPEEPAKARVGYLLIMRDRRGGLFGAYANEPFRPTESRRYSGNGECLLWYADLHPMLRLRAYPYTGLNEFCIYCTSGFLSMGAGSGHYGLWCDEGLVHGVSERSPTFGNDALSREGPRFHIVALEVWRVG

SEQ ID NO: 40360 - protein, 849 aa, Gibberella zeae PH-1
MAMLASKAAFPAGMGSSSHTPVASQPAMPLPRRTPMMPSSGAYGSPTESEFTEHDPAESVKNWDEDQVCEYLRTVKCGEYEKIFRKNHINGENLLEMDKDVLKEMGVEKVGDRVRLFLSIKKLRTRAYANEKKRNRDSFGGLDIQITAPNDSPRLHSSRGVPASSSKRYSRQLDLYGALDNGKTSSRPNSPLPGTDVRNLRARGKTYASIPVNAQGQRIVTTNPDLPANRLVTTHTRNNSSMDGSLMAALPQGQEVIRVISTGGVTKVVKISGCNTCEEVMRVTLRKFALREDHERNYCFWVLAGIDPDPGQCRRLGDTELWRIIKDQRRPERNRLILRRVPAGEPGEAELHRAAAIAMEEEQQKHARALETVDKRRSLRPFGGLRPPSELIASDLTSYFPDHTREDIDRTARLSMRRSTRMSKVNSRLSVASNLSFASSIQDAPPIPTIADSWLNANTQLAKVRTRDSHIRVPQAAYNRDSVTSSVLDTLQEESSLEPDRKSYVSFTESGSDSAPVSVTDPEGNTTATSYYDGDTSTGSGSFQEIRQALTNDGDDVDEELHSFLAGESWGDDKWMKGALIGQGSFGCVYLALHAVTGELLAVKQVETPAPGANSQGDNRKKGMIDALKREISLLRDLRHPNIVQYLGCSSTADYLNIFLEYVPGGSVQTMLNSYGALPEPLVRSFVRQILTGLSYLHNQDIIHRDIKGANILVDNKGTIKISDFGISKKLEATNILNGANNSKHRPSLQGSVFWMAPEVVKQTSYTRKADIWSLGCLVVEMMTGSHPFPDCSQLQAIFKIGGGKAAPTIPEHASEAAKEFLAQTFEIDHNLRPSADQLILSPFLIPIT

SEQ ID NO: 40361 - protein, 286 aa, Zea mays
  misc_feature (45)..(45): Xaa can be any naturally occurring amino acid
  unsure (1)..(286): unsure at all Xaa locations
MSSGRYMAYSPSPSTTPHSPRIHGLRTPSAAVAEQEKYLSELLAXRHKLTPFIPVIPHSVRLLNQEIFRVSTLLENASLLNQSGLEHGSPLTTGGLYSNGAATDMNGWPSAFQSESSPAYSWLGGSQGSSSGLIVKKTMKVDIPVDKYPTYNFVGRILGPRGNSLKRVEANTDCRVLIRGRGSIKDPAREEMMRGKPGYEHLNEPLHILVEAELPVDIIDARLMQAREILQDLLKPVDESQDFFKKQQLRELAMLNGTLREEGMQRFGSASPFHNGLGMKRAKTRG

SEQ ID NO: 40362 - protein, 576 aa, Rubrobacter xylanophilus DSM 9941
MGEALSNLEIARGAKLLPIEEVGRSMGLREERHLEPYGRHVAKVDLCAIEDLSERPKAKYILVSAITPTPLGEGKTTTTVGLGQAFSHIGKRATIAIRQASMGPAFGIKGGAAGGGYSQVVPMERLNLHLTGDLHAVTEAHNMLAAMIDNHLYHGNGLGIEPHSISWRRVMDVNDRSLRNIVIGLGARTDGVPRQSGFDITAASEVMAILALASSLEDLRERLGRIVIGHNREGNPVSAEDVRGAGAMAVILKEAIKPNLMQTLEGTPALVHAGPFGNIATGNSSVVADLIGIRTADYLITEAGFGADMGAERFFNIKCRISGLEPDAAVVVATVRALKAHSGRYQIKAGAPLPEELLEENPQDVLAGAENLKKQIENIKLHGVPAVVAINAFPTDHPSEHKAIEEAAKEVGARCAVCRHFTEGGKGAVELARALEETIEENERERRRGGGGSFRFLYPLEMPLKQKIETIAREVYGAEGVEYDAEALRALEGFERAGFGRLPVCLAKTHLSLSSDPALKGAPRGWKLSVREVRASVGAGFIYPICGQMRTMPGLSAHPAAERIDLDGEGNVVGLF

SEQ ID NO: 40363 - protein, 676 aa, Oryza sativa (indica cultivar-group)
MDMSYDCYNTTRKDIDCVDMVDLNLKGSPFTFSDTANKFIVFGCRMLAYLGPGEQNDVGSNLTIGCAATCGIGDDLVSINSAGCSGIGCCQTNIPKGIRYYKVWFDGRFNTTDIYNWTRCAYAALVETSSFNFSTVYNSLSRFNDNLGSQPPFVVDWAIGNSTCEQAKTNSDSYMCISSNSVCLNSRNGPGYICNCQNGFEGNPYLNDSFGCQDINECEDSSKYLCYGKCINKPGGYDCFCPAGTRGNASIGPCRKEIPLLTGIVIGMAAGFGILVLSLSVVLLIRKQRSDILKQQRKKYFRKNQGLLLQQLISSDERASDNTKIFSLEELKQATNNFDPTRVLGSGGHGMVYKGILSDQRVVAIKKPNIIREEEITQFINEVAILSQINHRHIVKLFGCCLETEVPLLVYDFVPNGSLNQIIHGATSNRESSLSWDDCLRIATEAAGALYYLHSAASVSVLHRDVKSSNILLDANYTAKVADFGASRLIPNDQTHVFTNIQGTFGYLDPEYYHTGHLNEKSDVYSFGVVLLELLLRRQPIFECESGTKKNLSIYFLYEIKGRPITEIVAPEVLEEATEDEINTVASIAQACLRLRGEERPTMKQVEMSLQSVRNKGFSSAGTSPESNHGMQPALSETYVNLHQPLGVHTIGIINLASSNCNSLQQEFMLSASFAR

SEQ ID NO: 40364 - protein, 895 aa, Arabidopsis thaliana
MKITEGRFRLSLLLLLLLISAATLISAADYSPTEKILLNCGGGASNLTDTDNRIWISDVKSKFLSSSSEDSKTSPALTQDPSVPEVPYMTARVFRSPFTYTFPVASGRKFVRLYFYPNSYDGLNATNSLFSVSFGPYTLLKNFSASQTAEALTYAFIIKEFVVNVEGGTLNMTFTPESAPSNAYAFVNGIEVTSMPDMYSSTDGTLTMVGSSGSVTIDNSTALENVYRLNVGGNDISPSADTGLYRSWYDDQPYIFGAGLGIPETADPNMTIKYPTGTPTYVAPVDVYSTARSMGPTAQINLNYNLTWIFSIDSGFTYLVRLHFCEVSSNITKINQRVFTIYLNNQTAEPEADVIAWTSSNGVPFHKDYVVNPPEGNGQQDLWLALHPNPVNKPEYYDSLLNGVEIFKMNTSDGNLAGTNPIPGPQVTADPSKVLRPTTRKSKSNTAIIAGAASGAVVLALIIGFCVFGAYRRRKRGDYQPASDATSGWLPLSLYGNSHSAGSAKTNTTGSYASSLPSNLCRHFSFAEIKAATKNFDESRVLGVGGFGKVYRGEIDGGTTKVAIKRGNPMSEQGVHEFQTEIEMLSKLRHRHLVSLIGYCEENCEMILVYDYMAHGTMREHLYKTQNPSLPWKQRLEICIGAARGLHYLHTGAKHTIIHRDVKTTNILLDEKWVAKVSDFGLSKTGPTLDHTHVSTVVKGSFGYLDPEYFRRQQLTEKSDVYSFGVVLFEALCARPALNPTLAKEQVSLAEWAPYCYKKGMLDQIVDPYLKGKITPECFKKFAETAMKCVLDQGIERPSMGDVLWNLEFALQLQESAEENGKGVCGDMDMDEIKYDDGNCKGKNDKSSDVYEGNVTDSRSSGIDMSIGGRSLASEDSDGLTPSAVFSQIMNPKGR

SEQ ID NO: 40365 - protein, 87 aa, Oryza sativa
  misc_feature (39)..(39): Xaa can be any naturally occurring amino acid
  unsure (1)..(87): unsure at all Xaa locations
MAAAAASAAAATAAVDGARLLQLEEQAVHGGSIAWEYLXLDGRLRARLAKAVLRLGLGVLNDSSARSRLASEQRTLYDHVAIASMDW

SEQ ID NO: 40366 - protein, 245 aa, Oryza sativa (indica cultivar-group)
MARELNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFIDIINSATVKSA

SEQ ID NO: 40367 - protein, 342 aa, Oryza sativa (japonica cultivar-group)
MADQLISTADHDTLPGNYVRPEAQRPRLADVLSDASIPVVDLANPDRAKLVSQVGAACRSHGFFQVLNHGVPVELTLSVLAVAHDFFRLPAEEKAKLYSDDPAKKIRLSTSFNVRKETVHNWRDYLRLHCYPLHRYLPDWPSNPPSFREIISTYCKEVRELGFRLYGAISESLGLEQDYIKKVLGEQEQHMAVNFYPKCPEPELTFGLPAHTDPNALTILLMDQQVAGLQVLKEGRWIAVNPQPNALVINIGDQLQALSNGRYKSVWHRAVVNSDKARMSVASFLCPCNDVLIGPAQKLITDGSPAVYRNYTYDEYYKKFWSRNLDQEHCLELFRTTPTDTS

SEQ ID NO: 40368 - protein, 482 aa, Listeria monocytogenes str. 4b H7858
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALILCILVIVGQDYAAFLKPEFTNPAWWQKIGISYIGLPIFLVFWLSFKFTNKTKVIPLEDCK

SEQ ID NO: 40369 - protein, 333 aa, Oryza sativa (japonica cultivar-group)
MAHKRGRLVGWVLLLLLAVAIAGAAAATPRQLFLVTQAPVTLTNHHGQLLTGNYSVNLLWYGRFTPAQRATVADFLLSMSSPSAAAEAAAVFGGPGGAVGRVVVGHQRRGTTRAPRGSRSAARCSTRRSPSAGRLSETSLRRAAGAPLPAPGLHRRGDNCPRRPRRRLLPLPTAASTASATSAAAAAATASPAATRGRGRFAYAWVGNAAEQCPGECAWPFHQPAYGPQAPPLVSPNADVGMDGIIINLATLLAGAVTNPYGGGYFQGPTEAPLEAVTACTGMFGAGAYPGYPGQLPVDAATGASYNAVGVAGRRFLLPAMWDPKTSQCSTLV

SEQ ID NO: 40370 - protein, 649 aa, Pseudomonas fluorescens Pf-5
MSELIRVPDIGSGEGEVIELFVKVGDRIEADQSILTLESDKASMEVPAPKAGVIKSLKVKLGDRLKEGDELLELEVEGAAAAAPAAAPAAKAEAKPAAAPAAASAPAAAPAAASVQQVHVPDIGSSGKAQIIEIQVKVGDKVEADQSLITLESDKASMEIPSPAAGVVKAISVKLNDEVGTGDLILDLEVAGAAAPAAAPAQAAAPAAAAAPAPAAAPAAPVADSVQDIHVPDIGSAGKAKIIEVLVKAGDSVEADQSLITLESDKASMEIPSPAAGVVESVSIKLDDEVGTGDLILKLKVKGAAPAAAPAPAAAPSAPAPAAAAAPAAAAPAAAPAAAPAKPGAKVHAGPAVRQLAREFGVELSAVGASGPHGRILKEDVQVYVKAMMQKAKEAPAAGGATGGAGIPPIPVVDFSRFGEIEEVPMTRLMQAGAANLHRSWLNVPHVTQFDSADITELEAFRVAQKAVAEKAGVKLTILPLLLKSCAHLLKELPDFNSSLAPSGKAIIRKKYVNIGFAVDTPDGLLVPVIKNVDQKSLLQLAAEAASLAEKARTKKLSADEMQGACFTISSLGHIGGTGFTPIVNAPEVAILGVSKATIQPVWDGKAFQPKLMLPLSLSYDHRVINGAAAARFTKRLSDLLADIRTILL

SEQ ID NO: 40371 - protein, 297 aa, Oceanicola granulosus HTCC2516
MVDRPKMQDPRKQYPAPPFPKQPQQAPGLARRLEPPADHGEESYKGSGKLEGRKALVTGGDSGIGRATAIAYAREGADVAISFLPDEQPDADEVIALIEQAGRKAVALPGDVSEERYARELPKRAADELGGLDILVVNAGHQKFFPSFDELTSDDFDTTMRTNLYALFWTTQEAARIMPPGASIITTASVQAYDPSTTIMHYATTKAGIVAFTKALASELIDKGIRANSVAPGPIWTPLNPSGGSSQEKVESFGGGSTFGRPGQPVELAPVYVLLASQEGSYITGEVYGITGGAGIA

SEQ ID NO: 40372 - protein, 163 aa, Phoenix dactylifera
MFSMVTGFMNYSQQTIRAARYIGQSFVITLSHTNRLPITIQYPYEKSITSERFRGRIHFEFDKCIACEVCVRVCPIDLPVVDWRFERDIKKKQLLNYSIDFGVCIFCGNCVEYCPTNCLSMTEEYELSTSDRHEDYTIQTVMNSTQIKIDKDKPFDSRTITNY

SEQ ID NO: 40373 - protein, 881 aa, Pseudomonas fluorescens Pf-5
MQDLDPVETQEWLDALESVLDKEGEDRAHYLMTRMGELATRSGSQLPYAITTPYRNTIPVTHEARMPGDLFMERRIRSLVRWNALAMVMRTNLKDSDLGGHISSFASSATLYDIGFNYFFQAPTDEHGGDLIYFQGHASPGVYARAFMEGRITEDQMNNFRQEVDGNGLSSYPHPWLMPDFWQFPTVSMGLGPIQAIYQARFMKYLEARGFIPAGKQKVWCFMGDGECDEPESLGAISLAGREKLDNLIFVINCNLQRLDGPVRGNGKIIQELEGVFRGAQWNVNKVVWGRFWDPLLAKDVDGILQRRMDEVIDGEYQNYKAKDGAFVREHFFNTPELKAMVADLSDDEIWKLNRGGHDPYKVYAAYHEAVNHKEQPTVILAKTIKGYGTGAGEAKNTAHNTKKVDVDSLKLFRDRFDIPVKDDDIENLPFFKPEEGSAEARYLSERRAALGGFVPQRRAKSFSVPTPPLDTLKAILDGSGDREISTTMAFVRILAQLVKDKEIGQRIVPIIPDEARTFGMEGMFRQLGIYSSVGQLYEPVDKDQVMFYREDKKGQILEEGINEAGAMSSFIAAGTSYSSHNQPMLPFYIFYSMFGFQRIGDLAWAAGDSRTRGFLIGGTAGRTTLNGEGLQHEDGHSHMLAGTIPNCRTFDPTYGYELAVIIQDGMKKMTEEQQDVFYYITVMNESYQQPAMPAGVEEGIIKGMYLLEEDTREAAHHVQLMGSGTILREVREAAKILRDEFNVAADVWSVTSFNELRRDGLAVERSNRLHPGQKPKLSYVEECLNGRKGPVIASTDYMKLFAEQIRQWVPSKEFKVLGTDGFGRSDSRKKLRHFFEVDRHFVVLAALEALADRGDIEPKVVAEAITKFGINPEKRNPLDC

SEQ ID NO: 40374 - protein, 517 aa, Oryza sativa (indica cultivar-group)
MDGGGGGDPGGRVGEAKADATRAANKRRAPSPAGGGGVEAKRRKDAMGSSVSGSRSGGGGGRRLRHGRGRRARAFRRKLEEENKNSNNRPRASNVVIAYTPNLIRRYGTLLRNISFLLPYDGQGKAYACPSDKINVFLKWSRCNFCLFFEWAEGDQMMICHMFNTLKEIHISFLINPAFLDESMEVKVTNPLLSFSSNFVEDETWALVKEMLMMMFSPVQEDERAASDLYVFTKSRDSVYFRIFKITSIPAGESENSLVLDEVGLNFCLKLLDVHGAFVGSDCDQALDGLQNLLSRRKILLKGSDVKFFQLEVIAYEEDEAINNVLQVVELVKSCFVGEMIPAYLQGDLHDLEENPLKRLESVIDSSSLMSAKEKKGLLVNLHTEYKTNISPAISEDDRDSLFKHIPYLDCWMNRTEDNEYLKLVANLDSKKVALKVNKVGTDKRKPSKNGILQFDFMRNSDVHIPEKAIKGWYHPLSFVMDRLYFNFPLPNVLACHSKKFGTIHEVKKLCAESRFG

SEQ ID NO: 40375 - protein, 700 aa, Solanum lycopersicum
MERIPEVRESTRQFPIGAKVAHTFSTSKKEVGIRGFRDFDLAIPIQTWKGKTSYQEEEDLMVDAGTIKRSDDSLEDSGSTSFHGASHPPEPVDTDLMRPVYVPIGQNKADGKCLVKNVSLKGPFLDDLSIRMPNVKPSPSLLSPAESLVEEPNDLGVISSPFTVPRPSQNTETSLPPDSEEKECIWDASLPPSGNVSPLSSIDSTGVVRSMSIVNSCTSTYRSDVLMSDGMLSVDRNYESTKGSIRGDSLESGKTSLSRASDSSGLSDDSNWSNITGSANKPHKGNDPRWKAILAIRARDGILGMSHFKLLKRLGCGDIGSVYLSELSGTRCYFAMKVMDKASLASRKKLTRAQTEREILQLLDHPFLPTLYTHFETDRFSCLVMEYCPGGDLHTLRQRQPGKHFSEYAARFYAAEVLLALEYLHMLGVVYRDLKPENVLVRDDGHIMLSDFDLSLRCAVSPTLIRISSDDPSKRGAAFCVQPACIEPTTVCMQPACFLPRLFPQKSKKKTPKPRADSGFQANSMPELVAEPTSARSMSFVGTHEYLAPEIIKGEGHGSAVDWWTFGIFLHELLYGKTPFKGSGNRATLFNVVGQQLKFPDSPATSYASRDLIRGLLVKEPQNRLGVKRGATEIKQHPFFEGVNWALIRCSTPPEVPRPVEPDYPAKYGQVNPVGVGNTSKRVVGADAKSGGKYLDFEFF

SEQ ID NO: 40376 - protein, 428 aa, Rubrobacter xylanophilus DSM 9941
MTTTMRGAGGYYYYGGRYDAIVVGVGAMGSAALYHLARRGKRVLGLERFGIPHAMGSSHGHTRIIRLAYYEHPSYVVLLRRAYELWRELEREAGEQLLHITGSIDAGPEDSWVFRGSWESARMHELPHEVLTGSELHRRYPAYRLPKDHLALLQPEGGFLKPERCIVAHVMAAQARGAEVHAHEKVLEWGPSEGGGGVRVRTERGTYEAEKLILSAGAWMGELAPEALGGVAVAERQVLAWLQPQKPELFRPQNFPVFNLLVEEGRFYGFPVFGVPGFKFGKYHHLLEELGEPDRLDRQVHWRDEQMLREFAERYFPEGCGPTMDLQVCMFTNTQDNHFIIDLYPGLEQVVIASPCSGHGFKFASVVGEILADLADSGASRHDISLFRVGRLLRGASPAGEPAAPPADGARNGRPASFPRPREMRTFW

SEQ ID NO: 40377 - protein, 411 aa, Rickettsia heilongjiangensis
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPYTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPR

SEQ ID NO: 40378 - protein, 515 aa, Thermoplasma acidophilum DSM 1728
MPFENENTYVRMVEAGKEDEFHRKYEEALKEVESYFHKEYPNIIKEDIVESKKIKDISPIDGSEIATFQLASDESVNKAVDMLYRSYKNWYNIGYMKRALTFLKAAGMLSDQKFKFAAILTYENGKNRYEAIGDVDEAIDFMRYYAINLIENQGFIKLTGKAYKNEESMSVMKPYGVFGVISPFNFFSIGVGMSSGPLVTGNAVILKPSSDIPLSLYLWVRLMHDAGVPKEVLAYVSGSGSVVGKHIVENKKVAGIVFTGSREVGLDIQRRSIDNGPKVVITEMGGKDAIIVSNKADLNKAVEGVARAAFGFAGQKCSACSLLYVHKDVYDEFMKRLKERTDQIKPDDPRKKETFLNPVINKEAYEKFIKLKPEYNKGKILTGGHELKRPGFYVEPTIVTDLPKDAYIARNEIFLPVLSVFKCNSIQEAIEDINSMDYGLTGGIFTEDPNEIQYYFDNVEVGVLYANRKSGGSTGSMVGSQPFVGWKLSGVSGKGTGSFYYLMQFLREQSQTIAH

SEQ ID NO: 40379 - protein, 259 aa, Nicotiana sylvestris
MAFVNKIGNMLKQIVSRHANLELCASRTSLYQAIRSMSSSKLFVGGLSWGTDETSLKEAFSQHGEVIEARVIMDRDTGRSRGFGFVSFTSTEEAASALTALDGQDLHGRQIRVNYATEKLRGSFGGGYGSGGGYGGGDGSFAGAGGYASSNYGGGGNYGSNNSYPTGGGNYGGGVRYGNGEGGNDAGGVRQGSFGGGYGGGNSGNYNADFTQGMVNNGVEEQLSADQGTESVNSDFTPGAEGSYRDDDDEPNGYANSRG

SEQ ID NO: 40380 - protein, 465 aa, Arabidopsis thaliana
MHAQRVARDLISGSPDEILGKILSFLPTHHAATTSVLSKRWRNLLPLVDKLELTEDHPSGRCSLGFPDFVEKTLALLDRPCSVIKKVHLNCDHLHGESRFYSWIRTVLERGVLDFHLESSRMYRVETEFFTSNTLVELTISGALYPEGELPPGGLFFPALKRLSIVLVAFADCDMYDDFVLGCPVLEELILYYADDDQPPGWNGKVSSPSIKRLTISHDYPDYPETHIYVWFDTPSLVYLDYSGHVARRYTAEMGSLEEARLNLLPWEQLIDSDEEDDDFDGYGPRWEKRSKDATGLIAMISNVKTLHLSSDSLEVIHSLCKVMPAFQNLLKLSFESDKERGWQVVPLLLNSSPNLETLVIKGLVHKVTSRCGDACLCIRKKTRGECCLLTCQVKVLKIIGYRGTCREQKQMSHFLANLKCLETVKVRVEVDHREDNDASNTYLRITNALMKLPRVSSNCRIHFL

SEQ ID NO: 40381 - protein, 430 aa, Flavobacteria bacterium BBFL7
MSFSYQRSSALFKEAQKVIPGGVNSPVRAFNAVGGSPVFVDHAKGAYLYDVDGNKIIDYIASWGPMILGHAFDPVVDAVKAAADKGTSYGMPTELETQIAELAISMAPNVDQIRMVNSGTEACMSAVRLARGFTGRDKIIKFAGCYHGHSDSFLIQAGSGAVTFGSPNSPGVTQGTAKDTLLAQYNNLEQVADIFKQNEGEIACVIIEPIAGNMGCIVPQEGFLEGIRSLCDENGALFIFDEVMTGFRLAAGGAQETTGVKADIVTYGKVIGGGLPVGAFAARQEIMNHLAPLGPVYQAGTLSGNPLAMSAGIAMLSHLNSNPNIFTSLAQKTERLHKGIEAVLTEKGMPYQINRYGSMMSVHFTDQPVVDFASAATGNNDWFKKFFHGLLNRGIYLPPSAFESYFLNNALSTEDIDKTIDASREVVAEW

SEQ ID NO: 40382 - protein, 232 aa, Methanococcoides burtonii DSM 6242
MLKALIFDMDGVLVDSMPYHTEALSHVFAEMGFSMDARHVYNMEGSKTVEIVRFLLEKDGIDLLEVDVDELIHRYRDEFARIVELKAFSEVLECLPILKERFMLAVVSGADRNIVQDIITNLYGGIFDVVISGEDVDNGKPAPDPFLSAADMFGLDANECLVVENAAMGVEAANRAGMFCLAVPTYVSKESLKNADRLVDDHRMLRDFLLELDHLEKEAVEFLRLKFNLAHK

SEQ ID NO: 40383 - protein, 230 aa, Methanococcoides burtonii DSM 6242
MDVNEISEGIFEVRKGGKKILATKNANPGSNVYGENLLEEEGEEYRAWDARRSKLAAMVIKKMKVPIKSNSRVLYLGAASGTTVSHVSDMLPNGIVYAVEFSPRTMRELIQLCDTRSNIVPILADASRPKLYAHIVEQVDVIFQDVAQPNQAQIAAVNAGQFLKEDGYLLLSIKARSIDTVANPSKVFKEEVNKLEKDFDTQFKVIKKYDLAPFHEDHLGLIAKKKLKEN

SEQ ID NO: 40384 - protein, 432 aa, Candidatus Desulfococcus oleovorans Hxd3
MHHTQSMLDFDRAHIWHPYTSIGNPLPVYPVKRAEGCTLFLEDGRELIDGMASWWTAVFGYNHPVLNRAVTGQLEQMAHVMFGGLTHRPAVELCRRLLGICPPGLDAVFLCDSGSVSVEVAIKMAIQYWSSVGRPEKQRLAAIRSGYHGDTLGAMSVCDPVTGMHHLFSGILPAQLFADMPRSPFEGPLDDRDVQNLEQLLAAHHREIAALVLEPVVQGAGGMRFYSPAYLAMARQLCDQYEVLLICDEIATGFGRTGKLFACEHAGISPDILCVGKALTGGYMTLAATLASEKVARGISSGDPGLFMHGPTFMGNPLACATAVAAIDLLHTFDWQAAVTGMEARMKQGLGPCADMPGVREVRCLGGIGVVETKEPVDTARAQTLFVERGVWVRPFGRLIYIMPPYIITPEALSRLTTAICEVVALLPDLQS

SEQ ID NO: 40385 - protein, 592 aa, Cryptococcus neoformans var. neoformans JEC21
MCGIFCCFNRAGDISQYRARAIACSKRQRHRGPDWSGCYMTNNTVLVHERLAIVGVDTGAQPLTNEDESLVLAVNGEIYNHVALRKSLKNKDAVFKTHSDCEVIMHLYKEHDTGLCNMLDGMFSFVLVDKSVSPPRLIAARDPIGITTLYMGWNSQSPDTLYFASELKCIHEECDNLQAFPPGHFYDSKEKKLTRYFNPSWWDSDKGVVPHNDIDYKLLRETLEAAVKKRLMSEVPYGVLLSGGLDSSLIASIAARETDKLAEEQEKLRQERKQAIASGKWVGDEQPLASWPQLHSFAIGLPGAPDLIAARKAADFLGTIHHEYNFTVQEGLDAIPEVIHHLETYDVTTVRASTPMYLLSRKIKAMGVKMVLSGEGSDEIFGGYLYFHAAPTAKDFHEECVKRVKNLHTADCLRANKSTMAWGLEARVPFLDKTFLEVSMNVDAKYKMFSKGTHQEVDEDGRPKMEKYILRKAFDCSPEGKAYLPDSILWRQKEQFSDGVGYSWIDGMKDHAAAIVSDEKFANRATRWPLDTPDTKEAYWIREIFEHHFPTEAAAKTAVRWVPKQEWGVSSDPSGRAVSIHTAAYADGEAKA

SEQ ID NO: 40386 - protein, 246 aa, Glycine max
MGMAAESQFHVLAVDDSLIDRKLIERLLRTSSYEVTTVDSGSKALEFLGLCENDESNPSTPYVCPNNHQEVEVNLVITDYCMPGMTGYDLLKKIKESSSLRNIPVVIMSSENVPSRINRCLEEGAEEFFLKPVRLSDLNKLKPHMKKTKLKDQKQGTVEKLEDLEVQQQQPQQQIIIQNEQQQAPKSRDLLQPESESHPHAQPTIEQQQQSLQQANNNSKRKTMEQGLSPETDRTRPRYSGIATVV

SEQ ID NO: 40387 - protein, 429 aa, Bacillus cereus ATCC 14579
MKKFDKSIAAFEEAQDLMPGGVNSPVRAFKSVGMNPLFMERGKGSKVYDIDGNEYIDYVLSWGPLIHGHANDRVVEALKSVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLEFFAAYYREMVEQGVFLPPSQFEGLFLSTAHSDADIEATIAAAEIAMSKLKA

SEQ ID NO: 40388 - protein, 186 aa, Triticum aestivum
MKLSCLLLVSFFAAAYASSERAIAVAGAGGLLSDPEQQCVYTVYVRTGSIWKGGTDSAIGVTLLGSDGTGVRIADLEQWGGMMGAGHDYYERGNLDIFSGRGPCMERAPCWANVTSDGAGAHHGWYCNYVEVTATGPHMGCAQQLFTVEQWLATDASPYRLYAAVDNCGDKQAAAKGQEVRASIAL

SEQ ID NO: 40389 - protein, 408 aa, Campylobacter coli RM2228
MQIPSKLKPYYENIAFEQEDSKMIINLGPQHPSAHGNLRLILELDGEQVVKARPAIGYMHRGMEKMAENMIYQEFIPTTDRMDYIAASANNYAYCAAVEKLCGLEIPRRAAVIRMILLELNRIASHLLWLATHALDIGAMSVFLYCFREREYVLDLIEKYCGARLTHSSMRIGGVMLDLPEGFLNELLAFCDKFPKDIADYEALLDDNRIWRLRTENVGVVSKEQAMNWGCTGVMLRGSGVRYDIRKEEPYLLYNEIDFGVPYATQGDSYARYKVYMQEFRESLKILRQCAALYKDTPPEILANHPEYVSASKEQILTQNYSLMQHFVLITQGLKPPKGEVYVPTESPKGELGFFIHSDGTGRPYRLKARTPSYWHCAFFEEMLVGTYLADVVAIMGNVNIVLGEIDR

SEQ ID NO: 40390 - protein, 965 aa, Xenorhabdus nematophila
  misc_feature (557)..(557): Xaa can be any naturally occurring amino acid
  unsure (1)..(965): unsure at all Xaa locations
EFGVTMIGATADAIDKAEDRQRFDKAMKKIGLDTARSGIAHTMEEALAVAEDVGFPCIIRPSFTMGGTGGGIAYNREEFEEICERGLDLSPTNELLIDESLIGWKEYEMEVVRDKNDNCIIVCSIENFDPMGIHTGDSITVAPAQTLTDKEYQIMRNASMAVLREIGVETGGSNVQFAVNPKNGRLIVIEMNPRVSRSSALASKATGFPIAKIAAKLAVGYTLDELMNDITGGRTPASFEPSIDYVVTKIPRFNFEKFAGSNDRLTTQMKSVGEVMAIGRTFQESLQKALRGLEVGATGFDPKVNLDDPQSLTKIRSELKSAGAERIWYVADAFRAGLSVDGIFNLTNIDRWFLVQIEELVRLEEQVAEQGVNGLTFDFLRHLKRKGFADAHLAKLAGISGKEVRKLRHDYQLYPVYKRVDTCAAEFSTDTAYMYSTYEEECEANPNNDKPKIMVLGGGPNRIGQGIEFDYCCVHASLALREDGYETIMVNCNPETVSTDYDTSDRLYFEPVTLEDVLEIVRVEKPTGVIVQYGGQTPLKLARELKAAGVPIIGTSXDAIDRAEDRERFQQAVNRLGLKQPANVTVTTIEQAVEKGKAIGYPLVVRPSYVLGGRAMEIVYDETDLRRYFQTAVSVSNDAPVLLDRFLDDAIEVDVDAICDGERVLIGGIMEHIEQAGVHSGDSACSLPAYTLSQEIQDVMRQQVEKLAFELRVRGLMNVQFAVKNNEVYLIEVNPRAARTVPFVSKATGRPLAKVAARVMAGQSLLKQGAIEEIIPPYYSVKEVVLPFNKFPGVDPILGPEMRSTGEVMGVGRTFAEAFSKAMLGSNSTMSKQGRALLSVREEDKERIVDLAAKLLKHDFELDATHGTAVVLGEAGINPRLVNKVHEGRPHIQDRIKNGEYDYIVNTTAGRQAIEDSKLLRRSALQYKVHYDTTLNGGFATTMALSADPTEQVISVQEMHAKIVK

SEQ ID NO: 40391 - protein, 565 aa, Oryza sativa (indica cultivar-group)
MERESSTPASSWLGIDEAAPFAGKKATKDAAAADAFVRRWPKVVNATLVAFIMTMPPLLILLGGGRPGAPAVWIKSTVASLAARGEPKKDVLLGGLLLPGFDEQSCVSRYQSVYYRKNMTRPPSPHLLRRLRQQEALQRRCGPGTEPYRRASERLRSGQNAGDDFVATVDGCGYLVLISYRGLGNRILSITSAFLYAMLTGRVLLLDPGKTMADLFCEPFQATSWMLPGDFPLEHFRDLGEDAPESYGNVAVNRSGSVAGLRFVYAHLDHAATPANRLLYCDDHRQFLHRVQWVILRTDSYIVPGIFLNPAYKEELDMMFPNKDAVFYLLSRYLLHPTNDVWGMVTRFYHSYLKNADERLGVQIRVFDGDEPFQHILDQILACTSQEHLLPGVVVSGHGGGVAPPPIARSKAVLTTGLNSWYHDSIRDMYWRSPSATGEVVSVHQPSHELHQHFFRSTHDMKALAEMYLLSLTDKIVTSGWSTFGYVGAGLGGLTPYIMIKPENHTVPNPPCVRAMSMEPCDHGPPYFECTKKEIDKIIDTGNLVPHVRSCEDVPWGRKLADPIS

SEQ ID NO: 40392 - protein, 567 aa, Oryza sativa (indica cultivar-group)
MATRVKKLGGVAGGGGAAVRVVGVVCAMAVPLFALLVLGGWASASTVWQSAARLTAVTAGFTNASKPSATGDAATGADELFGGLLAAGGGFDRGACLSRHESPRYYKRSPFSPSPYLLQKLRDYEARHRRCGPGTPGYAKSVEQLRSGHSSEVMECNYLVGLPYNGLGNRMLSLVASFLYALLTDRVFLVHFPDDFADHFCEPFPGGEGETATTWVLPPDFPVADLWRLGVHSNQSYGNLLAAKKITGDPARETPVSVPPCVYLHLAHDLRGDDERFYCNDDQLVLAKVNWLLLQSDLYFVPSLYAIPEFQDELRWMFPAKESVTHLLARYLLHPSNSVWGMVMRYHHSYLASAAEMIGVQIRMFSWASIPVDDMYKQVMACSSQERILPDTDGGDAPAPARTNASGGGATTAILVTSLQAEYYERLKGRYYEHAATASGAGGGRRWVGVFQPSHEEKQEMGKRAHNQKALAEIYLLSFADVLLTSGMSTFGYMSSALAGLRPAMLLTAFNHKVPRTPCVRAVSMEPCFHKPPPAAATCQGKLAVSENVTRHIKRCEDLAGGLKLFD

SEQ ID NO: 40393 - protein, 525 aa, Hordeum vulgare subsp. vulgare
MVLLGVLASPTPATVLWTLLGLALLWQVKRLVDYTWWRPRRLQRALRAQGLRGTPYRFPVGDLGDYGRQGKEASSRALPLRCHDIRAHVAPYLYSTVLEHGKTCVSWFGPVPKVTIADPGVTREVMSNKFGHFEKLQFPTLTRLLAGGVAVYEGEKWVKHRRILNPAFHLEKLKLMMPAFSACCEELVSRWTQSLGSDGWCEVDVCPEFQTLTGDVISRTAFGSSYLEGRRIFELQSVQADRIVAEVKKIFIPGYMSLPTKKNKLMHETNNEVESILRGLIEKRMQAMQQGETTKDDLLGLMLESNMKETDDKGQPILGMTIEEVIEECKLFYFAGSETTSVLLTWTMIVLAMHPEWQDRAREEVLGLFGKNKPEYDGFSKLKTVTMILYEVLRLYPPAIAFMRKTYKEIEIGSITYPAGVIIELPVLLIHHDPDIWGSDVHEFKPERFANGIAKASKDPGAFLPFGWGPRICIGQNFALLEAKMALCMILQRFEFDLASTYSHVPHNQKMLRPMHGAQIKLRAI

SEQ ID NO: 40394 - protein, 373 aa, Rubrobacter xylanophilus DSM 9941
MQTKDLYKVLGVDRGASQEEIRRAYRKLARRYHPDANPGDKEAEERFKEIQHAYEILSDPQKRREYDEGPRTFFEGARQGTGGFRPGGFSDLSDLFEGFGGLGDIFGRAGRRGDAGPRRGEDVTVSVNLRFKDALEGVTTRVSVPVEAVCEACRGTGAAPGTVPRRCPRCDGRGMRSRDQGLFAFSEPCSACGGRGTVIDSPCSACGGGGRVRMNRRVTVRVPPGARDGMKIRVPGRGSAGRDGGPPGDLYVVTRVEEHPVFKRRGDDFVVEVPVSFVEAALGAEIEVPRPEGGRLRLRLPAGTQEGRQFRVRGAGAPKARSRSGERGDLIVRAHVVVPQKLRRREREILEAFAEERGEDVREELFKRAGSWT

SEQ ID NO: 40395 - protein, 556 aa, Oryza sativa (indica cultivar-group)
MTKALQAAGGKPWRPGKMSTVLVAVLMTMPPLVVIFSGRIGDQAMWIKTAVDGIRGGTDDDVSFMKHPTTSHDKLLGGLLVDGFDQESCHSRYQSAAYRRNAGRRPSEHLVSKLRRHEDLQRRCGPGTAAYSAAVEQLKSGKSPAAAEASPEACRYLVSISYRGLGNRILAAASAFLYAMLTDRVLLVDPSNEMGELFCEPFAGTTWLLPPEFPLVGYQGFYLHTAERYGKMREDRVLRPDGGEAAAAAPPPAFAYIHLDYNQTDYDKLFFCDEDQRLLSSIQWLVMRTDSYIVPGLFLVDAFQDELAALFPERDAVFHHLGRYLFHPTNHVWGLVTRYYRGHLAWARRRVGIQVRVSSWEWESPEILRTITSCTQDEGLLPRVLDDTDQEPPATAAASARRGLRPSAVVITSLKSWYYEKMKGMYWERATESGEVVVFDQPSHEEQQMYGVRAHERKAWAEMYLLSTTDVLVTTGKSTFGYVAQGLGGLTPWVLPRREVNGTAPPCRRDMSMEPCFHVAPLYDCKRWEDAGKIVPHVRHCHDMPAGLKLVDRTEW

SEQ ID NO: 40396 - protein, 437 aa, Flavobacteria bacterium BBFL7
MAKTMDFILPKMGESITEGTILNWLVQEGEAFEEGDILVEVGTDKVDNEVPAPVAGVMSKHFFTDGDVVEIGSVIAQFEESDGSVKTVAAPKSANSIEIPKKDSIVNKQPKPVKTTSKTTSVSNSYVNQDLFVSPLIDSMARKHHMSYEELARIPATGHEGRLRKSDVVNYLNEGRPFQFAQAVSNEPDPTAYRIPQLKLDKGTGTIIEMDRMRSMIADHMVYSKHTSPHVTAYVEADLTDLVNWRNNNKAPFQEKYGERLTFTPLFVDAVARAIKEYPNINASVDGKNIIVKENINVGMATALPSGNLIVPVVKYADQKSLQDIAADVNRMANLARENKLGGDDIKGGTFTISNVGTFGSLMGTPIINQPEVAILATGIIKKRAEVMTKDGVDSIEIRSMMMLSLSFDHRVVDGFLGGSFLKQVADNLSQAPTKNY

SEQ ID NO: 40397 - protein, 396 aa, Candidatus Desulfococcus oleovorans Hxd3
MKSLKTIDVAGKRVLVRVDFNVPLDDQQQITDDTRIQSAVPTIEYLVGAGAKVIVCSHLGRPKGKPDPVFSLAPTARRLGELLDRPVEMANTCVGPDVVSRIARMAPGDVLMLENLRFHPGEANDDDAFARALAALCDVYVDDAFAVSHRANASVDAVTKYAPVCAPGFLMEKELGAFGKALENPARPFVAIVGGAKVSSKLPALQHLLQEVDRLIIGGAMANTFLAAKGVNVGKSKIEQELIGEARSVIRQAAEKKVELFLPVDVIVAEKIDPDADRQAVSVDRIPADAMALDIGPETSRLFGDALKDAKTIVWNGPMGIFEMEAFAAGTKAVAAAVADSKAFTVVGGGDTVSAVHEAGVADRISYISTGGGAFLELMEGKTLPGVAALERNQPA

SEQ ID NO: 40398 - protein, 132 aa, Synechococcus sp. WH 7805
MTLSAIQAVYTDAAPAPVGPYNQAVQAGGWLYCSGQIPLDPASGEMVGEGDVEAETRQVLHNLDAVLKAAGTDGSRVVRTTVYLVDLNDFQVVNAIYAEWFGEGVSPARACVQVAALPKGSRVEIDCIACLS

SEQ ID NO: 40399 - protein, 198 aa, Bacillus cereus ATCC 14579
MKVTKADIVISAVKPEQYPDSDLPEIALAGRSNVGKSSFINKILNRKKLVRISSKPGKTQTLNFFLINEMMHFVDVPGYGYAKVSKSERAAWGKMIETYFTTREQLDAAVLVVDLRHQPTSDDVMMYDFLKHYEIPTIIIATKADKIPKGKWQKHLKVVKETLAVEIGDEIVLFSSETGLGKEEAWKAIHKFTKTKNA

SEQ ID NO: 40400 - protein, 116 aa, Colwellia psychrerythraea 34H
MSEETIFSKIIRQEIPTPLLYQDELVTAFRDVAPRVDSHILIVPNKHIATINDVTSDDELTLGRMITVAKKLAKEEGIDEKGYRLVINCNSDGGQEVYHIHMHLLGGQPLGPMLCC

SEQ ID NO: 40401 - protein, 221 aa, Campylobacter coli RM2228
MKNYYLIDEKRKTPTSTWQKISQALKRSVKLELFVGLWVVMREMLKRNNSATIKYPFEKVKLDNRYRAVHRLMRFIESENERCIGCGLCEKICISNCIRMETSLDENARKKVGNYSINLGRCIYCGFCAEVCPELAIVHGTEYENAAEQRSYFGYKQDFLTPIDKLKNQVEFEGAGSLRKDADLLVKKTPNYYEVLQEREKNLCTDEECTLPNLAPQGEVK

SEQ ID NO: 40402 - protein, 302 aa, Kineococcus radiotolerans SRS30216
MAIGSGTGVERSASPAGGVLTRGRYGKAPRSRTRHTEPTVSVIVGGAPPGTALEQQEDPVQVDGAVVVITGASSGIGAATARAAAGAGARVALLARRRDRIDALAQELGSVGGEALAVRCDVTDQAQVHAALQQVVSTFGRIDVVVNNAGQGLQATVEQVDLADARAVFELNVLAPLAVMQAAAPLLRATGGGSIVNISSGTTLAAAPGTGSYAASKAALEKLSAIARAELAPDAITVSCVLPFATATEFMTSIRAGREAAEEMTAGAQFDPPERVAEAVLDIVRSGAEQVDLVPRAYGGSA

SEQ ID NO: 40403 - protein, 258 aa, Prochlorococcus marinus str. MIT 9211
MTSQHILIFDFDGVIIDGIWEYWISSTKAYWKIIGKENHLDPFNSNIPKDFRILRPWVKSGWEMVLLTAELLQADSFLKASGASIFSKHYERNCLEALNKWGWSPEQLQAALDDVRREAIRKDRKRWLTSHQAFPLVAERIKQFKNESIEFGVLTTKSAEFTLELLDHLNLHPKLLYGHEAGDKASMLLKISKETPIAGFIEDRRKTLETVLNTPGLKSIPCYLANWGYLKPLDNKNLPSGIQLLEKRKFLSPLANWS

SEQ ID NO: 40404 - protein, 305 aa, Synechococcus sp. WH 5701
MQKFLPYAWFQGGCVPFAEATLSIATHALHYGTGAFGGMRALPNPSDPGEILLFRADRHARRLSQSARLLLAELEESTILGAIDAFLQANRPTTPIYLRPFVYTSDLGIAPRLHDIETDFLIYGIELGDYLSPDGVSCRVSSWTRQEDRSLPLRGKISGAYITSSLAKTEAVKSGFDEALLLNSRGKVSEASGMNLFIVRDGVLITPGVDQDILEGITRASILELARDLDIPVIERAVDKTELFVADEVFLSGTAARVTPVRRVESTDLPTQRPVMEQLRERLTQITIGNDPNYDHWVTRIRLRD

SEQ ID NO: 40405 - protein, 550 aa, Oryza sativa (indica cultivar-group)
MAKRGGGRPWVIVLFSLPLLLVFLLSADRRVLIASESQVLRLIKGRGDGSILQWPSAAAAAARDKLLGGLLADGLDDGSCHSRYQSAMYRRNAGREPSPHLVSKLRRHEELQRRCGPGTAAYSDAVERLRSGKSGGIVSPSPEAECRYLVSISYRGLGNRILAAASAFLYAMLTDRVLLVDPSNEMDELFCEPFPGATWLLPPGFPLANYTSFSVETAESYGNMVKNKVITTDAGDAAPTTAQLPAFAYIHLDHTSTVEDKFFFCDEDQRAIRNIPWLVMRTDSYIVPGLFLVTGFQDELDSLFPETDAVFHHLGRYLFHPTNHVWGLVTRYYDAYLATAQQRVGIQVRVFGAQPESPKLLDQITTCTQKEKLLPEVIAAGEPPVVDVALANSKSKAVLVTSLKSWYYEKMKSMYWEHATATGEAVSVHQPSHEEYQRFGARSHDGKAWAEIYLLSLSDALVTSGWSTFGYVAQGLAGLTPWVMHKPANDTAAAAGDDPPCRRDVSMEPCFHAPPFYDCRLKRGADTGKMVPHVRHCDDVQWGLKLVRRG

SEQ ID NO: 40406 - protein, 458 aa, Ashbya gossypii ATCC 10895
MGRATIGRTKKQRHDPLLQDLASQHGKLRKQANAQTEETEEQDEEYVDAQASRKILQLAREQQEELEEEDQARAQSETMNRFRVADYGLAKDSDEEEMAEEISDFEPEEELEEEVVEIDEEDAAMFEQYFKRSSDFNSANGTYILADKIMAAIREKEMEMKVKAQAAQAGDAGMPSEGVALPERVIRAYTTVGSILKTWTHGKLPKLFKVIPSLNNWEDVLYVTNPEAWSPHVVYEATKLFVSNLSAKGAQKFINMVLLERFRENIETSEDHSLNYHIYRALKKSLYKLAAFFKGFLFPLVETGCNVREATIAASVLARVSVPALHSSAALTYLLRLPFNPATTVFIKVLLEKKYALPYQTVDECVFYFMRFRAVDDGSTGEDATRVLPVVWHKAFLSFAQRYKNDITQDQRDFLLETVRQRGHRDIGPEIRRELLAGKSREFVSDVGNTADLMIDVQ

SEQ ID NO: 40407 - protein, 178 aa, Oryza sativa (indica cultivar-group)
MENLLPDVITTGEPAATTRRRLKPKAVLVTSLTSWYYEKLKGMYWERATATGEAVGVHQPSHEEYQRFGSGSHDAKACAEIYLLSLSDALVTSGWSTFGYVAQGLAGLTPRVMYKPANESSAVPDPPCRRDVSMEPCFLTPPYNNCRMKRSAHSGKVVAHVKNCHDVPWGLKLVRRVE

SEQ ID NO: 40408 - protein, 565 aa, Oryza sativa (indica cultivar-group)
MNSEGGIGAGITNRPSQQCSAAAAEDGDDYERPCPWIPGKKKKKKITCLAICLIASPILILLVSRRGSPFPSMSGWALPSRMYASKGSKRDVLMGGLLVPGLDERTCASRYSSAMYRKNTARSPCRHLVKRLREQEALQRRCGPGTAAYWRAAERLGSRRNGTAGADDEGCKYLVLVPYRGLGNRMLAMASAFLYAMLTGRALLVDRGESLADLFCEPFPGTSWLLPPEFPIKNLQDLTGEAPESYRNLVQSDRPATSVSELPYVFVDLDHGCTYHDKLFYCDDERHFLHRAPWLLMRTDGYFPPALFLNPAYQDELDRLFPRKDSVFYLLAHYLLHPTNKVWGLITRFYDSYLRDSDERLGIQVRVFDGDTPFKHILDQITACTSQERLLPEVVEQEPSSFPAPAAAATAARSKAVLMTGLNSWYYDNIRSRYWQSPTATGEVVRVHQPSHEEHQLSGSTTHDMKAMAEMYLLSMTDAIVTSGWSTFGYVGHGLGGLSPWVMFKPENLTTPDPPCRRAVSMEPCLHGPPFYDCRVKRGADTGKLVPHVRHCEDMSWGLKLVHPE

SEQ ID NO: 40409 - protein, 548 aa, Oryza sativa (indica cultivar-group)
MDTDKLGEEAAAHPPEAEKRRGVAAPGAATVLVLVALPLMLVSYFFGDLAADTVVRLHRFKESSSSSSSPAAAADRLLGGLLSPEFDEASCLSRYEASSRWKPSPFRVSPYLVERLRRYEANHRRCGPGTARYRDAVARLRSGDGDGDAECRYVVWLPIQGLGNRMLSLVSTFLYALLTGRVVLVHEPPEMEGLFCEPFPGTSWLLPPDFPYKGGFSAASNESYVNMLKNGVVRHDGDGGALPPYVYLHLEQIHLRLQNHTFCEEDHRVLDRFNWMVLRSDSYFAVALFLVPAYRAELDRMFPAKGSVFHHLGRYLFHPGNRAWGIVERFYDGYLAGADERLGIQVRIVPQMAVPFDVMYEQILRCTREHGLLPQVTSTSESAGGRPPPPPTATATKVKAVLVVSLKREYYDKLHGAYYTNATASGEVVAVYQPSHDGDQHTEARAHNERALAEIYLLSFSDAVVTTAWSTFGYVAHALAGVRPWQLAPLDWGKMRADVACARPASVEPCLHSPPPLVCRARRDRDPAAHLPFLRHCEDVPAGLKLFD

SEQ ID NO: 40410 - protein, 436 aa, Thermoplasma acidophilum DSM 1728
MSGKADPLEIAKEAKPSQANNEVEEDPFEIALKQLRKAAKVLNLDEQALEILSSPQKILQVSLPVKMDDGKVKVFTGFRVRHNIARGPAKGGIRFHPQETLSTVKALSMWMTWKCAIADIPYGGAKGGIICDPSTMSQGELERLSRAYIRAIADFIGPDVDVPAPDVNTNPQIMAWMLDEYENIVRHNAPNVITGKPLEVGGSLGRFDSTGKGGMFVLREGAKKIGLDLSKARVAVQGFGNVGQFAVKFVEEMFGAKVVAVSDIKGGIYSENGFKFDDLLAWSKKIGSVVGFPGSKPITNEELLESDVDVLIPAAIEEQITARNADKIKAKIILELANGPTTPEADEILYKKGKLVLPDVLSNSGGVIVSYFEWVQNNYGEYWSTEEVTNKLDVKITKAARQVLETMDKYHVDPRTAAYVIAVKKVADAMKVRGWY

SEQ ID NO: 40411 - protein, 159 aa, Prochlorococcus marinus str. MIT 9312
MSEFFAFFNNSVLFWSLLSCLLAQFFKIVFNFFSTGEIRFGIVFETGGMPSSHSALITGATSGIGYELGFDSSIFALAVAVALIIMYDASGVRKSAGIQAAEINKLSKKLDPQSELLLKETLGHTKIEVMVGSFLGPLITLPGIFFLGSPLKIFDLIIN

SEQ ID NO: 40412 - protein, 634 aa, Methanococcoides burtonii DSM 6242
MCGICGYAGFDDEDLLGKMCDAIVHRGPDDSGSFTDKGIGLGHRRLSIIDLEGGHQPVCNEDGTIYVVYNGEIYNFLSLRDELEKRGHRFQTSSDTEVIVHLYEEYGKDLVHHLRGMFAFALWDSNTRTLLLARDRLGVKPLYYTTIDNRLLFASEIKSIVQYSGYEKAVDIGTLHDYLTFRHALGTETMFAGIKKLLPGHVMTYREGEVNISEYWDVPLVTVGNESEDFYIKKTRLLLEESVKMRLMSEVPLGIYLSGGIDSGIVTGLMSKMVDEPIETFSVGFGERGEIGELSQAQEAADFFGTNHHEIIVDQGAFKQNLKDIIWHNDEPIADPSALAMFQLSKMASKHVTVVLNGAGGDEVFGGYISYKVGLANQKYHKIVPKVIRQGLVRPFVNAISPHLSSKMYVGIQSATQEVEEHGFLFTKSVFSEEDKEDIYTDKIKDKIHHNTFEKATTSLFRGKRYSGAIDERSSAKNTDLLSKMMYADTKSYLVDHILLETDKLTMSSSIEARVPIIDHKVVEFAASIPQELKLRGMTEKYILKKVGQGMLPPAAQNRKKRPFRIPIDTWFKDELHEMSQQVLDESSIVEQGYFRPEVVKDIMKKHERAELLYNHQMYALLVFEMWHERFMKM

SEQ ID NO: 40413 - protein, 405 aa, Fulvimarina pelagi HTCC2506
MEDYYKIRRLPPYVFEEVNRLKAAARAKGADIIDLGMGNPDLPTPAFIVDKLCEVARDPRAHRYSASRGINGLRKAQAAFYERRFNVKLDPNRQVVATLGSKEGFANMAQAITAPGDVILCPNPTYPIHAFGFIMSGGTIRSLPAKPDEDFLRAMERAVVHSIPKPIAVVLNFPGNPTAFTATREFYKDVVDFAKKHEIIVLSDLAYSEIYFDDVPPPSILEVEGAMDVAVEFTSMSKSYSMPGWRIGFAVGNERLCAALGRVKSYLDYGAFTPVQVAAATAINQGDKAVAEIRQVYKKRRDVLVDSFGRAGWDVPPPPSTMFAWVPLPAAYKHMGSLEFSKLLVEEADVAVAPGVGFGEHGDDHVRIALVENEHRIRQAARNLKRFLASDEGEGQKVVPMRARA

SEQ ID NO: 40414 - protein, 189 aa, Brassica napus
MDPCSFVRIIVGNLAVRFPAPSSSSSSSAPSVSGISTSSTSPPNCYCKIKFKSFPRQIVSAPVIFRTESESETRCSTVAAFFSLSKYQIKASLNKPKLSVLSVETYSRGEGVTGASCGLASASEKLLGRFEVSLDLKAAETKTCLAHNGWVALRGKRRNKTGPDPELHVSVRVEPDPRFVFQFYGEPEC

SEQ ID NO: 40415 - protein, 238 aa, Methanococcoides burtonii DSM 6242
MLFNNMQAVILAGGKGTRLAPYTTVLPKPLMPIGDMPILEIVIRQLKKNGFTDIVLAVGHLAGLIEAYFGDGSKWGVNITYSIEDEPLGTAGPLSLIDDLDENFLVMNGDLLTNVNYSDLMRFHLENDALSTVSVYTKDVPISLGVLELDDNGKITDYIEKPTLKYKVSMGIYVFNRKILEHIKKGEYLDFPDLIKNLISLNENVSGYMFEGYWMDIGRYEDYSKVLEEFESMKDELL

SEQ ID NO: 40416 - protein, 394 aa, Methanosarcina acetivorans C2A
MKAVVYKGPRNVDVEEVKKPEIEKPTDVIIKVTSSGICGSDLHLYDGHGPDGLGTILGHEPMGVVEEVGDAVELVKPGDRVVIPFNVACGSCLNCIRGLTNMCLTMNPDAAIANYGYPGAGPYAGGQAEYLRVPYGDWACLKLPGEPGDEFEDDFVMLADIFPTAYYAAELAKVKTGKTVAVFGAGPVGLLAAYSSMLMGASEVYVVDKSDKRLKLAESIGAVPINFTDGDPVEMIMQIRQNNKNLMSSLRPGEEKVLGVDCAIDAVGYQALDRNNSEEFKPNQVLMDIARIIAPGGSIGVIGVYSPDPAGKDENEKQGYLTLPWAELWFKGVSIGTGPTPVKQMHGFLRNLIFNGKAKPSFIVSDRISIDEAPEAYKQFDKRDDVVKPIIKFH

SEQ ID NO: 40417 - protein, 453 aa, Synechococcus sp. WH 7805
MDQNFDLVVIGAGSGGLAAAKRASAYGARVALVEGDKVGGTCVIRGCVPKKLLVYGSQVSEHLADAPSYGVDVPPATINTHVLLKAVRAEVDRLNALHVNLLEKAGVTLIQGWGRFEDDHRIAVSSKPGGEALKVLNAGRILIAVGGRPRRPAIPGAELGWVSDDMFLLDRFPDHVVVVGAGFIACEFACILRGLGIAVTQLVRSDGLLRGFDRELAAAVQEGMIEKGVDLRLSTSPAAIEGAPGDLVLITDQGDRIPAGGVLLATGRQPFLQGLNLEAAGLRSDGRKLAVDADQRTSTSHIFAVGDVTDRICLTPVAVDEGRAFADTEFGGRPRQVNHDLVASAVFSQPELATVGLSEEAAISRLGADAVVIQRARFRSMAQALPKRGPRTLLKLVIEADTDKVLGCHMVGDHAAEIIQMAAIAVGMGATKADFDRTMALHPTVSEEFVTMA

SEQ ID NO: 40418 - protein, 666 aa, Burkholderia pseudomallei K96243
MTSPTLSFAQNRPLDVICVGRVAVDLYAQQIGARLEDASSFAKYLGGSSGNIAFGCARLGLKSAMLSRVGHDHMGRFVRETLAREGCDTSRLRTDTERLTALVLLGLKDRDTFPLIFHRENCADMALDEDDFDEAFIASSKALLITGTHFSTEQVMRASRRALDYARRNQVRTVLDIDYRPVLWGLTGKADGETRFIANEGVTAHLQRILPLFDVVIGTEEEFRIAGGKDALLDALAMVRAVTSAALVVKRGPLGCSIVDGDVPATLDALPVIRGVEVDVMNVLGAGDAFASGFLSQWLRGRPFADAARAANACGALVVSRHGCSPAMPTPAELAYFLAEAKRDPARMRRPDLDATLARLHRVTPARTPRDEVLGFAFDHRNQFFELARQTGASVARIDALKRLFVEAVAQTEAQLGLAGRIGVLIDDRYGQDALNDATGRGWWVGRPVELPGSLPLEFDHGRSIGTTLASWPLEHVAKCLVQYHPDEAAEPRIEQETQLRALYDAVQASGHELLLEVIPPRRADLPQAADTVYRALKRLYNLGIHPEWWKLAPLDAAQWQAIDALIAERDPYCRGVVLLGLSAGVDELVGGFGAAAASATCRGFTVGRTIFHEPSRAWLAGEIDDAELIARVRRTFETLIGAWRAARTDARARGRHAGAAPRVAA

SEQ ID NO: 40419 - protein, 520 aa, Colwellia psychrerythraea 34H
MYFYQALQRNATIFSNNIGTSFGDRERTWKEVEQRVAKLAGALVEHGVGQENHVAILAMNSDQYFEYYNAIPWIGGVVVPLNIRWSIKENIYSLENSQSSVLFVDDAFLEMGKELAKQCEKIQVIIYMGDGETPAGMLNYEQLIEHADAIAPVENDYSKLAGIFYTGGTTGFPKGVMLSHTNLWSSSIVVTAEMGLNVAGERYLHAAPMFHLADVGVSYAMVIGGLSQVFVPYFEATSVIEAIEHKQVNHVLLVPTMVTMMLATPALDNANFSSLKHIIYGASPMPEGTLIAAMEKMSSVKFIQAYGQSELSPVISILPAEYHVLEGPNAGKLRSAGRPAYCVSVEMRDENGKVLPTGKVGEIAASGPNSMLGYWNNTEQTAATLIDGWVLTGDAGYMDEDGFIFLVDRLKDMIVTGGENVFSAEVENALSHHPAIQESVVLGIPSEQWGESVHAILRLNEGQEITDEEIFSHCREYIAGYKVPQSIEIRVEAFPITGAGKIMKNELREPYWINETRAIN

SEQ ID NO: 40420 - protein, 404 aa, Oryza sativa (japonica cultivar-group)
MELHLTSRGALPLSPPLAGQRRPHLSLSTPSLPIKNHTYSVPPPFSKAHCAIGCQASLATNYMETSAVADLDWENLGFGLVQTDFMYIAKCGPDGNFSKGEMVPFGPIELSPSAGVLNYGQGLFEGLKAYRKTDGYILLFRPEENAIRMRNGAERMCMPAPTLEQFVDAVKQTVLANKRWVPPTGKGSLYIRPLLMGSGAVLGLAPAPEYTLKNFGLPCWELFQGLAPINLIIEENFHRAAPGGTGGVKTIGNYASVLKAQRIAKQKGYSDVLYLDAVHKKYLEEVSSCNIFIVKGNVISTPAIKGTILPGITRKSILEVAQRKGFMVEERLVSVDELLEADEVFCTGTAVVVSPVGSITYLGQRVEYGNQGVGVVCQQLYTSLTSLQMGHVDDCMGWTVELNQ

SEQ ID NO: 40421 - protein, 629 aa, Pseudomonas fluorescens Pf-5
MTTKLKNASNLSESAQVDQQSVQPFTRSQKVYVQGSRPDIRVPMREITLDVTPTDFGGEINAPVTVYDTSGPYTDPNVVIDVRKGLGDVRSAWIEDRGDTERLAGLSSNFGQQRLADPELTKLRFAHVNNPRRAKAGANVSQMHYARKGIITAEMEYVAIRENMKLQEARAAGLLKQQHAGHSFGASIPKEITPEFVREEIARGRAIIPANINHVELEPMIIGRNFLVKINGNIGNSALGSSIEEEVAKLTWGIRWGSDTVMDLSTGKHIHETREWIIRNSPVPIGTVPIYQALEKVNGVAEDLTWELFRDTLIEQAEQGVDYFTIHAGVLLRYVPLTAKRVTGIVSRGGSIMAKWCLAHHKENFLYTHFDEICEIMKAYDVSFSLGDGLRPGSIADANDEAQFGELETLGELTKIAWKHDVQCMIEGPGHVPMQLIKENMDKQLECCDEAPFYTLGPLTTDIAPGYDHITSGIGAAMIGWFGCAMLCYVTPKEHLGLPNKDDVKTGIITYKIAAHAADLAKGHPGAQIRDNALSKARFEFRWEDQFNLGLDPDTARSYHDETLPKDSAKVAHFCSMCGPKFCSMKITQEVREYAANQRIEAVDVDVAKGLAEQAERFKQEGSQLYKKV

SEQ ID NO: 40422 - protein, 466 aa, Arthrobacter sp.
MNQEGKLQKGLKIRHLTMIAFGGSIGAGLFVGSGAIIQMTGPAAVFTALMAGILVILIMRMLGEMVVAKPSLGSFSDYAREALGNWAGFTVSWLYWYFWVIVIAVEAIAGAAILKDWLFPNVSLWVLNLILLIALTITNIFSVKAYGEFEYWFSLIKIVAITLFLTLGGAYIFGLFPGIPMHLSNLTAHGGFIPNGAGIVFIAVATIIFSFVGSEIVTIAAAESAESEKAVVRAVNSVIVRIMTFYVGSVFIIVAVVPWNDAKALTNPYVSALKLMGMPGADMIMNLVVVTAVLSCLNSGIYTASRMLFALGDKGDAPKWMMHVTKTGVPLKAILTCTIFGFISVIMAFVSPETVFQFLLNSSGAIALFVYLLIAVSQLKLRKTIERETPERLKLRMWAYPYLTIATIIAMLMIITTMAFNASTRSQFILSLLSSAIVVAIYFIKTNLSKKQSLDTSIVNPENIKS

SEQ ID NO: 40423 - protein, 334 aa, Colwellia psychrerythraea 34H
MKIKVGINGFGRIGRFVFRAAVERDDIEVVGINDLMDIEYMAYMLKYDSTHGRFKGTVDVVDGKLIVNGNPVRVTAERNPENLQWNDIDVDVVVEATGLFLTDETARKHITAGAKQVVLSAPSKDDTPMFVCGVNLNEYKGQEIVSNASCTTNCLAPIAKVLNDNWGIQDGLMTTVHATTATQKTVDSPSTKDWRGGRGAGQNIIPSTTGAAKAVGKVIPALNGKLTGMAFRVPTPDVSVVDLTVNLIKPATYAEICQAMSAAAEGELNGILGYTEDAVVSNDFIGETCTSVFDAKAGIALTDTFVKVVSWYDNEIGYSNKVLDLVAFISQYEK

SEQ ID NO: 40424 - protein, 519 aa, Silicibacter pomeroyi DSS-3
MSQTSHDRLLIIDFGSQVTQLIARRLRELNVYCEIHPYQNVTMDFVREMAPRAVIFSGGPDSVTREGSPRAPQEIFDYGVPILGICYGQQTMMTQLGGRVESGHGTAEFGRAYVTPKGTLDILDGWFTDGREQVWMSHGDHVAEIAPGFEVYGTSPGAPFAITADTSRHFYAVQFHPEVHHTPNGAKLYENFVRLAGFKGDWTMGAYREEMIRTIREQVGDKKVICGLSGGVDSSVAAILIHEAIGDQLTCVFVDHGLLRKNEATEVVGMFRDNYNIQLIHADESDLFLGELDGQSDPETKRKIIGKLFIDVFQKHADTIEGAEFLAQGTLYPDVIESVSFSGGPSVTIKSHHNVGGLPEKMGLKLVEPLRELFKDEVRALGRELGLPQSFIGRHPFPGPGLAIRCPGEITREKLEILREADAIYIDQIRKHGLYDEIWQAFVAILPVRTVGVMGDGRTYDYACALRAVTSVDGMTADYYPFTHEFLGETATRIINEVKGINRCTYDITSKPPGTIEWE

SEQ ID NO: 40425 - protein, 480 aa, Zea mays
MAVSHNVGSKHGVAPLEVSVEAGNGGAAEGLDDDGRPRRKGTFWTASAHIITAVIGSGVLSLAWAIAQLGWVAGPAALLLFAFVTYYTATLLAECYRTGDPDTGKRNYTYMDAVRSNLGGTKVLLCGVIQYANLVGVAIGYTIASSISMKAVRRAGCFHVHGHGDPCRSSSTPYMILFGLVQILFSQIPDFDEIWWLSNVAAVMSFTYSSIGLSLGIVQTISNGGFMGSLTSISFGAGVSSTQKVWHTLQAFGDIAFAYSFSNILIEIQDTIKAPPPSESKVMQKATCVSVATTTIFYMLCGCMGYAAFGDNAPDNLLTGFGFYEPFWLLDVANVAIVVHLVGAYQVFCQPIFAFVERRAAAAWPDSAFISRELRVGPFALSLFRLTWRSSFVCVTTVVAMLLPFFGDVVGLLGAVSFWPLTVYFPVEMYIKHRRVPRGSTRWICLQTLSVTCLLVSIAAAAGSIADVIDALKVYRPFSG

SEQ ID NO: 40426 - protein, 197 aa, Oryza sativa (japonica cultivar-group)
MDSEHWISRLAAAKRFYAAQLGHADRAGMEEVDMDEEVRPEFACPYCYEDHDVVSLCAHLEEEHPFEPHAAPCPICSDKIAKDMLNHITVQHGYLFKVLLGGGGHRSNNSSNTTNISADPLLSSFGLSFPTSDTEETSKPPISIPDDASVIKETPAQPWDSSIDSSLTREEREQKRKQASVRATFVQDLLLTTLFGD

SEQ ID NO: 40427 - protein, 473 aa, Synechocystis sp. PCC 6803 [sequence omitted]

SEQ ID NO: 40428 - protein, 203 aa, Neurospora crassa
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMTDKKVVEYTVAKEFADSLGIPFLETSAKNASNVEQAFLTMARQIKERMGSSIATNNTKASVNVSPGHGVSNNSSGGCC

SEQ ID NO: 40429 - protein, 507 aa, Rubrobacter xylanophilus DSM 9941
MRLYTAEEMGRADRAAQEMGISGRVLMERAGVGMASLALERFSPRRAVAVCGGGNNGGDGFVVARELHRAGVEVEVLATREEYRGDPEANLRALKGLGVRMIRPEELGVSLGRADLVVDALLGTGFSGEVREREAALIRRINASPARVLAVDVPSGVDGSTGEVRGEAVRADLTVCAHALKVGCVISPGREHAGEVAAVDIGLPSEAEVEPSVVLNDAASLAGLIPRTAEPAHKYSAGALLVVAGSRAMTGAAVMTVAGAQRAGCGIVFLVTAAGAAPLLDARLTEAIVEGAPEDAEGHMGEGALEAVLGRAGRASAVVVGPGIGVGEGGRRLVEGIVREVEAPVLLDADAITNLSGSDALAAREAPAVITPHAGELGRLMGAGAREISASRLRHAREAAARHGCCVLLKGSDTIIAEGEKAAVNPTGHVALATAGTGDVLSGVIGALLSRGMGAYDAARAGAWAHGRAARLWLRETGWPAESLIATDLLPHLPRAFAELLEGRPPR

SEQ ID NO: 40430 - protein, 489 aa, Triticum aestivum
  misc_feature (115)..(115): Xaa can be any naturally occurring amino acid
  misc_feature (185)..(185): Xaa can be any naturally occurring amino acid
  misc_feature (216)..(216): Xaa can be any naturally occurring amino acid
  unsure (1)..(489): unsure at all Xaa locations
MAGGDEGSLVPREVPGSYGMPFVSAIRDRLDFYYFQGQDKYFESRVERYGSTVVRINVPPGPFMARDPRVVAVLDAKSFPVLFDVDKVEKKNLFTGTYMPSTSLTGGFRVCSYLXPSEPTHAKVKQLLFSLLASRKDAFIPAFRSHFSSLLATVESQLVLGGKANFNTLNDAPSFRVHRATPYFXGVLPLPRLDLGTTRALPKAAQGGSIFQPPPXLVHASGLPMILEEPLLHTVHLPPILVSGDYKVLYKYFNAAATKALDTAEGLGLKRDEACHNLLFATVFNSYGGLKVLLPGILARIAGAGEKFHQKLVAEIRAAVADAGGKVTVEALEKMELTKSAVWEALRLDPPVKFQYGRAKADMNIESHDAVFAVKKGEMLFGYQPCATRDPRVFGPTAREFVGDRFVGEEGRKLLQYVYWSNGRETESPSVDNKQCPGKNLVVLVGRLLVVELFLRYDTFTADVGVDLLGTKVEFTGVTKATSGPDSAV

SEQ ID NO: 40431 - protein, 353 aa, Catharanthus roseus
MMSRGATRISRSLICQISPRYFSSAAVRGHEPSLGILTSGGTTTFLHGNPGNGSERTALTWIKLPMMRARSASTVATVDQKDKDEKREDKNGVADGENGNKAVVSYWGVEAPKLTKEDGTVWRWTCFRPWETYKPDTDIELKKHHVPVTLLDKVAFFTVKALRWPTDLFFQRRYGCRAMMLETVAAVPGMVGGMLLHCKSLRRFEHSGGWIKALLEEAENERMHLMTFMEVSKPRWYERALVFAVQGVFFNAYFLTYLASPKLAHRIVGYLEEEAIHSYSEFLNELDKGNIENVPAPAIAIDYWQMPPDSTLRDVVMVVRADEAHHRDVNHYASDIHYKGLELKEAAAPLDYH

SEQ ID NO: 40432 - protein, 143 aa, Glycine max
GAFTEKQDALVSSSFEAFKANIPQYSVVFYNSILEKAPAAKDLFSFLANGVDPTNPKLTGHAEKLFALVRDSAGQLKASGTVVADAALGSIHAQKAVTNPEFVVKEALLKTIKEAVGDKWSDELSSAWEVAYDELAAAIKKAK

SEQ ID NO: 40433 - protein, 316 aa, Guillardia theta
EKGDFCALLASIQSACKIISRAVHRAGVDELHGALEHVNIQGEVVKRLDVLSNDTLIHFLCNSGQLCVATSEETEDIIRPPDYLTGEFVVTFDPLDGSSNIDAGVNVGTIFGIYRRISDSGPDGRQPGNIQDAFQPPKNLIAAGYTMYGASTILVLATEQGVNGFTLDTGIGEFIMTHPEIKLPTRGKTYSINEGNSASWDKSTTEFIAYCKSEDESKKCYSLRYIGTMVGDVHRTLCYGGIFMYPADARAKNGKLRLLYECGPMGYIVEKAGGRATTGKMQIRDIQPVELHERAPIFLGSKLDVEQVEAIYAKNS

SEQ ID NO: 40434 - protein, 348 aa, Prochlorococcus marinus subsp. marinus str. CCMP1375
MNLLAADIGGTKTLLGVFRYEGQIKQLYKAKYSSEDWDNFDLMLKDFIANLPSNITTPKYACIGVAGAINNKIVKLTNLNWQISQESLCKTLNTDEVILLNDFSCLVYAIPYLQQKQYKYIQSLKTNLDYQKEGSIFAILGAGTGLGMARGIITKSGLKAIPSEGGHREFSPRNNKEWELCQWLKKDLKLTRLSIERVVSGTGLANIARWRLSQEDTKSHPILSIIEANNSHNFNNKLLPERVSIAAKGGDPIMREVLEMWLSAYGSAAGDLALQELSTEGLWIGGGTAIKHLDGLSSEIFLNSLKNKGRFSEYLEKLPIMVLIDPEAGLFGAACKAHLMTKSNVKIN

SEQ ID NO: 40435 - protein, 787 aa, Ustilago maydis 521
MFMLKSLFGKIWGDSNNHELIQIPAGGLYLVRPNGPQGLRECIYEDAVLSIRRTTTEHHYQLVVTKAFQDSQAELTDDDDLEDERAYLIDQSLDFRLSTRGKERTIAWRDFEGDDDDLLEFVIDSKQVNEVTITIFEITYLQCVYEHAFRTSHERATEEDLDQLRYKDEADQKLRRENKRQLDKKLQDAGIGSTSTSASATTTTIATVVKAEQDAKPAPAIPATIAPVADTAGPQIDQDTTVFSAIADLYLYDLKSQYFLVQERKVDVRVLEAGRFLFWLSIRGADKVWLAQKVETDMNMNFSPEQTSAVWNYFTDDRQCFSWLLRFEDKEAYSHFHKGFSQVMYETQNEESWAKAKNDERAYAETAFEAGEPMDVDDISESEDGNESVRTAREEEDERYDDDEDEVAAALQGGRARSDESSWPEDSTSLLAGQQDVNSLLAVGYKFDRSFVARGDKIGVFRHTDDNKLEHDTTINNVGTPSGKGFRPLKMMLHNQDAQMVLMDPSNKNAVYNMDLEYGKIVEEWKVHDDVQVNNVVANSKYAQMTAEKTMIGHSHNGIYRIDPRLSGNKLVDSEFKQYASKNDFSVAATDSKGRLAVASNKGDIRLFDSIGKNAKTALPALGDPILGIDVSADGRYIIATCKTYLLLIDTLIGSGRYQGQLGFDRSFPADAKPQPKRLTLKPSHVAYMGSAISFSPARFNTGSDQETSIVTSTGAYVVSWSFKDVKKGNLGSYVLKRYGGEVISDEHAYGSDQAIVVAFEHDVQMAKRSQLLKPTRKSLAPTGFGR

SEQ ID NO: 40436 - protein, 351 aa, Ustilago maydis 521
MARNQEKAQSMLYRFREAQATSLGVSTKPARRPRLASSVSSLKECERWRSDVIREISRKVSKIQDFGLNDYEVRDLNDEINKLLREKGHWENQIVALGGANYKRGVPSMLGDDKGVVGRGGYKYFGRAKDLPGVKELFTSQKADEAGRSEERYERFRNLPPSYYGDEDEDDGLLLEQERSAEEVEWNERFWNVVQGLKHDLQSRDDHDNMHLTDAEDDEHGGIQVPKIPRPSPRPLKQSVQAVQASLSAAYNQRFMEHAATPAESTSKRAPQDELQTPAKRHKNEQGHPIPPTHHADAEPSRTTLEPPSVADYSIFSPEDLQPPPIPDRAAIEKLILQAKKKQLRQEYIGA

SEQ ID NO: 40437 - protein, 201 aa, Synechocystis sp. PCC 6803
MRGRTHGIIRPTLLRPIFLMKFFTAMRDILISLTVVTFFSLVLISVAIFGKSSPSAIAAPQEVKPVQIAQASALQTPEPSPMTAENSANIVTTESGLQYIDEVVGEGPSPTKGQKVEVHYTGRLTDGTKFDSSVDRNKPFTFTIGVGQVIKGWDEGVATMQVGGKRKLIIPPDLAYGSRGAGGVIPPNATLEFEVELLGIK

SEQ ID NO: 40438 - protein, 1073 aa, Methanosarcina mazei Go1
MPKREDIKKVLLIGSGPITIGQAAEFDFSGSQACRSLKEEGVQVVLVNSNPATIMTDPEMADSVYIEPLDARIIEKIIEKERPDGIIAGIGGQTGLNITSELAEMGVFEKYGVQILGTPVEAIKNTEDRELFKETMLSIGEKVPLSRAVHSLKEAEEVVEELGLPLIIRPAYTLGGAGGGIARTKEELLEITERGLRRSRINQVLIEESVLGWAEVEYEVMRDANDTCIVICNMENIDPMGVHTGESAVVAPSQTLSDEEHQMLRSASIKIIRALKIEGGCNIQYALKEGDYRIVEVNPRVSRSSALASKATGYPIARVTAKIAIGMTLDEIVNSVTKSTPASFEPALDYVITKIPRWPFDKFTTADKTLTTAMKSTGEIMAIGRTIEESLLKAFKSLDIDNQLGIKRWDEPEIKTLLKTPTSERLFVIFHALERGMSIKEIAELTSINPFFISKMKKIVEMEKCIRTEELTPEFLREVKRMGFPDSRLAELTGKTREQISDFRHEEGILATFKMVDTCAAEFEAATPYYYSTYEDTCETNSTDKKKILILGAGPIRIGQGIEFDYCTVHAVTALREEGIETHIINNNPETVSTDFDTSDKLFFEPLTMEYVMNVIERERPDGVLVQFGGQTSVNLALPLKKELKRRTDLNTVILGTDPEDMDLAEDREKFYLLMQELGIPQPEGGYATSQQEAIEVAKRIGFPVLVRPSYVLGGRAMEIVYDEIDLERYMKEAVRVSPEHPILIDDFLEAACEIDVDAVCDQIDVLIGAIMEHIEEAGVHSGDSACVIPPQSLSKEVLDQVRDYTRKIALGLRVKGLINIQMAEKGGKVFVLEANPRSSRTIPFVSKAVGIPLAKIAAKVIAGHSLKDLGYTDEPKPKHVSIKEVLLPFDKLPGADPVLGPEMKSTGEVMGVDYDFGRAYYKAELAADNLLPLTGKVFLSIRNADKPELVEAARKLQAAGLELMGTRGTVNYLAQHGIFMDTVKKVHDGSPNVIDMMRRDEVDLIINTPTSKMSRKDGYRIRRAAVDFKVPYITTIQAAVAAADAIETMKKGQDLTIKSINEYHKEMEQKEE

SEQ ID NO: 40439 - protein, 248 aa, Glycine max
CFDLILLQNGTTEEVKKIVTTLNEAKVPGEDVVEVVVSPPFVFLPVVKSLLRPDFHVSAQNCWVRKGGAYTGEVSAEMLVNLGIPWVIIGHSERRQLLNESNEFVGDKVAYALQQGLKVIACIGETLEQREAGTTTAVVSEQTKAIAAKISNWDNVVLAYEPVWAIGTGKVATPAQAQEVHADLRKWVHDNVSAEVAASVRIIYGGSVNGGNCKELAAQPDVDGFLVGGASLKPEFVDIINAATVKKN

SEQ ID NO: 40440 - protein, 847 aa, Azoarcus sp. BH72
MSMDRRDFIKANAVAAAAASAGIGIPVVAQAQPNGANTKVRWDKAACRFCGVGCSVLVGVQNGRVVATQGDPDAPVNRGLNCIKGYFLSKIMYGEDRLTKPLLRMKNGKYDKNGEFTPISWDQAFDIMAEKWKAALKEQGPDSICMFGSGQWTIWEGYAASKLWKAGFRTNNIDPNARHCMASAVTGFMRTFGIDEPMGCYDDIENADAFVLWGSNMAEMHPILWTRITDRRLSREGCEVHVLSTFEHRSFELSDNGMIFTPQTDLAILNYICNYIIQTKRVNTAFVNTNVKFKAGETDIGFGLRPTHALEQKATSNGYPGADGKPKGDVNAAKDISFEEFAKFVSDYTLEKTAKLTGVPAERLKRLAEVYADPNKKVMSFWTMGFNQHTRGTWVNNMIYNVHLLVGKISEPGNSPFSLTGQPSACGTAREVGTFAHRLPADMVVANPMHRAIAEEIWKLPEGTIPAKIGLHAVAQSRALKDGKLKCYWTSTTNNMQAGPNVNEEIYPGWRNPNAFVVVSDVYPTVSALSADLILPSAMWTEKEGAFGNAERRTQFWRQQVTAPGEAKSDLWQYIEFSKRFKVEEVWPADLIAKKPEVKGKTLFDVLFANGTVNKFPLSDVEKANAHAIPGYMNLESKALGFYLQKGLFEEYAQFGRGHGHDLADFDVYHKARGLRWPVVEGKETLWRFREGYDPYVKQGEGVKFYGHKDGKAVVFALPYQDPPEMPDKEFDMWLCTGRVLEHWHTGSMTRRVPELHRAVPEALVFMHPEDATQRGLQRGMVVKIASRRGEVVARLETRGRNKPPKGLIFVPFFDEGRLVNKLTLDATCPISKETDFKKCAVKVMKA

SEQ ID NO: 40441 - protein, 467 aa, Synechocystis sp. PCC 6803
MVHKKIDLNQLSEAESLLTPTYAARGLANSVSKYEMPETEMLPAIAYNLIHDELGLDGNSRLNLATFVTTWMEPEARQLMADTFDKNMIDKDEYPQTAEIELRCVNILSRLWNAPASAEATGCSTIGSSEAAMLGGMAMKWKWRQRRQAAGKPGDRPNLVMGINVQVCWEKFCRYWEVEPRFVPMEGDRYHISPEEAVKLIDENTIGVIGILGSTFDGSYEPIEALNDALETLNQRTGWQVPLHIDAASGGFIAPFLDPDLRWDFRLPWVKSINTSGHKYGLVYPGVGWIIWRDKEELPEELIFHCNYLGGDLPNFALNFSRPGNQVVAQYYNFLRLGKEGYRKIQQTCRDTALYLSGKIAQLGPFELLTDGGDIPVFAWRLKDEVLANTCYTLYDMADKLRERGWLVPAYRMPKNREDLVVQRIVVKEGFSRDMADLLLADMERAIAYFASQPDHKPKQEGSHFSH

SEQ ID NO: 40442 - protein, 372 aa, Synechococcus sp. WH 5701
MIRSRAAVAWAAGQPLEITEIEVAPPAAGEVLLRVVASGVCHTDAFTLSGQDPEGLFPAVLGHEGGAIVEEVGADVTSVAVGDHVIPLYTPECRACSFCLSGKTNLCQAIRGTQGRGLMPDGTSRFSSAGRLIHHYMGTSTFSEYTVVPEIAVARISKEAPLEKVCLLGCGVTTGIGAVLNTAKVEPGSTVAVFGLGGIGLAVIIGAVMAGASRIIGIDTNPEKFAIARQLGASDCLDPGAFDAPIQEVVIDLTDGGVDYSFECIGNVQVMRAALECCHKGWGESTIIGVAGAGQEIATRPFQLVTGRVWRGSAFGGVRGRTELPGYVERFQSGEIPLDTFITHTMPLEEINRAFELMHAGQSIRSVIHFNR

SEQ ID NO: 40443 - protein, 707 aa, Ostreococcus tauri
MEREFVNFFQKFEIPGNRESSTYAEKLQHDECRLVVNLDHVRMFRPSLAQSILNDPGTALSAMKTAVESLSAKLTSAVHLSVSGNFGSYELSPRQLLSRYINKMVKIHGIVTKCSAVNPKVQTLVQYCPSTGKLSNGQTYRDVTTLTGNITGSSYPIRDQSGNALEIEYGLGTYIDHQRICVQELPEKAPAGQLPRSIDVILEDDLVDACKPGDRVSVVGIYKIVPVQQSSTCVFHTVLVANHCEKLLKEASIVPNLNEVEDMKKMAHSIEANQLLKLLGRSLAPSICGHEHIKQALILLLVGGNEKNLENGAHIRGDINCLLVGDPSVAKSQLLRSVMGVAPFAISTTGRGSSGVGLTAAVTSDAETGERKLEAGAMVLADRGVVCIDEFDKMNDIDRVAIHEVMEQQTVTISKAGIQASLNARCSVVAAANPLYGSYDHAQSLSRNINLPDSLLSRFDLLFIIHDTSDASVDRTVSSHVLQLHAQYSSILNAQSNRIGAELRTPIETRNTERWSFCSARTDPEGGTLSKGDLQKYLSFAKDRPWVQQLTTEAELCIAEQYAIWRLAKVGKSKQAASSVPITARTLETMIRLASAHAKLRLSRSIDKMDALEAIRLLKYTVDASDGASVSLGSDSFGETSQEGDSTLFKKGFSVLRAHRNAIPLDELTRSATTWSPNLNAEAVMRMLEDMQNSNEILVHEGTVHII

SEQ ID NO: 40444 - protein, 559 aa, Synechococcus sp. WH 5701
MAPLRFLGGPSTDKFSLGSRFVKPARMTTLPDYSFHEPQVQWQRFCDLLWHHDDLGIWVDVSRMELNQAHLEALEPAFDRAFTAMQALEAGAIANPDEGRQVGHYWLRTPDLAPDPEAAAHIKAEVERIDAFGQQVIGGACPAPSGTPFTDVLWIGIGGSGLGPLLILRALKEEGLGLPFHFFDNVDPQGMSRTLSALGERLLTTLVVVVSKSGGTPEPRLGMEQARARLEALGGSWAQQAVAVTMVGSQLDQRAEAEGWLARFDMFDWVGGRTSITSAVGLLPAALIGADLHGFLEGAARMDAATRAANLRENPAALMAAAWHVAGGGAGGRDMVVLPYRDRLEVFSRYLQQLVMESLGKRLDRDGREVHQGIAVYGNKGSTDQHAYVQQLRDGVDNFFVTFIEALDDPADVAPVDGDYPGDFLDGFLQGTRSALTEGGRQSLSISLRRFDARSLGALVALFERAVGLYGELVNVNAYDQPGVEAGKKAAATILDLQGRVEALLADGQARSVAAIGEELQLPSPEAAFWILRHLCGNDRGFSAEGDWGDPAGLVFRKV

SEQ ID NO: 40445 - protein, 475 aa, Methanosarcina mazei Go1
MEGERFLNHRTPEELEKWKNTGKTEGSEDSMKELETEFNSFEQEVGLLDTVGPKAREIIGQDCNMVSACVSRPYPLVVDRAKGSVVRDIDGKEYIDFVAGIAVMNAGYSNPEVQAAISAQLEKMVHCGYGDFFAEPPLKLAKKLRDLSGYSKVFYCNSGAESIEAAMKLSLWKTKRQNFISFYNAFHGRTLGALSLTCSKVRHKEHFPTIRTVHTDYAYCYRCPLNLDYPSCGIECAKQIENLVFRRELSPEDTAAVFVEPIQGEGGYIVPPVEFHKEVRRICTDNDVLLVADEVQTGCFRTGPFLAMENFEVRADITCLAKALGSGLPIGAMLADNELMDWPPGVHSNTFGGNLLSSAAALASLEFLEKENTENHVREMGAHIRHRLRELQENFPCIGDVRGLGLMTGVEIVKPDKSIDPVRRDKIIREAFKDGVLLLPCGDSVIRFSPPLVMTDEEADLGLDKFEKALKKAVR

SEQ ID NO: 40446 - protein, 329 aa, Rubrobacter xylanophilus DSM 9941
MILAIETSCDDTCAAVVEPDGRRALSNAVHTQTEHARYGGVVPEVASRAHLERMDGVVRKALSDAGVSLDQIDRVAVTVRPGLIGALLVGVAAAKGVAYARRLPLVPVNHLEGHVAAAYLEAPDLEPPFVALVASGGHTALYAVGEDRGMRLLGETLDDAAGEALDKGARMLGLGFPGGPAISRAAAGGDPERYGFPVALKGRDNLDFSFSGLKTSLLYRIRELGPERVRRELPHLAASYEAAVVEALARKLLRAAELREAGAVVVAGGVAANGRLRERLRRECAGRGLRLVIPHPSLCTDNAAMIGAAAAHTPKIPWPEYLSLNARSV

SEQ ID NO: 40447 - protein, 305 aa, Vaccinium corymbosum
MGSIASAVTHEFPPYFRVYNDGRVERFKVPADYSPPSVDPETGVESKDVVISEETGVKVRIFLPKINCLDQTKLPLLVHYHGGAFCVGSSLDVVTTRLLNLQTSVANVVTVSVDYRLAPEHPLPIAYDDSWSALQWIATHLNGKGPELWLNEHVDFGRVFLTGDSVGANIAQHMAVRLGVTGLDGFRVRGAVMVHPYFAASEPDKMIQCLYPGSSGTDSDPRLNPKADPDLEKMGCEKVLVFVAEKDWFKPRGVEYCETLNKSEWKGTVELVENEGENHVFHVPNPACEKALLLMQKLASFVNQG

SEQ ID NO: 40448 - protein, 449 aa, Magnetospirillum magnetotacticum MS-1
MPLSVLFVFGSLFAVVVAELVAALVAWGMVGHVPAVVWAGAFFAPLAVAPVELAVLVAVIGRMRDEMGRRRRAEMDLREDVARRREVEAGLRSNEEKLRAMFEMSPLGMARSTQDGAFLEANSAFLSIVGYDLEELRTLSFWDLTPFRFAENEACNLDSLEAVGHFGPYEKEYIHKAGRHVPVRLSGVLITGSDGESYLWSIVEDITEAHSAEQALIAKTEELARSNSDLEQFAFIASHDLREPLRMVSAYMGMLERRFGSMIGPEGADYIAYAKEGAQRMDRLVLDLLEYSRVGRMEEELQPVPLDEVLDGVIANLSPSIAQCGAQVERAAPLPSIPVIRGEMVQVLQNLIGNAVKYREPSRPLRVLVSAVRDGGLWRISVADNGIGIAPEFGDRIFRIFQRLHTRDRFEGTGIGLAICKRIVERHGGRIWVDSVQGDGATFSFTLPG

SEQ ID NO: 40449 - protein, 311 aa, Clostridium perfringens
ARVPVVALIGLTLLPVSIDWAAGGAGSANYASLENLAVAMFVLIITLLLNNYGKGMISSASILIGIVVGYIVCIPLGLVDFTSVKEASWLSFPKILEFGVTFDAKAVMAFIPAYFVATIGTVGMLKSYWRDILLLIFGDKRVAAGVLSDGVGSALGGLVGSCPNTSFSQNIGIISLTKVASRHVAVMAGILLVILGFLPKVAAIITGIPNPVLGGVGIMMFGTVAAAGIRTLSNIKLTERNLLIIAISMGLGLGVTFRPDVIHNLPEAIRMIFSSGISTGTIAALILNAVLKESPTSMEFENMYDEETKAS

SEQ ID NO: 40450 - protein, 506 aa, Rubrobacter xylanophilus DSM 9941
MIVVLDFGGQYAQLIARRVREARVFSELLPYDTPLEEIRRRDPEGIILSGGPNSVYERGAPRVDAALFDLGVPVLGICYGMQLMALTLGGEVGAVQIREYGRSKLEVRGHGELFSGTPDEQTVWTSHGDAVLAAPPGFRVTARTPSVPILAFEEPSRGLYGVQFHPEVRHTEYGMEILKNFLFEACGCAPDWTPVNIVTEAVERVREQVGASRAICALSGGVDSATAAMLVHRAIGDKLTCVFVDHGLLRQNEAEQVVEAFRREAGLPLVHVDARERFLDRLAGVTDPEAKRKIVGEEFIRVFEEEAGKIRDARFLVQGTLYSDVIESGTRDAARIKSHHNVGGLPEVMDLELVEPLRNLFKDEVRVVAAELGMPERLVWRQPFPGPGLAIRIIGEVTAERLEILRKADAVLQDEIRSAGYYRRLWQSFAVLPAVHSVGVMGDARTYAYPIVIRAVTSDDAMTADWARLPYDLLERISNRIINEVPGVNRVALDITSKPPGTIEWE

SEQ ID NO: 40451 - protein, 457 aa, Prochlorococcus marinus str. MIT 9312
MEEKKSFLKKKIDLKSPNKNIVPITTTIGNDGKLSVGGCSIEELVKKYDSPLYILDEITLRNSCRAYKNALEKYYPGKSLPIYASKANSSIFMSNLVSSEGLGLDAVSEGELLTALKGGVPNEKIVFHGNNKSDKEIEFAVRNNIQVIVDNDYDLERLEGISNSFNRDLEIMIRFTPGIECHTHEYIRTGSFDSKFGFGIEYLNILFDRINNTKHLKLKGLHAHIGSQIFELDPHKDLGEIMVNVILDAKKFGHNIQKLNLGGGLGIKYTENDDPPSIDEWVKTISTSVVKACKKHNLDLPTLMCEPGRSIVSTAGITIYKIGAFKEIPGIRTYLSVDGGMSDNPRPITYQSNYSACLVSNPFNINSKNKYTIAGKHCESGDVLFKEIELADCKTGDLICVFGTGAYNNSMSSNYNRIPRPAALLVCNGEAEIIQKRESPFDLLKYDVLPDRFLKQN

SEQ ID NO: 40452 - protein, 516 aa, Zea mays
  misc_feature (47)..(47): Xaa can be any naturally occurring amino acid
  unsure (1)..(516): unsure at all Xaa locations
MVSESNRGGADRTTAAGEERGQLLFDVPEIRFTKLFINGSFVDAVSXRTFETRDPRTGGVIASVAEADKEDVDLAVRAARAAFDHGEWPRMSGSERGRIMARLADLVEERADELAALESLDAGKHPAVTRAVDVGNAAGSLRYFAGAADKIHGETLKMPGQFQGHTLREPLGVAGVIIPWNFPSTMFAVKVAPALAAGCALVVKPAEQTPLSALYLAQLAKQAGVPDGVINVVPGFGPTAGAALASHMDVDMVSFTGSTEVGRLIMKASAESNLKPVYLELGGKSPLIVFDDADLDMAVELAVGASFFNKGEACVAASRVYVQERVYDRFEERLAERMRSWVVGDPFSDPSADQGPQVDKAQYERVLSYIDHGKREGATLLTGGRPCGPEGKGYYIEPTVFTNVKEDMIIAKEEIFGPVMCLMKFKTVEEAIARANDTRYGLGAGVVTRDLDVANRVVRSVRAGVVWVNCYFAMGSDCPFGGRKMSGFGKDEGMHALDKYLAVKSVVTPLRASPWI

SEQ ID NO: 40453 - protein, 702 aa, Arabidopsis thaliana
MRLLVFVNPGRTGPYLNYEHFPNVIESFVPSSLRSDQNQKCYDSVSSSLSFVILSNPALFSPSALMVLPLFRRAAIARTSSLLRARLFAPASEFHSRFSNGLYHLDDKISSSNGVRSASIDLITRMDDSSPKPILRFGVQNFSSTGPISQTVLAMPALSPTMSHGNVVKWMKKEGDKVEVGDVLCEIETDKATVEFESQEEGFLAKILVTEGSKDIPVNEPIAIMVEEEDDIKNVPATIEGGRDGKEETSAHQVMKPDESTQQKSSIQPDASDLPPHVVLEMPALSPTMNQGNIAKWWKKEGDKIEVGDVIGEIETDKATLEFESLEEGYLAKILIPEGSKDVAVGKPIALIVEDAESIEAIKSSSAGSSEVDTVKEVPDSVVDKPTERKAGFTKISPAAKLLILEHGLEASSIEASGPYGTLLKSDVVAAIASGKASKSSASTKKKQPSKETPSKSSSTSKPSVTQSDNNYEDFPNSQIRKIIAKRLLESKQKIPHLYLQSDVVLDPLLAFRKELQENHGVKVSVNDIVIKAVAVALRNVRQANAFWDAEKGDIVMCDSVDISIAVATEKGLMTPIIKNADQKSISAISLEVKELAQKARSGKLAPHEFQGGTFSISNLGMYPVDNFCAIINPPQAGILAVGRGNKEVEPVIGLDGIEKPCVVTKMNVTLSADHRIFDGQVGASFMSELRSNFEDVRRLLL

SEQ ID NO: 40454 - protein, 527 aa, Medicago truncatula
MTIGNIFKDEASEEKGERARMSSFVGAMAIADLVKTTLGPKGMDKILQSTGRGREVTVTNDGATILKSLHIDNPAAKVLVDISKVQDDEVGDGTTSVVVLAGELLREAEKLVAAKIHPMTIIAGFRMAAECARSALVEKVVDNKGDAEKFRSDLMNIARTTLSSKILSQDKEHFAKLAVDAVMRLKGSTNLESVQIIKKPGGSLIDSFLDEGFILDKKIGLGQPKRIENAKILVANTAMDTDKVKIYGARVRVDSMAKVAEIEGAEKEKMKEKVNKIIGHGINCFVNRQLIYNFPEELFADAGILAIEHADFDGIERLALVTGGEIASTFDNPESVKLGQCELIEEIMIGEDKLIKFSGVAMGQACTIVLRGASHHVLDEAERSLHDALCVLSQTVNDSRVLLGGGWPEMVMAKEIDALARKTPGKKSLAMEAFSRALLAIPTTIADNAGLDSAELISQLRAEHQNEGCTAGIDVISGSVGDMVERGICEAFKVKQAVLLSATEAAEMILRVDDIITCAPRRREDRM

SEQ ID NO: 40455 - protein, 867 aa, Medicago truncatula
MFHTIMNVLSIHDDNNKNKNDRIMRGEVILMKKNVLDFKDLSASFFDGIHELVGKRVSLQLVSADKGDPGNGMKGKVGKPAYLEDWNSTITPLIAGESTYKVTFDLDDDDDIGTPGAFLIKNNHHSEFYLKSLKLQNVPGQGVIHFTCNSWVYPSQKYQKDRIFFSNKTYFLSETPAPLLKYREEELETLRGSGDSIQLKEWDRVYDYAYYNDLADPDKGPKYVRPVLGGSSEYPYPRRGRTNRPPAKSDANSESRLNLAMSLDIYVPRDERFGHVKMSDFLAYAIKAIVQVIKPELESLFDSTPNEFDSLEDVLKLYEGGIEVPEGAVKRIRDKIPAEMLKEILRTDGQKLLKYPVPHVIKEDKSAWRTDEEFAREMLAGVNPVIIRGLQEFPPTSKLDPNVYGDQSSTIRKSDIESNLDGLTVDEAIAQKKLFILDHHDALMTYLRRINSTSTKTYASRTILFLQQNGTLKPLAIELSLPHPNGDQHGAISNVYMPAENGVENSIWQLAKAYVAVNDSGYHQLISHWLHTHASIEPFIISANRQLSVLHPIHKLLHPHFRDTMNINALARQILINAGGLLEATVYPSKYAMELSSALYKDWTFPEQALPVDLVKRGMAIKDSASPHGLRLIVNDYPYAVDGLEIWFAINTWVQDYCSFYYKNDDTVKKDAELQSWWKELIQEGHGDKKNEPWWPKMQTVEELTETCTIIIWIASALHAAVNFGQYPFAGYSPNRPTISRRFMPEKGTIEYDELVTNPDKAFLKTITAQLQTLVGISLIEILSTHSSDEVYLGQRDSMHWTCDAEPLEAFDRFGKKLKEIEERIVAMNDDVNLKNRVGPVKMPYTLLYPRSEAGLTGAGIPNSVSI

SEQ ID NO: 40456 - protein, 195 aa, Brassica napus
  misc_feature (162)..(162): Xaa can be any naturally occurring amino acid
  misc_feature (167)..(167): Xaa can be any naturally occurring amino acid
  misc_feature (177)..(177): Xaa can be any naturally occurring amino acid
  misc_feature (182)..(182): Xaa can be any naturally occurring amino acid
  misc_feature (186)..(186): Xaa can be any naturally occurring amino acid
  unsure (1)..(195): unsure at all Xaa locations
MFSLHDGILCSKKRDQIKDYGESFHGSFKRIKQEDQTPARLEKNSTLFDQRLKSDNARLIKPDVQLHLETKFHSETLEDRKTYLDLELNLSSSSSSTIKTIAKKDESSKGKNLIMSPSKKRKSGDIKLSRSPSWLAFEGDDDQKKQEMVTTVCMKCHMLVMXCKSTXVCPNCKFTHXEYSSXKNFXSLSLFKLSY

SEQ ID NO: 40457 - protein, 348 aa, Glycine max
MCQALSAPSPPCTALLSFLFFLLTVVGPVSVSAWRPWPQKNNMNTTDYAFGDSKKYEGSSEFVKLRYHMGPVLTTNITVHTIWYGKWERNQKKIIREFINSISAANSAHPSVAGWWRTVQLYTDQTGANISKSVRLGEEKNDRFYSHGKSLTRLSIQTVIKSAITAKTRPLPINPRSGLYLLLTADDVYVQDFCTSVCGFHYFTFPSLVGYTLPYAWVGNSAKFCPGQCAYPFAVPAYIPNRKPFKSPNGDVGVDGMISVIGHEMAELATNPLANAWYAGQDPSFPVEIADLCEGIYGTGGGGSYTGQVLDARDGATYNMNGIRRRFLVQWVWSHVLNYCTGPNALDH

SEQ ID NO: 40458 - protein, 732 aa, Azoarcus sp. BH72
MDSAAVSAPPLPAAPQAEVWPDFATLRDKLASYLKADDLGRIDAAYHFAAAAHEGQFRISGEPYISHPVAVASIVADWNLDAQALIAALLHDVMEDTHISKAEIAERFGKTAAELVDGLSKLDKIEFRSQEEAQAENFRKMLLAMASDLRVILVKLADRLHNMRTLDYMRPAKRRRIAVETLEIYAPIANRLGLNNLYRELQELSFQHRYPLRYRVLAKAIKAARGNRREVVGKVLANIEERLPQWGIAADVQGREKHLYGIYRKMVEKHLSFSQVLDIYGFRVIVRDVQSCYLALGALHSMYKPVPGKFKDYLAIPKANGYQSLHTTLIGPFGTPVEVQIRTREMHHIAETGVASHWLYKEDEKTLTELQQKTHSWLQSLLELQSTSGEATEFLEHVKIDLFPGEVYVFSPKGKIFSMPKGSTPVDFAYAVHTDIGNRCVACRINGDLMPLRSELRNGDQVEIITAAHANPNPAWLSYVRTGKARAQIRHFLKSAQQEESVALGERLLNQALRPHGLTLGQISTFAWDRFLRDRGVRSKKEIFSDIGLGKRLPVIVARRLSQAQDQESGRPDVIKPKPAGAIMIRGSEGIAVQLARCCHPIPGDPIIGTIRKGQGLEVHLHDCPVVAKLRGDRGRWVDVEWEPGDDRMFDVTIRVLTKNARGVLAKVASVISEEECNIQNVSMDNEQGAYIALSFTLQVRDRMHLARVMRGVRRVQEVVRIGRVKGDGRVG

SEQ ID NO: 40459 - protein, 492 aa, Methanosarcina mazei Go1
MIREYKLLIGGKSVDSSTGETFDDINPATLENLATLQVAGIEDVDRAVEAAEAGFRVWSEVPAPGRAEVLFRAARIMQERKEGLARLMTEEMGKVLPETRGDVQEAIDITIYAAGEGRRMFGETTTSELRDKFCMTVLRPVGVVGMITPWNFPIAIPSWKIMPALIAGNAIVFKPASDTPLLTIKLVEILMEAGLPPGVINIVPGPGGSTGKAIVQHPRIRAISFTGSLDTGKWIMEECAKSMKRVSLELGGKNPVIVMDDANLELALEGVVWGAFGTTGQRCTATSRLILHEKIKDEFIKRLLAKTKSLRVGNGLLPETDVGPVINKAQLEKIEKYVRIGKEEGAAILVGGNRIDPGLPGYFFEPTIFTDVSPEMRIAQEEIFGPVLSIITVSDFDEAIEVANNIKYGLSSAIYTENVRTAFRAIEKLEAGITYVNAPTIGAEVHLPFGGIKGTGNGFREAGTEAIKEFTEVKAVYIDYSGRLQKAQIDTE

SEQ ID NO: 40460 - protein, 286 aa, Pseudomonas fluorescens Pf-5
MPQTKHPLPDVQLLTSGHLPHLNGRLRDAHKGQFGHLLLIGGDRGFAGAALLSAESALRSGAGLVSLATRSEHVAAAAARLPEVMTQGTHSANQLMGLLARATVLVVGPGLGQGAWGRSLLSAAANAPLPQVWDADALNLLAEGGLQLPAASVITPHPGEAARLLGISSAEVQADRPAAALALSKKYAAVAVLKGAGSLIATADGRLARCDVGHPAMATAGLGDVLAGLIGALLAQGLSAFDAACLAVWLHASAGEQQGKLGRGLAASDLIPAIRQLLEEQSPCLS

SEQ ID NO: 40461 - protein, 394 aa, Campylobacter coli RM2228
MNYKEQSHIIPTYKRFDIVLESGEGVYLLDDKGKKYLDFSSGIGVCALGYNHAEFNAKIKAQVDKLLHTSNLYYNENIAQAAKHLAKASGLERVFFTNSGAESIEGAMKVARKYAFNKGIKGGNFIAFKHSFHGRTLGALSLTANEKYQKPFKPLISGVKFAKYNDFSSVERLVNEKTCAIILESVQGEGGVNPAQKDFYKALRQLCDEKDILLIADEIQCGMGRSGKFFAYEHSGILPDVMTSAKALGCGLSVGAFVVSEKVAQKSLEAGDHGSTYGGNPLVCAGVNAVFEIFKKEKILENVSKLTPYLEQSLENLIKEFRFCKKRKGLGLMQGLSLDNSIKVAEVIKKCQENSLLLISCGENDLRFLPPLIIEKSHIDEMSEKLRKVFKSFE

SEQ ID NO: 40462 - protein, 292 aa, Zea mays
MAGSEQRVVAVIMVGGPTKGTRFRPLSLNVPKPLFPIAGQPMVHHPISACSRAFGSQIPHLAQIYLIGFYEEREFALYVSSISHELRIPVRYLREDKPHGSAGGLYSFRDYIMEDSPSHIVLLNCDVCSSFPLPDMLEAHKKYGGMGTLLVNKVSAESANQFGELVADPETNELLHYTEKPETFVSDLINCGVYIFTPDILSAIEDVLKQKKDRASGDGKRTATIVGDVYIHPSAKVHPTSKIGPNVSISANARVGAGARLINCIILDDVEIMLKKLVLGFFLKFNSSSMTA

SEQ ID NO: 40463 - protein, 149 aa, Staphylococcus aureus subsp. aureus Mu50
MERTFLMIKPDAVQRNLIGEVISRIERKGLKLVGGKLMQVPMELAETHYGEHQGKPFYNDLISFITSAPVFAMVVEGEDAVNVSRHIIGSTNPSEASPGSIRGDLGLTVGRNIIHGSDSLESAEREINLWFNENEITSYASPRDAWLYE

SEQ ID NO: 40464 - protein, 274 aa, Medicago truncatula
MASGGDHTHVHDHDHHHHDHDHKHGDSFIGADGKVYHSHDGLAPHSHEPIYSPGFFSRRAQPLINRDFNERAFTVGIGGPVGTGKTALMLALCQNLRDRYSLAAVTNDIFTKEDGEFLVKHKALPEERIRAVETGGCPHAAIREDISINLGPLEELSNLYKADLLLCESGGDNLAANFSRELADYIIYIIDVSGGDKIPRKGGPGITQADLLVINKTDLAQAIGADLGVMERDALRMRDGGPFVFAQVKHNVGVEEIVNHVLQAWEAATGKKRH

SEQ ID NO: 40465 - protein, 773 aa, Medicago truncatula
MDLSEEVRQAHKREFVDFLDQDIGKSIYMDEIKALINHKRRRLIVNISDLHNFRDLGNRILRNPSEYMQSFCDAVTETVRGSDPKYLKEGEQVLVGFEGPFVSRRVTPRDLLSEFIGSMVCVEGIITKCSLVRPKVVKSVHFCPTTGSFTSRDYRDITSNLGLPTGSVYPTRDESGNLLVTEYGMCKYKDHQTLSMQEVPENSAPGQLPRTVDIIAEDDLVDSCKPGDRVAIVGIYKALPGKSKGSVNGVFRTVLIANNVSLLNKEANAPIYSPEDLKNIKKIAERDDTFDLLGNSLAPSIHGHSWIKKAVILLMLGGVEKNLKNGTHLRGDINMMMVGDPSVAKSQLLRAIMNIAPLAISTTGRGSSGVGLTAAVTSDQETGERRLEAGAMVLADRGVVCIDEFDKMNDQDRVAIHEVMEQQTVTIAKAGIHASLNARCSVVAAANPIYGTYDRSLTPTKNIGLPDSLLSRFDLLFIVLDQMDPDIDRQISEHVLRMHRFRSAIDGGEAAHDGSARYGREEEADTESSVFVKYNRMLHGKKTDRGRKRDTLTIKFLKKYIHYAKHRIQPDLTDEASEQIAAAYAELRNAKSNAKTGGTLPITARTLETIIRLSTAHAKLKLSRKVSKSDVDAALKILNFAIYHKELTEMDEREEERERELERKRRADGENDGPDRGSKSKRNSTSDAMEVDDTSEAQPAVGLTPERIEAFNSLFGQHMRSNRLDQIPIADIEDVINRGAGSTYSSADVLLLLEKLQEDNRLMIADGIVHMVS

SEQ ID NO: 40466 - protein, 258 aa, Thermoplasma acidophilum DSM 1728
MTSAKYIFDFSGSTAVVTGAFQGIGKAIADALLDAGAEVYGIDKAFPDHGVDEGRFHGLHGSVDSLDDIASLRDRVAETSGRLDFLVNNAGIYFYKKIEDSTEDDYERITSVNLKGYFLMTREFLQLLRKSDYPSIVNIASVSGQRPEAGHPLYSMTKGGILALTRALSADLGMLGIRVNSVSPGNIKTPMNDEDILDQARKRGLDPDEVERQYAAESVLGRRGEAAEVASVVLFLLSKGASYINGADIVVDGGLLLV

SEQ ID NO: 40467 - protein, 107 aa, Prochlorococcus marinus subsp. marinus str. CCMP1375
MNLETRARIEDLINSHSIMVFMKGTKLMPQCGFSNNVVQILNALGKHFETFDVLSDMDIREAIKEYSNWPTIPQVYLKGEFLGGSDILIEMYNSGELLEKLEIALAS

SEQ ID NO: 40468 - protein, 518 aa, Rhodococcus sp. RHA1
MTLSNFAVLTPTQYLDRAAVTVAHRNAIIDGDLTFTYREFAERSNRLTGVLAARGIGVGDRVAVLCTNSHIMLELHNAVPLRGAVLVPLNIRLSEPELDYILEHSGATLLVATHEFADIAGSLAARRNIPLLQADGSDSAYETELVSAEPARVESDDDRTLLAINYTSGTTGRPKGVMYHHRGAYLQALAMTYHMGLGPGSRYLWTLPMFHCNGWCFPWAVTAAGGTHVCLRAVDPSEIWRHIREGATHFSAAPTVLSMIAEHAAAADGPTANPVKVSTGGAPPSPTLLRRMVKLNMQITHLYGMTETFGPAIINLWQPEWDSLGDQAAAEKQARQGVPNVITGGARVVDSAGKDVEPDGQAIGELIIEGNNIMLGYYRDDAATAAANVDGWLRTGDLAVMHADGYVEIRDRLKDVIISGGENIASVEVERVLDSHPAVVESAVVGIPHDRWGEVPIAFVTVRPGTEVHEEELVEFARQHLARFKVPKKIIFANLPRTSTGKIQKNVLRNATVDVIGQ

SEQ ID NO: 40469 - protein, 557 aa, Burkholderia pseudomallei K96243
MDIHTTRRLARHAPAGPSIPTHLVRQERQRMNKHWIRVSPIALAAAIGLTACGGDDVTSPGLSAVKNVVVIYAENRSFDNLYGNFPGANGLQNVTAASAAQVDRDGTPLATLPKIWGGLTAAGVTPAVTEAMTANLPNAPFAIDDPNGFNTPMSVTTRDLVHRFYENQMQIDGGKNDKYAAWSDAGGLVMGHYTADPSKLPLWKLAQQYTLADNFFMGTFGGSFLNHQYLICACAPFYPNADKSPAASQISVVNPDGVTLTTASNSPASALSGPPKFVKSGGLTPDFYAVNTMQPPYQPSANAAPTGGDPNLADPANPSTLPPQTQQNIGDLLTSAGVSWAWYAGAWGAALQAAQSGTSGVIYGPNMTSPNFQPHHQPFNYYANQAPGSANRAQHLLDAGSNGAALIQAIDAGKLPQVTFYKPQGNLNEHPGYTDVASGDQHIADVIAHLQKSPQWNNMVVIVTYDENGGFWDHVAPPKGDRWGPGTRIPAFVISPFAKQGFVDHTQYDTASILRFITRRFALPKLAGLKQRDDALVANGFKPMGDLTNALTLSTGN

SEQ ID NO: 40470 - protein, 176 aa, Prochlorococcus marinus subsp. marinus str. CCMP1375
MSLRIPIAAFALGAGFFFSSIPSISETSSSEEFRVLAKDEIGLSLNSVEKYLSDGDEFFARGDFDKARKKFDKAREMSKLLLGFYRDLGNSFKGIDARIPREMDSNSRKVLSLISRANLKLAILFRKTNRPELAVPLLVEVVRISSPANLEGQEAYQTLVELGFVNTTYRGARKRL

SEQ ID NO: 40471 - protein, 498 aa, Synechococcus sp. WH 7805
MAGRFSQQNQRVRPSSKEDQVVLKAREHFERTLIPVRGQLAGSVAALEHPRHDEALNYGEIFLRDNVPVMVYLLTQKRFDIVKQFLSICLDLQSTTYQTRGVFPTSFVEEKGQLIADYGQRSIGRITSVDASLWWPVLCWMYVKSSGDEEFASSQAVQRGVQLLLDLVLHPTFEGTPVLFVPDCAFMIDRPMDVWGAPLEVEVLLYGSLRCCAQIMELGRKHHGSRLLDQRLILTRQWVHDLRQFLLKHYWVTSKTMQVLRRRPTEQYGDNQHQNEFNVQPQVIPDWLQDWLENRGGYLIGNIRTGRPDFRFYSLGNSLGCLFGLLTAPQQRALFRLTLHNRDHLMAEMPMRICHPPMESLEWQNKTGSDPKNWPWSYHNGGHWPSLLWFFGSSILLHERRHPHADVLLMGQMKALLEECYWSHLNQLPRQQWAEYFDGPTGTWVGQQSRTYQTWTIVGFLLLHQFLRVNPDDVLLLDLDEGAVPDPDSIDSPVRHND

SEQ ID NO: 40472 - protein, 142 aa, Pseudomonas pseudoalcaligenes
MITPAPSALYPFWAPIRSQSLPAPHFSYTPVVRAGGCVFVSGLVALDPVLGTLINGGMEAQTRQILNNFERLSAELELGLDQLMLARIYCADFAQFSAINQVWEEFFSERIPPARTSVGVSALPLGALVEIEFQFAIDPLKP

SEQ ID NO: 40473 - protein, 218 aa, Methanosarcina acetivorans C2A
MLKAIIFDVDGVLVDSMRFQAEAWVKTLKEVGVTVSREDIYELEGSNNLGLIKLVFEKAGKEPEPWHYEQLPVKKREVLEFDRIKPFEGMPSCLNQLKKHFRLAMVSGSNFDVVSTFANSFFPDCFEVIITGGDLARGKPCPDPYLKALEKLDLATNECIVVENAPLGITAAKRAGLYCVAVASMLAPEKVKHADLVFENHAALLDYLKSLIPGESHT

SEQ ID NO: 40474 - protein, 249 aa, Archaeoglobus fulgidus
MDEKLLKTIAESKYLVALTGAGVSAESGIPTFRGKDGLWNRYRPEELANPQAFAKDPEKVWKWYAWRMEKVFNAQPNKAHQAFAELERLGVLKCLITQNVDDLHERAGSRNVIHLHGSLRVVRCTSCNNSFEVESAPKIPPLPKCDKCGSLLRPGVVWFGEMLPPDVLDRAMREVERADVIIVAGTSAVVQPAASLPLIVKQRGGAIIEINPDETPLTPIADYSLRGKAGEVMDELVRHVRKALSLKLN

SEQ ID NO: 40475 - protein, 249 aa, Archaeoglobus fulgidus
MDEKLLKTIAESKYLVALTGAGVAAESGIPTFRGKDGLWNRYRPEELANPQAFAKDPEKVWKWYAWRMEKVFNAQPNKAHQAFAELERLGVLKCLITQNVDDLHERAGSRNVIHLHGSLRVVRCTSCNNSFEVESAPKIPPLPKCDKCGSLLRPGVVWFGEMLPPDVLDRAMREVERADVIIVAGTSAVVQPAASLPLIVKQRGGAIIEINPDETPLTPIADYSLRGKAGEVMDELVRHVRKALSLKLN

SEQ ID NO: 40476 - protein, 149 aa, Zea mays
MITGGARRAAVLAAAALLCAAAAAPAVAQQASNVRATYHLYNPAQNGWDLNRVGAYCATWDAGKPPSWRQQYGWTAFCGPSGPKGQAACGRCIRVTNRGTGASTTARVVDQCSNGGLDLDFETVFKKIDTDGRGYQMGHLDVDYQFVGC

SEQ ID NO: 40477 - protein, 249 aa, Archaeoglobus fulgidus
MDEKLLKTIAESKYLVALTGAGVSAESGIPTFRGKDGLWNRYRPEELANPQAFAKDPEKVWKWYAWRMEKVFNAQPNKANQAFAELERLGVLKCLITQNVDDLHERAGSRNVIHLHGSLRVVRCTSCNNSFEVESAPKIPPLPKCDKCGSLLRPGVVWFGEMLPPDVLDRAMREVERADVIIVAGTSAVVQPAASLPLIVKQRGGAIIEINPDETPLTPIADYSLRGKAGEVMDELVRHVRKALSLKLN

SEQ ID NO: 40478 - protein, 107 aa, Synechocystis sp. PCC 6803
MNPETKARIDQLVTANKVMVFMKGTKLMPQCGFSNNVVQILNMLGIPFETLDVLADAEIRQGIKEYSNWPTIPQVYVNGEFVGGSDIMIELYQNGELQEMLEVALAS

SEQ ID NO: 40479 - protein, 249 aa, Archaeoglobus fulgidus
MDEKLLKTIAESKYLVALTGAGVSAESGIPTFRGKDGLWNRYRPEELANPQAFAKDPEKVWKWYAWRMEKVFNAQPNKAHQAFAELERLGVLKCLITQNVDDLHERAGSRNVIHLHGSLRVVRCTSCNNSFEVESAPKIPPLPKCDKCGSLLRPGVVWAGEMLPPDVLDRAMREVERADVIIVAGTSAVVQPAASLPLIVKQRGGAIIEINPDETPLTPIADYSLRGKAGEVMDELVRHVRKALSLKLN

SEQ ID NO: 40480 - protein, 319 aa, Staphylococcus aureus subsp. aureus Mu50
MAKLNMNNEIKKVEQRLEKAIKSKDSVLEQASLHLLSSGGKRVRPAFVILSSQFGKDEQTSEQTYQVAVALELIHMATLVHDDVIDKSDKRRGKLTISKKWDQTTAILTGNFLLALGLEHLMAVKDNRVHQLISESIVDVCRGELFQFQDQFNSQQTIINYLRRINRKTALLIQISTEVGAITSQSDKETVRKLKMIGHYIGMSFQIIDDVLDFTSTEKKLGKPVGSDLLNGHITLPILLEMRKNPDFKLKIEQLRRDSERKEFEECIQIIRKSDSIDEAKAVSSKYLSKALNLISELPDGHPKSLLLSLTKKMGSRNT

SEQ ID NO: 40481 - protein, 249 aa, Archaeoglobus fulgidus
MDEKLLKTIAESKYLVALTGAGVSAESGIPTFRGKDGLWNRYRPEELANPQAFAKDPEKVWKWYAWRMEKVFNAQPNKAHQAFAELERLGVLKCLITQNVDGLHERAGSRNVIHLHGSLRVVRCTSCNNSFEVESAPKIPPLPKCDKCGSLLRPGVVWAGEMLPPDVLDAAMREVERADVIIVAGTSAVVQPAASLPLIVKQRGGAIIEINPDETPLTPIADYSLRGKAGEVMDELVRHVRKALSLKLN

SEQ ID NO: 40482 - protein, 248 aa, Brassica napus
MMNQNVIVSDRKAILGSKTVTVSNSPLFSSPPTYFTFPRHKFLELLEAADKNSNNINKNNLGAGKIASWVDSMRDSSPTRLRSSSRDSVSDNDHKTSWIVRFPSALNMFDEIVNAAKGKQIVMFLDYDGTLSPIVEDPDKAYITHEMREVVKNVALNFPTAIVTGRSIDKVRGFVKLDEIYYAGSHGMDIEGPTSEYAYGGESNQGVLFQPAREFVPTIEKVYKILEEKTKWIPGAMVENNKFCLSVH

SEQ ID NO: 40483 - protein, 211 aa, Campylobacter coli RM2228
MDNLISGAIKFMQEDFKEHEELFESLKNKQNPHTLFIGCSDSRVIPNLITNTGPGELFVIRNIANIVPPYRVGQDYLATTSAIEYALNSLRIKNIVVCGHSNCGGCNALYYSDEELDKIPNVKKWLTMLDPIKRDVTIFARDDIAMRSWLTEKLNLVNSLQNIFTYPGVQEALDEGRLEVHAWYYIIETGEIYEYDFKTKIFKLIQNRKMQ

SEQ ID NO: 40484 - protein, 666 aa, Streptococcus pyogenes SSI-1
MMKKPFYITTPIYYPSGKLHIGSAYTTIACDVLARYKRLMGHEVFYLTGLDEHGQKIQTKAKEAGITPQTYVDNMAKDVKALWQLLDISYDKFIRTTDDYHEEVVAAVFEKLLAQDDIYLGEYSGWYSVSDEEFFTESQLKEVFRDEDGQVIGGIAPSGHEVEWVSEESYFLRLSKYADRLVAFFKERPDFIQPDGRMNEMVKNFIEPGLEDLAVSRTTFTWGVPVPSDPKHVVYVWIDALLNYATALGYGQANHANFDKFWNGTVFHMVGKDILRFHSIYWPILLMMLDLPMPDRLIAHGWFVMKDGKMSKSKGNVVYPEMLVERFGLDPLRYYLMRSLPVGSDGTFTPEDYVGRINYELANDLGNLLNRTVAMINKYFDGTVPAYVDNGTAFDADLSQVIDAQLADYHKHMEAVDYPRALEAVWTIIARTNKYIDETAPWVLAKEDGDKAQLASVMAHLAASLRVVAHVIQPFMMETSAAIMAQLGLAPVSDLSTLALADFPANTKVVAKGTPIFPRLDMEAEIDYIKAQMGDSSAISQEKEWVPEEVALKSEKDVITFETFDAVEIRVAEVKEVSKVEGSEKLLRFRVDAGDGQDRQILSGIAKCYPNEQELVGKKLQIVANLKPRKMMKKYISQGMILSAEHGDQLTVLTVDSSVPNGSIIG

SEQ ID NO: 40485 - protein, 467 aa, Colwellia psychrerythraea 34H
MKDFSKYNTKELWNNDLKHNMHPFTDFSSFKKEGSLIMAESEGAYVFDTDGRKYLDGIAGLWCVNIGYGNEEMGQAMLDQTRRIPYYSSFGHLTTPPAVELSTKLASLAPKSLSHVFYGTGGSMSNDTAVRMVHFYFNRIGKPNKKQIITRTDGYHGSTYLSMTLTGVEYDHIGFDLAPDLVHRVSAPNVYRRPAGMTVPEYCDFLVNEVEQKILSIGPENVAMFVAEPIAGAGGVLVPPEGYHQRVAAVCKKYGVFILSDEVVTAFGRLGEMFSSEKIFGFTPDIITCAKGLTSGYIPLSANMISDEIYDVISVPQAEGASFTHGFTYSGHPVSCAVGLKNIEIMERMDLCGHVREVGKYFENQLIEKLSNLPLVGDVRGSHFMMCIESVANKETKELLDPNIAIGNRIADKCQAVGLLVRPLAHKNILSPPLTLSVAEVDFIVSTLHKAIIDVQDDLVKEGLWHG

SEQ ID NO: 40486 - protein, 694 aa, Zea mays
  misc_feature (117)..(117): Xaa can be any naturally occurring amino acid
  unsure (1)..(694): unsure at all Xaa locations
MGHTSSGNEVPLKYSSGKAFPLGVSQVDDGLNFAIFSQHASSVTLCLNFPERGNQDDVDIVEFALDRQRNKTGDIWHVSVEGLPASGVLYGYRINGPQGWQQGHRFDDSVILLDPYXKLVYGRKHFAVEKEKPSQLFGTYDFDSSPFDWGDNYKLPNLPETDLVIYEMNVRAFTADESSRLAPAIRGSYLGVIDKIPHLLELGVNAVELLPVFEFDELELKRFPNPRDHMVNTWGYSTINLFAPMSRYASAGGGPVAASKELKQMVKAFHNSGIEVILDVVYNHTNEADDVNPYMTSFRGIDNKVYYMLDLNNSAQLLNFSGCGNTLNCNHPVVKELVLDSLRHWVKEYHIDGFRFDLASVLCRGPDGSPLDAPPLIKEIAKGSVLSRCKIIAEPWDCGGLYLVGRFPNWDRWAEWNGKYRDDIRRFIKGDPGMKGVFATRVSGSADLYQVNNRKPYHSVNFVIAHDGFTLCDLVSYNSKHNDANGEGGRDGCNDNYSWNCGIEGETNDLNVLSLRSRQMKNFHVALMISQGTPMMLMGDEYGHTRYGNNNSYGHDTHINNFQWGQLEERKDGHFRFFSEMIKFRHNHPILRRDRFLNKNDVTWHENRWENQDSKFLAFTIHDHSSGGDIYLAFNAHEYFVDAVIPPPPHHKSWSRVVDTNLESPKDIVPEGVPFTGSGYRIAPYSSILLKAKP

SEQ ID NO: 40487 - protein, 200 aa, Triticum aestivum
  misc_feature (184)..(184): Xaa can be any naturally occurring amino acid
  unsure (1)..(200): unsure at all Xaa locations
MSSSSSSKLFHSACKAARSFLASSHGYAWIAAIPAAVYMLQDQEVHAAEMERTFIAIKPDGVQRGLISEIVSRFERKGYKLVAIKLVFPSKQFAEKHYHDLKERPFFSGLCDFLSSGPVLAMVWEGEGVIKYGRKLIGATDPSKSEPGTIRGDLAVVVGRNIIHGSDGPETAKDEIALWFQPKXLVSYTSNEEKWFYGVN

SEQ ID NO: 40488 - protein, 486 aa, Pseudomonas putida
MKEIKHFINGAFVGSASGRTFEDINPSNGQVIGHVHEAGRAEVDAAVKAARAALKGPWGKLSVAERAEILHRVADGITARFDEFLEAECLDTGKPKSLASHIDIPRGAANFKVFADLLKNVANEAFEMATPDGAGAINYAVRRPKGVIGVISPWNLPLLLMTWKVGPALACGNTVVVKPSEETPLTATLLGEVMQAAGVPAGVYNVVHGFGGDSAGAFLTEHPDVDAYTFTGETGTGEVIMRAAAKGVRQVSLELGGKNAGIVFADCDMDKAIEGTLRSAFANCGQVCLGTERVYVERPIFDEFVARLKAGAESLMIGPPDDASSNFGPLVSLKHREKVLSYYQQAVDDGGSVITGGGVPDMPAHLAGGAWVQPTIWTGLSDDSAVVTEEIFGPCCHIRPFDTEEEAIELANSLPYGLASAIWTENGSRAHRVAGQIEAGIVWVNSWFLRDLRTAFGGSKQSGIGREGGVHSLEFYTELKNICVKL

SEQ ID NO: 40489 - protein, 51 aa, Escherichia coli
GIEDALTADGKPLLDVWMSHGDKVTAIPSDFITVASTESCPFAIMANEEKR

SEQ ID NO: 40490 - protein, 231 aa, Fulvimarina pelagi HTCC2506
MSDAKSLKRKAAEAAFAELDEGLNIGIGTGSTAEEFVRVLAEHVEADFEMTGVTTSERTETLCRELGVPTKTLDEIPILDVTVDGADEIDGDLRLIKGGGGALLREKIVAFSSAKMIVIADASKKVETLGAFPLPIEVNGFGLMSTFMAIRRVAETLDLTGDIVLRKNGDQPFITDGGHLILDASFGRIPDPEALSAALRSIPGIVEHGLFIKLASVAILASEDGIERLEA

SEQ ID NO: 40491 - protein, 301 aa, Triticum aestivum
MLPWATAAEAEAALGRAMTAAEALWFRWTAETSDYYLYCLNILFLLVVFTLAPLPVALLELRAPRAVGPYKLQPRVRLSRAEFIKCYGDVMRIFFLVIGPLQLVSYPAVKMVGIHTGLPLPSLGEMAAQLLVYFLVEDYLNYWIHRLLHGEWGYEKIHRIHHEYTAPIGFAAPYAHWAEVLILGIPSFAGPAIAPGHMITFWLWIILRQMEAIDTHSGFDFPFSLTKYIPFYGGAEYHDYHHYVGGQSQSNFASVFTYCDYLYGTDRGYRFHKAYLAKLKDLAPSDGKKEGADGFAYAKLD

SEQ ID NO: 40492 - protein, 550 aa, Rhodococcus sp. RHA1
MTATTAQLLTETTPWLRLSEHSEEIDRSHLRALFASDPDRVDEFTVTAGDLHIDYSKHLITRRTRELLLDLARSVDVEGNRDAMLHGEHINTTENRAVLHTALRLPRDASLSVDGQDIVTDVHETLEKMGVFTERLRDGRWRGATGKKITTVVNIGIGGSDLGPVMVYRALRHYADAGISLRFVSNLDPADLTDNLRGLDPAATLFIVTSKTFSTLETLTNATAARRWLVSALGEDAVTKHFVAVSTNAQPVAEFGIAPENIFGFWDWVGGRYSVGSAIGLSVMAAIGRERFTELLDGFHTIDEHFRTAPPESNAPLLLGMLGVWYSSFRGAQSRAVLPYSNDLVRFPAYLQQLTMESNGKSVHTDGSPVRCDTGEIFWGEPGTNGQHAFFQLLHQGTRLVPADFIGFAQSTDDLPTMSGTGSMHDLLMANFFAQSKVLAFGKTRKEIAAESASADLIPHKVMPGNRPSTTILAPRLTPSTLGQLIALYEHQVFVQGVVWGIDSFDQWGVELGKVQALALAPAVAGEAAPCTGDTSTDALIRTYRRLRHP

SEQ ID NO: 40493 - protein, 335 aa, Actinidia eriantha
MSNDHLETTGSSDPNTNLLKYLPIVLNPDRTITRPIQIPSTAASPDPTSSSPVLTKDLALNPLHNTFVRLFLPRHALYNSAKLPLVVYFHGGGFILFSAASTIFHDFCCEMAVHAGVVIASVDYRLAPEHRLPAAYDDAMEALQWIKDSRDEWLTNFADFSNCFIMGESAGGNIAYHAGLRAAAVADELLPLKIKGLVLDEPGFGGSKRTGSELRLANDSRLPTFVLDLIWELSLPMGADRDHEYCNPTAESEPLYSFDKIRSLGWRVMVVGCHGDPMIDRQMELAERLEKKGVDVVAQFDVGGYHAVKLEDPEKAKQFFVILKKFVVDSCTTKL

SEQ ID NO: 40494 - protein, 312 aa, Actinidia arguta
EYLPIVLNPDRTITRIYELPRTPASPDPSSSLPVLSKDVPINPKHNTSVRIFLPRKALDNSSPTTKKLPVIVYFHGGGFILFNADSSVFQDICVDLAVQARAMIVSVDYRLAPEHRLPAAYDDGVDALHWIRTSDDEWLRDFADLSNCFLMGSSAGGNIAYHAGLRAAAAVDDLAPLKIQGMVLHQPYFGGSDRTPSEMRSVDDPLLPLFVNHLMWELSLPIGADRDHEYCNLTVSSESESIETFKLLGWKVIVTGCDGDPLIDRQMELVKVLEKKGVRTIALFDEGGFHGVEFRDPTRMKAFLEFLIPCLN

SEQ ID NO: 40495 - protein, 429 aa, Salmonella enterica subsp. enterica serovar Typhi str. CT18
MKKQNNLRSLAAQAVELVVEQGQSLSNVLPPLQQKVADKDKALLQELCFGVLRTLSQLEWLINKLMSRPMTGKQRTVHYLIMVGFYQLLYTRVPPHAALAETVEGAVSIKRPQLKGLINGVLRQFQRQQETLLNEFATSDARFLHPGWLVKRLQNAYPTQWQRIIEANNQRPPMWLRVNRTHHTRDGWLGLLEDAGMKGYPHPDYPDAVRLETPAPVHALPGFAEGWVTVQDASAQGCAVFLAPQNGEHILDLCAAPGGKTTHILEVAPEADVLAVDIDEQRLSRVYDNLKRLGMKATVKQGDGRYPAQWCGEQQFDRILLDAPCSATGVIRRHPDIKWLRRDRDIAELAQLQAEILDAVWPRLKPGGTLVYATCSVLPEENRDQIKAFLQRTPDAALSETGTPDQPGQQNLPGGEEGDGFFYAKLIKK

SEQ ID NO: 40496 - protein, 584 aa, Colwellia psychrerythraea 34H
MSNNFTKVENPVLIVEGKQADNERLKAESDYLRGTIKDDLQDRMTGGFTSDNFQLIRTHGMYQQDDRDIRAERQKQKLEPLHNVMLRARLPGGIINPTQWLAIDKFADDYTSYGSIRLTTRQTFQFHGVLKPNIKLMHQTLNSVGLDSIATAGDVNRNVLCTSNPVESALHQEAYEWATKISEHLLPKTRAYAEIWLDEEKVETTEADEIEPILGSNYLPRKFKTTVVIPPNNDIDVHANDLNFVAISEGGELIGFNVLVGGGLAMTHGDKATYPRCADDFGFIPKEHTLAIAAAVVTTQRDWGNRVNRKNAKTKYTLDRVGVDTFKAEVERRAGIKFSESRSYEFTHRGDSFGWVEGIDGKNHLTLFIENGRILDFNGANSDSKALKTGMREIAKIHKGDFRLTANQNLIVAGVSAEDKTIIEQLAREHGLINDGVSNQRKSSMACVAFPTCPLAMAEAERYLPGLVDDVEAILEKNGLKDDSIILRVTGCPNGCGRAMLAEIGLVGKGPGKYNMYLGSDLAGSRVPKLYKENVDEAGVLSEIDALSARWSAERNDGEAFGDFVIRAGIVEQVIVSFRDFHHA

SEQ ID NO: 40497 - protein, 1026 aa, Cytophaga hutchinsonii ATCC 33406
MQNPFPGLRAFNVDESHLFFGREGQSDEVLDKLSKNKFVGIIGASGSGKSSFMFCGVIPILYGGFLSHVGPNWHVITTRPGGCPIDNLSEALLQKDAEYLVADAEDKRLKKTITSTLLKSSSLGLIEAVRQLHLDNGNNVLIVADQFEELFRFKRTEDTNTTNESLAYINLLMEAVKDLKSNIYVVITMRSDFIGDCAQFPELTKYINESHYLIPQMVREQKRLAIEGPVAVGGAEISSRLVQQLLNDLGDNPDQLPIIQHALMRTWTFWAENHEPEEILDLRHYEAIGSMSGALSQHADEAYDELTEQQKFYCEILFKTLTEKGSDSAGIRRPTKLSTIANVAGCSEDDMAHIIDHFRIEGRSLLMPPVHVALASDSIIDISHESLMRIWTRLKKWVEEEGESAQMYIRLSDAASSYQIGKAGLWRPPDLQLALNWKQKNKPTLVWAQRYDSAFERAMVFLDTSNEAHEEEQRLKELAQKQALKRARIIALVLGIFTIMALGSLVFSILKTVEANNQRIEAEKQKGIALTQEAEAKKQTGIAEQQTLEAQRQKDFAVLAAEEAKHQQGIAEKNFNEAQKQRNIAVTYATEATKQQKIAEMQRELAVKNEKQAKQEKQRADKLRLLSIAQSMAVKSVQMEEDTMRKALLAFQAYEFYKENGGNVNQHEIYDGLYYALKNLKVKDYNALHAHKDAVRSIAYTADGKGMYTAGSDGKIFSWDMTAANPKPKTVYNTNYALGALSLSSNGTMLASGGASPNIRMVNLTKEGDAPLLLKGHKKTVLYTAFSPDNQTLVSASADSTVMIWNLSSGVPITVYRDRHNIKAVSLHPKGRVIAVANDKGETMIISLYNEFTPYLIDRGTTADYSLQYSHDGEFLAIANNSGLIKIMDVEGRRLVVALPGHKARVNEMKFSKDDSKLASASFDGTIRVWDLSELSEQPLILKDHTNWVWSMTFNAEGDKLIAGCGDNLIRIWPTSSKIMADQMCDLIKRNMTGAEWKRYVAKDGVPYELTCPALPSQETNMNTIY

SEQ ID NO: 40498 - protein, 387 aa, Hyphomonas neptunium ATCC 15444
MTVTLNLSRPNSALPGKKRLTGLSVPALKAEMEALGLEPKAANMRARQIRRWIHHFGTTDFAAMTDIAKDLRAQLAEKFEVERPEIADHQVSRDGTQKWLTRYGPGIEGESVYIPDVGKAGALCVSSQVGCTLNCTFCHTGTQALVRNLTAAEIVQQVIIARDALSEWPSSIEERRLTNIVFMGMGEPLYNLDNVAEAIDTISDGDGMAIGRRRITVSTAGVAPKIPELGERTGAMLAISLHATNNDLRNELVPLNRKYDIQTLFDAIRAYPGLGNAKRVTFEYVMLKGINDTLAEARDLVKLMKGVPSKINLIPFNPWPGSPYECSDWETIEEFAEVLNRAGYASPIRTPRGRDILAACGQLRSESVKVRASELRKQQASAEGAES

SEQ ID NO: 40499 - protein, 425 aa, Hyphomonas neptunium ATCC 15444
MWTNSVDKALRDRAEAVIPGGMYGHQSVRLLPDDYPQFFDRASGAYLWDADGNRYVDYMCGYGPNLFGYGHETIDAAYINQLKKGDTMTGPAGLMVELAEQMTAMVSHADWAMFCKNGTDATTMAMMVARNFTRKNTIVLAKGAYHGAAPWCTPVKNGTAPSDRANQVFYTYNDVASLEEAVRKAGDDLAAIFASPIKHDTFVDQEDPTTEYARRARELCDENGALLIVDDVRAGFRLARDSSWARVGVKPDLSSWGKAIANGHPISALLGAEKARNAAATIYATGSYWFSAAPMAASLETMRLIRETDYLERTQSLGQRLRSGLDEAANRHGFALRQTGPAEMPLIMFEDDPGYSKGYAWNDALMKRGVYFHPWHNMFICAAMTEADIDHTIEVADDAFKFVRDAGTLPRIEKLAILGLLTDGH

SEQ ID NO: 40500 - protein, 742 aa, Zea mays
  misc_feature (189)..(189): Xaa can be any naturally occurring amino acid
  misc_feature (453)..(453): Xaa can be any naturally occurring amino acid
  misc_feature (585)..(585): Xaa can be any naturally occurring amino acid
  unsure (1)..(742): unsure at all Xaa locations
QPSSRRPHGSAEEKEAEAGDDNGSPIEQVALTVPAWDDPATPALTFRTWVLGTASCAALSFLNAFFGYRKEPLTVTAVSAQVAVLPVGRLMAAALPERAFFRGRPCEFTLNPGPFSVKEHVLITIFANAGAGTVFAKNLVTSVRVFYGQHMSFLIALLLILTSQVMGFGWAGVFRRYLVEPAAMWWPSXLVQVSLFRCNQALHEKERRRKGSMTRNQFFTVAFICSFAYYIFPGYLFQMLTSLSWICWVFPSSVIAQQLGSGLHGLGIGAVGLDWSSISSYLGSPLASPWFATANIAAAFFIVVYIITPINYWFNVYKARNFPIYSDGLYTVAGQKYNISSIMDSHFYFDTDAYEKSGPLYISTFFASSYGLSFACLTATVSHVLLFHGSEIWQLSKSAFYDKKMDIHTKLMRRYRQVPEWWFICILVASVSATMLTCEYYIEQLQLPWGGSXLACALAIFYTLPIGILKATTNQAPGLNVITEYIMGYLYPGRPMANMCFKVYGYVGPHQALEFLQDFKLGHYMKIPPRAMFTAQVVGTLIAGSVYLGTIWWLLDTIPDVCNTELLPAGSPWTCPYDHVFYKCXSVLWGIIGPRRIFGDLGTYSNLSWFMLAGSIAPLLVWCTHKAFPAQKWIRHVNAPVLIGATTFMPPATAANYTTWILVAFLSGYVVYKYRRNWWERHNYLLSGALDAGLAFMAVLLYLCLGLENKSLNWWGNDLDGCPLASCPTAKGITVDGCPVHN

SEQ ID NO: 40501 - protein, 234 aa, Methanosarcina mazei Go1
MTERNTSTDSPEKRAAGIAAAGLVSSGMVVGLGTGSTVAYTIKELGRRVKEEGLDILGVVTSYQSEMLAIDAGIRLTTLSQDPELDIAIDGADQIDSNLYTIKGGGAAHTREKIVSVSAKRFVVVADDSKTSTQLDKPVPVEVLPFAKEPAVNRIRKLGGEPRLRSAVKKDGPVITDNGNFVLDVEFGVIKDPEALALQLSAVPGVVEHGIFSNVDELYIGKKDGSVKIISRQK

SEQ ID NO: 40502 - protein, 223 aa, Azoarcus sp. BH72
MQTTPNTPDIQLLFDNNKAWSERMHGEDPEYFTRLANQQTPEYLWIGCSDSRVPANQIIGLAPGEVFVHRNVANVVVHTDLNALSVIQYAVDVLRVKHILVVGHYGCGGVKAALNNNRLGLIDNWLRHVQDVRDLHEATLAQIEDPNLRVDRLCEFNAMQQVVNICQTSVLREAWARGQKVNVHAWCYGLKDGLVHDLGIDAGSRDEALEQYRQAVSQVRDSV

SEQ ID NO: 40503 - protein, 293 aa, Staphylococcus aureus subsp. aureus COL
MAAQDPRTKFKTTDYEKQEQEVPGLQSEMTPAPDCGETSYQGHQRLQGYKILVTGGDSAIGRAAAIAYAKEGADVAINYLPSEEQDAQEVRQVIEESGQKAVLIPGDIRDEQFNYDLVEQAYQQLGGLDNVTLVAGHQQYHDDIHGFTTEAFTETFETNVYPLFWTVQKALEYLKPGASITTTSSVQGYNPSPILHDYAASKAAIISLTKSFSEELGPKGIRVNCVAPGPFWSPLQISGGQPQSKIPTFGQKTPLGRAGQPVELCGTYVLLASEESSYTTGQVFGVSGGVQID

SEQ ID NO: 40504 - protein, 1060 aa, Pseudomonas aeruginosa PAO1
MFKASHVLQGEDQTRSAAEFFPVISANYAVDEEAYLGELLQLADPGPDGIEAIRRNARALIETVRSRDNAVDTLDALLRQYSLDTQEGLMLMCLAEALLRVPDAATADALIRDKLSAADWQRHLGQSDNVLVNFAAWGLVMTGKVVNIDERTDGRAPSVISRLVQRSGEPVIRAAMNQAMKLMGKQFVLGRTISEALKNGRPCREQGYTYSFDMLGEAALTAADAEKYMADYRQAIDTVGAEPQVGPGPRPSISIKLSALHPRYEVAQRERVLSELFANVLELAVRARKLNVGITIDAEEADRLELSLELYEKLMRDPAIAGWGEFGLVIQAYSKRCLPVLVWLTLLGRELGARIPLRLVKGAYWDSEIKQCQVQGADGYPVYTRKEGTDTSYLACARYLLSEHTRGVIYPQFASHNAHTVTAILALADEARAAGGEERDFEFQRLHGMGDALYDTVIEKYRRNVRIYAPVGAHKDLLPYLVRRLLENGANSSFVHKLVDPRVPVETLIQHPVTQLRQFKTLANDRIPLPQAIFGAGRKNSQGINMNIQNQWNELELAYKPHLTRQWQAAPIVNGEKLSGPAHEVRCPYDLERLVGSVQYASAEQAGKALDVLQAAWPRWSATPVDERAGILERLADLLEAQRGELMALCTLEAGKSLQDGIDEIREAVDFCRYYAQQARQRLVREELRGPTGERNELFYEGRGIFACVSPWNFPLAIFLGQISAALVAGNTVLAKPAEQTSLIAARTVELMFEAGLPKDVIALLPGDGATLGGVFCRDARVAGVAFTGSTDTARIINRQLAEKPGAIATLIAETGGQNAMIVDSTALPEQVIKDAVQSAFTSAGQRCSALRVMYVQQDIAERVIELLKGAMAELKVGPTEVRVSDVGPVIDAEAKAGLEQHIAALKAAGKLIAETKVPGNLNGHFVAPVAFEISGIDELKKENFGPVLHVVRYAAQDLEKVVQAINATGFGLTMGVHSRNEETARRIEELARVGNLYINRNQIGAVVGVQPFGGHGLSGTGPKAGGPNYLLRFVSERTTSVNTTAVGGNASLLSLADAE

SEQ ID NO: 40505 - protein, 179 aa, Haemophilus somnus 2336
MNKLELIKSSIKSIPNHPKEGIIFRDITSLTEVPEAFQATIDLIIERYKSKGITKVIGTESRGFIFGAPVALALNVPFILVRKPGKLPRETIAQSYQLEYGQDTLEMHVSSIQAGDNVLVIDDLLATGGTIEATVKLVERLQGQVKHAAFVISLPDLGGEVRLRELGVEPFTLVEFSGH

SEQ ID NO: 40506 - protein, 142 aa, Triticum aestivum
  misc_feature (58)..(58): Xaa can be any naturally occurring amino acid
  misc_feature (69)..(69): Xaa can be any naturally occurring amino acid
  misc_feature (97)..(97): Xaa can be any naturally occurring amino acid
  misc_feature (109)..(109): Xaa can be any naturally occurring amino acid
  misc_feature (118)..(118): Xaa can be any naturally occurring amino acid
  misc_feature (129)..(129): Xaa can be any naturally occurring amino acid
  misc_feature (132)..(132): Xaa can be any naturally occurring amino acid
  unsure (1)..(142): unsure at all Xaa locations
MAPTVMASSATSVAPFQGLKSTAGLPVSRRSNGASLGSVSNGGRIRCMQVWPIEGIKXFETLSYLPPLXSTEALLKQVDYLIRSKWVPFLRVNKVGXLPVEHNASPGVXNNGRYWTMXELLCFGCTDAXQVXNEVEEVKKDT

SEQ ID NO: 40507 - protein, 314 aa, Oryza sativa (indica cultivar-group)
MAERVTKALMRPLLCYIIVVAVAPAGCAAFNPRMLFLVKPDPIVLKDHHGVVLSGNVTVNVLYYGRFTPAQRAVVAGFVRSASAAQHPRVPSVAAWWSTTSLYRGGGARLRLGMQVMDERMSLGRSLSLDNVTALARAAGHHRGAVTAVLTAPDVLVAPFCMSRCGVHGHGGGVGAHGRARYAYLWAGNPAQQCPGQCAWPFHQPVYGPQAPPLVPPNGDVGVDGMVISLAALLAGTVTNPFGDGYYQGDAGAGMEAATACAGVFGSGAFPGYPGKLLKDPVTGASYNAVGLAGRKYLLPALWDPTTSQCKTLV

SEQ ID NO: 40508 - protein, 228 aa, Staphylococcus aureus subsp. aureus COL
MKDVKALKLMTLNDVLSQINGDMTLGIGTGSTMELLLPQMAQLIKERGYNITGVCTSNKIAFLAKELGIKICEINDVDHIDLAIDGADEVDPSLNIIKGGGGALFREKVIDEMASRFVVVVDETKIVQYLGETFKLPVEVDKFNWYQILRKIESYADIKVERRVNEDVAFITDNGNYILDCKLPKGIDPYKFHEYLIHLTGVFETGYFLDMADQVIVGTQEGVKILEK

SEQ ID NO: 40509 - protein, 321 aa, Oryza sativa (indica cultivar-group)
MASCMMIPIIVLILVSMAANDLADDRRQLQLMQDPAAGDVLSYHGGAVLSGDIPASIVWYGKFAPSQKDIVVDFVQSLTSTSSSSSQRAATPSAAQWWSTLATVYLSNATTGGGGKPAAATRVVLSGQVSDEECSLGKTLTLVQVFQLAAGAAPKRGAVVLVLTDPDVVVEGFCSVRCGVHGSDAGAGYAYAWVGNAERQCPGQCAWPFAAPPYGPQGSPLGAPNGDVGTDGMVVTLASTLAGAVTNPFGDAYYQGDKDAALEACTACAGVYGSGSYPGYAGKVLVDEANGGSYNAIGGGGKRFLLPAIYNPATTGCSTTV

SEQ ID NO: 40510 - protein, 302 aa, Oryza sativa (indica cultivar-group)
MVAALVVMSLAGVSMAARRVPALLKSHVGDGISFHGGAVLGGDIPVTLVWYGKFKPAQKAIVVDFLLSLTATPPNATAPSAAQWWGAIAAGYLSSNATTAARVVLANQTSDEEYSLGKSLTLVEVFQLAAGVVPDRGDLVVVLTDRDVAVEGFCSARCGVHGSDSGAGYAYAWAGDAERQCPGQCAWPFAKPPYGPKGEAALVPPNGDVGADGVVATLAGVLAGAVTNPFGDGYYLGDKDAALEACSACAGAYGSDSYPGYAGKVLVDETTGGSYNAVGAHGRKYLLPAVYDPATSRCTTLV

SEQ ID NO: 40511 - protein, 405 aa, Arabidopsis thaliana
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELTGGIYFGEPRGIKTNENGEEVGFNTEVYAAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 40512 - protein, 455 aa, Prochlorococcus marinus subsp. marinus str. CCMP1375
MAILRPFEKDQDKSSPNRNIAPITAALDSQERLSIGGCLLSSLAEKYGTPLYILDELTLRTSCREYKDALSKYYPGDSIPLYASKANSSLIISNIVASEGMGVDVVSEGELITALKGGVESSNIVFHGNNKSKSELIMAYKNDVIIVLDNQYDIDQLREIVPFGKRKAKLMLRFTPGIECHTHEYIKTGHIDSKFGFDPDELESIFLQFKDIEWGELIGLHAHIGSQIFEVQPHKDLADVMASALQTGRKLGHSLNALNLGGGLGIRYIASDDPPSISDWVEVIAAAVVKACRERSLDLPLLMCEPGRSIVGSAGLTLYKIGSRKEIPGIKTYLSVDGGMSDNPRPITYQSEYSACLVDKPLIRADEVVTIAGKHCESGDVLLKDFRLPRSNSGDVLGVFSTGAYNFSMSSNYNRIPKPAAIIVGNGESELIQKRELPEDLLRNDILPDRFIAKG

SEQ ID NO: 40513 - protein, 272 aa, Salmonella enterica subsp. enterica serovar Typhi str. CT18
MEAYAVFGNPIAHSKSPFIHQQFAQQLDIVHPYGRVLAPINNFINTLDAFFAAGGKGANITVPFKEEAFARSDELTERASLAGAVNTLKRLEDGRLLGDNTDGIGLLSDLERLNFIRPGLRILLIGAGGASRGVLLPLLSLDCAVTITNRTASRAEALAKIFAHTGSVHAMDMDKLDGCEFDLIINATSSGIRGEIPAIPASLIHPSLCCYDMFYQKGNTPFLSWCVQQGAKRYADGLGMLVGQAAHAVLLWHGVLPQVEPVIKLLQQELLA

SEQ ID NO: 40514 - protein, 375 aa, Methanococcoides burtonii DSM 6242
MAQYKIPVLPGDGIGPEIITEGKKVIDAAGEKFGFDVDWIEYPQGADHYLETGELISEDTLKELSAYDAIYLGSIGDDRIAPGVLEKGILLAARFYFDQYINLRPIKLLEGVWCPLKDKTPADIDFTVVRENTEDFYIGIGGRAKTGASKDLLEVSRTLYSAKFGLDIETDSEEIAYQIGMISKEGTQRVIDYSFDLAEKSDKHVSSVDKANVLSDIYGFWREEFNTIAAKHPDVKTDLNYVDAITMWFVKNPEWFDIVVTPNMFGDIITDLGAMVQGGLGLAPGGNINPNGTSMFEPIHGSAPKYKGLNKVNPIATIWAGSMLIEQLGEKEAADAIVSAIEKNILEAKVQTYDMGGSSTTSDVGSDIARILLEM

SEQ ID NO: 40515 - protein, 288 aa, Arabidopsis thaliana
MASEKQKQHAQPGKEHVMESSPQFSSSDYQPSNKLRGKVALITGGDSGIGRAVGYCFASEGATVAFTYVKGQEEKDAQETLQMLKEVKTSDSKEPIAIPTDLGFDENCKRVVDEVVNAFGRIDVLINNAAEQYESSTIEEIDEPRLERVFRTNIFSYFFLTRHALKHMKEGSSIINTTSVNAYKGNASLLDYTATKGAIVAFTRGLALQLAEKGIRVNGVAPGPIWTPLIPASFNEEKIKNFGSEVPMKRAGQPIEVAPSYVFLACNHCSSYFTGQVLHPNGGAVVNA

SEQ ID NO: 40516 - protein, 494 aa, Mentha x gracilis
MELNLLLVIIILVATYTVSLLNKQWRKPKSQQKQPPKLPVIGHLHLLWGGLPPQHLLRSIAREYGPVAHVQLGEVYSVVLSSAEAAKQAMKVLDPNFADRFDSVGSRIMWYDNDDIIFSPYNDHWHQMRKICVSELLSPKNVRSFGFIRQEEIERLIRVMKQSEGAPVDVTEEVSKMSCFVVCRAAFGSVLKDQGSLAELVKESLAMASGFELKDLYPSSWLLNLLSFNNYRLKRMRRRLDHVLDGFLEEHRVKKNGEFGGEDIVDVLFRMQKDSNIKIPITSNGIKGFIFNTFSAGAEASSTTISWALSELMRNPAKMAKVQAEVREALKGKTSVDLSEMQELKYMRSVVKETLRLHPPFPLIPRQSREECEINGFYIPARTRILINAWSIGRDPLYWEDPDTFRPERFDEVSRDFMGNDFEFIPFGAGQRICPGLHFGLANVEIPLAQLLYHFDWKLPQGMTDADLYVAGTPGLSGPRKKNVFLVPTIHKSR

SEQ ID NO: 40517 - protein, 136 aa, Glycine max
SLLTPLFFFFFCVCVCALFDFSASDDTQKSHKSRHRMHRTLGSSHKTMSRSFSGDSQSKGSVSMPNGSAKVDLSKLEMAALWRYWRHFNLVDAVPNPSKEQLVDVVQRHFMSQQMDGSRVIVGFVQAAKRLKTVCK

SEQ ID NO: 40518 - protein, 348 aa, Vibrio sp. Ex25
MPWYAYHFGLGWEHLVWGVMAFSFTNLSITAGYHRLWSHKTYEAHPILRAIFAIGGAFSLQNSALHWSSDHRVHHKHVDNNDKDPYSAKRGFWYSHIGWMLRDYNKSQENEYTNCRDLKRDKIVMWQHKYYVPLALLTNIGFPVALGIIYGDIWGMLLVVGAARLFMSHHTTFFINSLAHVWGKQTFTDKNTARDNGVLAFFTFGEGYHNFHHIFENDYRNGVYWWHYDPTKWLIKSCSWLGLTSKLRTTPTFRIEKARATQLLKKAKEKLGAKPNTQTILDQLQHEFDSLVHHMQEYYEMRKEVLGAKTASVVKKYECSVTKIKYQQIKAEFERQQRSWNLMVRRYA

SEQ ID NO: 40519 - protein, 433 aa, Daucus carota
MASKAVITQRHKEAEGKQKNVQAERRNRRVLGDIGNVVKAVDAGKPKNPIKTNRPMTRSLCAQLVAKGLPVVGGKDPKDIQLIDDGVVGRKDASVLEAAAVKKKDTDQKTTVTLSCEEEIKPKSSGRKSRPDYSEKTEKAFTSILSARSKAACGLINKPQNEIIANIDASDVDDELAAVEYVDDIYKYYKLTEGDGQVHDYMPSQTDINSKMRSILIDWLVEVHRKFELMPESLYLTINIVDRYLSMKIVPRRELQLVGVGSMLIACKYEEIWAPEVNDFIAISDNAYNREQVLLMEKSILAKLEWYLTVPTPYVFLVRYIKSSVPSDPEMENMTFFLAELGLTHYTTVMTYCPSVIAASAVYAARCTLKKSPFWTETLKHYTGYSEDQLRDCAKLLVSYHAALSESKLKAVYKKFARPEKGVVALVPPLKLI

SEQ ID NO: 40520 - protein, 456 aa, Daucus carota
MASTRPVVQQNHREEAAPVAGGGGKQKKMAAEGRNRRALGDIGNLVTARGGIDAVKPLPQVSRPITRSFCAQLLANAQAAAAENNKKQMAIPGDGVLAGKGGKQAALPLPPKAAQKKKVVVESKPEDVIEISSSETEQVKKERPNRKKAIEASSSKNGQTLTSTLTARSKAACGINKKPKEQIVDIDAADATNELAAVEYVEDMYKFYKEAETESQVSDYMDSQPEINQKMRAILVDWLIEVQNKFELSPETLYLTVNIVDRYLATKMVARRELQLLGISAMLLASKYEEIWAPEVNDFVCISDRAYTNQQVLTMEKKVLGRLEWSLTVPTPYVFLVRFIKASLPNEPDVNNMTYFLAELGMMNYATVMYLPSMVAASAVYAARCTLNKTPVWNDTLKLHTGFSEAQLMDCAKLLVGLHSAAAENKLRVIYRKYSNPERGAVAFLPPAKSPGAANN

SEQ ID NO: 40521 - protein, 444 aa, Daucus carota
MASRPVLQQNIEADGGEEAVKQKNMAAGEGRNRRALGDIGNLVTVHGIEGKQQQIPRVIRPVTSFCAQLLANAQAAAENKKQRAVIGDGVVAHKAVHQKKVTVMPKAEDIIVISPDTEEVKKVDRHLNKKKAIEGSSKKKSQTFTSTLTARSKAAAFGITRTPKEQIVDIDAADANNELAAVEYVEDMYKCYKLVEHESRVFDYIDFQPEINEKMRAILVDWLIEVHNKFELMPETLYLTINIVDRYLATKSVARKELQLVGISSMLLASKYDEIWAPEVNDFTKISDNAYTNQQVLVMEKKILSRLEWNLTVPTPYVFLVRFIKASIPSEPAVENMAYFLAELGLMNYATVMYCPSMLAASAVYGARCTLDTAPFWNETLKLHTGFSEQQLMDCARALVRFHSCAAENKLRVIYRKYSLAERGAVALLPPAKALLNVAASPHS

SEQ ID NO: 40522 - protein, 471 aa, Pseudomonas aeruginosa PAO1
MSSVGEQKVQDGSLKRELGERHIRLMALGACIGVGLFLGSAKAIQMAGPAIMISYILGGLAILVIMRALGEMAVHNPVAGSFSQYAKDYLGPLAGFITGWNYWFLWLVTCVAEITAVAVYMGIWFPDVPRWIWALAALASMGTINLIAVRAFGEFEFWFALIKIVTILAMVVVGIGMIAFGFGNDGIATGISNLWAHGGFMPNGIQGVLMSLQMVMFAYLGVEMIGLTAGEARNPTKTIPSAINSVFWRILLFYVGSLFVIMSLYPWNEIGTQGSPFVMTFERMGIKTAAGIINFVVITAALSSCNGGIFSTGRMLYSLAQHRQAPAFFGKASRSGVPRRALILSILALLLGVLLNYLVPEKVFVWVTSIATFGAIWTWAMILLAQLRFRKTLSPAECDKLQYRMWLYPVSSYLALAFLVMVVVLMAFFEDTRIALYIGPPFILLLTVLYYAFNLAPKEPAGTGSVSRAAS

SEQ ID NO: 40523 - protein, 496 aa, Pseudomonas fluorescens Pf-5
MVAALLDRLGVNPALYQSGTQPVHSPIDGSRIAAVNWQGAAEVEQQVSRAEHAFALWRKVPAPRRGELVRQFGEVLREYKADLGELVSWEAGKITQEGLGEVQEMIDICDFAVGLSRQLYGLTIASERPGHHMRETWHPLGVVGVISAFNFPVAVWAWNTTLALVCGNPVIWKPSEKTPLTALACQALLERVLKNFQDAPEYLSQVIIGGRDAGAALVDDPRVALISATGSTRMGREVAPKVAARFARSILELGGNNAMILGPSADLDMAVRAILFSAVGTAGQRCTTLRRLIAHESVKEEIISRLKTAYSKVRIGHPLEGNLIGPLIDKHSFEAMQDALEQALSEGGRVFGGQRQLQDQFPNAYYVSPAIVEMPEQSEVVCSETFAPILYVIGYNDFEEALRLNNAVPQGLSSCIFTTDVREAEQFMSAVGSDCGIANVNIGPSGAEIGGAFGGEKETGGGRESGSDAWRGYMRRQTNTVNYSRELPLAQGITFD

SEQ ID NO: 40524 - protein, 455 aa, Daucus carota
MASRPAVLQQNREAAGGAVKPKNMAGGEVRNRRALGDIGNLVTVRGIDGKKQPIPQASRPVTRSFCAQLLANAQAVEKNKKQRAIVGDGALEVKHVTKAAVPKAVVHQKKVNVKPKTEDVTVISPDTEVEDKKVDKNLDKKKATEGSSKEKKGQAFTSTLTARSKAACGLTKKPKVQIVDIDAADANNELAAVEYVEDMYKFYKLVENETMVFDYTHSQPEFNEKMRAILVDWLIEVHNKFDLMPETLYLTINIIDRYLARKTVPRKELQLLGISSMLTASKYEEIWAPEVNDFTKISDNAYTSQQVLVMEKKILGGLEWNLTVPTPYVFLVRFIKASLPNEPAVENMTYFLAELGILNYATILYCPSMIAASAVYGARCTLNKTPFWNDTLTLHTGFSEPQLMECAKALVRFHSCAAENKLKAIHKKYSNAERGAVALLPPAKALLTVAAAAPH

SEQ ID NO: 40525 - protein, 360 aa, Campylobacter coli RM2228
MPADLNDYFNKKNGNSNNNNNRQNFNFKAPEFNFKGFGKFSPFVYGVIIIVLFLIIAKPFMVINSGEMGIKSTTGRYDPNPLEPGLHFFIPFIQKITTIDTRVRQINYASIEGSNENLTSGSGVINKNSISVLDSRGLPVSIDVTVQYRLNPLQVPQTIATWSLNWENKIIDPVVRDVVRSVVGKYTAEELPTNRNAIATQIEEGIRKTIEAQPNEPVELRAVQLREIILPLKVKEQIERVQIAKQEAERTKYEVERANQEALKKAALAEGEANATIISAKGKAMAVKIEADAQAYSNKEIANSLNTPLLNLKQIETQKEFNEALKVNQDAKIFLTPGGAVPNIWVDTKDAKKQSSTNMN

SEQ ID NO: 40526 - protein, 180 aa, Arabidopsis thaliana
MASSNTTTGVDNTFRKKFDVEEFKERAREREKKGVVFAAKGPPVQRAPLKHRDYHVDLESRLGKTQVVTPVAPLSQQAGYFCRVCDCVVKDSANYLDHINGKKHQRALGMSMRVERSSLEQVQERFEVLKKRKAPGTFTEQDLDERIRKQQEEEEELKRQRREKKKEKKASLHIYIHLSS

SEQ ID NO: 40527 - protein, 681 aa, Magnetococcus sp. MC-1
MGDFNAVALVLSIIAGGAAIVWAYQKRAWILTLPAGNEKMQAISGAIEEGAHAYLKRQYETITYVGMVLFVLVAFTLDWLTAVGFAIGAILSGMAGYFGMSISVKANVRTAEQARKGLDQALQVAFNGGAITGMLVVGLGLLGVTLFVAYLLLSADATHTMSQALKPLMGLAFGGSLISIFARLGGGIFTKGADVGADLVGKVEAGIPEDDPRNPAVIADNVGDNVGDCAGMAADLFETYAVTVVATILLGVLLMPTFGNVVIYPLTLGAASIVGSIVGVRFVHSTPGMSNVMPALYKGLGVAAAVSALLFLPVTVWLMAGNPLGISSGSLYLSALIGIVLTGAMVGITEYYTGTEFSPVQRIAKASETGHATNIISGLGISMKATAAPVIAVCVAIYASHALAGLYGIAIAATAMLSMTGIIVALDAYGPITDNAGGIAEMAQMPEEVRAITDPLDAVGNTTKAVTKGYAIGSAGLAALVLFADYTHELSHFTKDVTFDLSNHMVIIGLFLGGLLPYLFAAMGMEAVGRAAGSVVVEVRRQFHEIPGIMEGSHKPDYSRAVDLLTQAAIKEMVIPSLLPVLAPILVGVLLGPQALGGLLMGTIITGIFVAISMTTGGGAWDNAKKYIEDGHCGGKNSEAHKASVTGDTVGDPYKDTAGPAVNPMIKIANIVALMIVGMIV

SEQ ID NO: 40528 - protein, 421 aa, Magnetococcus sp. MC-1
MTETAPFMGVGWLCRLSSCMNGPSMEEFHRIKRLPPYVFAVVNELKYKARNRGEDIIDFGMGNPDQPTPKHITDKLIEAVQDGRNHRYSLSRGIGGLRRAVCAYYKRRFGVDLDPESEAIVTIGSKEGLSSLAMAITEPGMNVIVPSPTYPIHEYSFLIAGAHIQRVKISRDNDFIEDMKVAVRNHWPRAQVLVVNFPSNPTAQVVELDFYQKVIDFAKEHNIWVISDVAYAEICFDGYKAPSILQIPGAKDIAVEFYSLSKTYNMPGWRVGFCVGNPHLIKALSRIKSYLDYGMFQPIQIAATVALNGPQDCVAEINEIYRQRRNVLIDGLARAGWAIERPKASMFVWAEIPDEFKAMGSLEFSKLLLKEAKVAVSPGVGFGVYGDDHVRIALIENEHRTRQALRSMRRFLSAGSDVAGD

SEQ ID NO: 40529 - protein, 216 aa, Triticum aestivum
  misc_feature (130)..(130): Xaa can be any naturally occurring amino acid
  unsure (1)..(216): unsure at all Xaa locations
MEAVAAAGGAGLTGWQAAALSGAAGWVWAASYYDLTRRARALAQPWVTRRVHAETPSILTFQRLQHRLLDNFFSVLSCVVSVPFYTGFLPLLFWSGHGKLARQMTLLLAFCDYLGNAVKDLVSAPRPCSXPPVRKVTATEDEKENACGYGLPSSDTLQTVCLMGYIPCFCMKGWAAVNLSGFALANTDLEKWRNLLPFCPHIGTGGGFLDCHGAFP

SEQ ID NO: 40530 - protein, 552 aa, Pseudomonas aeruginosa
MYVYDEYDQRIVEDRVKQFRDQTRRYLAGELTGEEFRPLRLQNGLYIQRYAPMLRIAVPYGLLSSRQLRKLAQIARDYDKGYAHISTRQNVQFNWPELEDVPEILAELATVQMHAIQTSGNCIRNTTTDQFAGVARDELVDPRPWCEIIRQWSTFHPEFAHLPRKFKIAVNGAVSDRAAIEVHDIGLEAVKNEAGELGFRVSVGGGLGRTPIVGSFINEFLPWQHLLGYLDAILRVYNRYGRRDNKYKARIKILVKALTPEVFAERRRGRMGQPQGRTEHLTEAEVQRVAAHFVDPAYKALDDLDESLARLDAEHPGFARWRARNTFAHKKPGYVAVTLSLKPTGTAPGDVTDKQLEAIADLADRYSFGEVRNSHNQNIILADVEQGELFALWGELRELGFATPNVGLLTDIICCPGGDFCSLANAKSIPIAEAIQPGFDNLDYLFDIGDIDLNISGCMNACGHHHVGHIGILGVDKKGAEFYQVSLGGSSARDASLGQILGPSFAQEQMADVIDKIIQVYVERRTEEEPFIDTFRRIGIDPFKERVYAANH

SEQ ID NO: 40531 - protein, 156 aa, Haemophilus influenzae
NRTNTPVLVDGKDVMPEVNTVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 40532 - protein, 212 aa, Prochlorococcus marinus str. AS9601
MKITSKTEALNIVETSYLASLSSLLWVALYYLPIGGALLRLILPLPMILLHLRRGSKIALEGLLIQFLLLFIIMGPVRGTLFLFPYGILAFWLGWCWFKEKSWKLSLTGGVVIGTLGFLLRVIALSTLVGDNLWVLITRASYGLIEKFIGLFNLPLYPSILSIQFGAILLIIFQEIVYVLTVHVVAYCLFPRFKLTIPDPPRLLNSLVDFNN

SEQ ID NO: 40533 - protein, 368 aa, Oryza sativa (indica cultivar-group)
MGYLPSLGGKAAHLVSDLATVILNPVSERESQRHPSHLPEATEVQENIYEDDDDDDSVKNSEIPNGPDTSSFRAFLMSFMSSSNSSSDSIEIIPEHNMNMEYPTLTPVGKGSNGRKGLFSRGKHSIGKIINKAGRIGGFRQKPSYSIDGETVQTEYDAPGLELKGSKESASHDKLPAMSEPSMLLSETMRTVLYTSLPVLVQGRNWMLVYSTWRHGISLSTLYRRSMLCAGYSLLIVGDRKGAVFGGLVEAPLQPLIKKKYQGTNNCFVFTNIAGRPVIYRPTGANNYFTFCSTDYLAMGGGGHFALYLDGDLLNGSSSTSETFNNPCLSRSREFEVKDVELWGFVNASKYDEMLTICRTEKQGIWNL

SEQ ID NO: 40534 - protein, 497 aa, Mentha x gracilis
MELQISSAIIILVATFVASLLIKQWRKSESQQNLPPGPPKLPLVGHLHLLWGKLPQHAMADMAKKYGPVTHVQLGEVFSVVLSSREATKEAMKLLDPACADRFESIGTRIMWYDNDDIIFSPYSDHWRQMRKICVSELLSARNVRSFGFIRQDEMSRLLRHLQSSAGETVDMTERIATLTCSIICRAAFGAIINDHEELVELVKDSLSMASGFELADLFPSSKLLNLLCWNKSKLWRMRRRVDTILEAIVEEHKLKKSGEFGGEDIIDVLFRMQKDSQIKVPITTNAIKAFIFDTFSAGTETSSTTTLWVMAELMRNPAVMAKAQAEVRAALKGKTSVDVDDVQELKYMKSVVKETMRMHPPIPLIPRSCREECEVNGYKIPNKARIMINVWSMGRNPLYWEKPETFWPERFDQVSRDFMGSDFEFIPFGAGRRICPGLNFGLANVEVPLAQLLYHFDWKLAEGMKPSDMDMSEAEGLTGIRKNNLLLVPTPYNPSS

SEQ ID NO: 40535 - protein, 398 aa, Triticum aestivum
SVWMSHGDEVVRLPEGFEVVARSVQGAIAAIEHREKRFYGLQYHPEVTHSPQGMETLRHFLFDVCGIKADWKMQDVLDEEIKTIKSMVGPDEHVICALSGGVDSTVAATLVHNAIGDRLHCVFVDNGLLRYKEKERVMSTFNSDLHLPVTCIDASEKFLTELKGVKDPEMKRKIIGREFIVVFDEFAHMLEQKIGKRPEYLVQGTLYPDVIESCPPPGSGRTHSHTIKSHHNVGGLPKDMKLKLIEPLKLLFKDEVRKLGSILNVPESFLKRHPFPGPGLAVRVIGDVTAGNALEVLRQVDEIFIQAIKDAGLYDEIWQAFAVFLPVQTVGVQGDQRTHSHVVALRAITSEDGMTANWYDFERPFLVDVVKKICNNVRGVNRVVLDVTSKPPATVEWE

SEQ ID NO: 40536 - protein, 332 aa, Actinidia eriantha
MASGDTKEVATDLLPLLRHYKDGTVERFIASPYIPPSPLDPATGVSSKDVTISPLVSARLYLPASATQKLPVLVYFHGGGFCIESAFSLFNHRYVNALASESNAVAVSVEYRLAPENPLPAAYDDSWAALQWVAYHSVDRGTDDKSQQRDSWLAEHADFDRLFIGGDSAGANIVHHLAIRAGSEPLPGDLKILGAFLAQPYFWGSDPVGSESPDLHTEENLIQRIWTCVYPSAPGGIDNPAINPFSPDAPSVAALGCARLLVCVSGEDELRERGIRYLEEVKRSGWRGEKIELFEVEGEGHAFHFFGFGSENAKRMITRLASFVSQTRLASL

SEQ ID NO: 40537 - protein, 506 aa, Wolbachia endosymbiont of Drosophila melanogaster
MNIKSVVLCILDGWGNGIENNKYNAISNANPPCWQYISSNYPKCSLSACGADVGLPGGQIGNSEVGHMNIGSGRVVIQSLQRINQEIGTIENNVNLQSFINDLKSKNGVCHIMGLVSDGGVHSHQKHISTLANKISQHGIKVVIHAFLDGRDTLPNSGKKCIQEFTKSIKGNDTRIATVSGRYYAMDRDNRWKRTIEAYEAIAFAKAPCHDNAVSLIENNYQNNITDEFIRPAVIGDYQGIKPEDGVLLANFRADRMIQLASILLGKTDYAKVAKFSSILSMMKYKEDLKIPYIFPPTSFADTLGQTIEDNKLRQLRIAETEKYAHVTFFFNCGKEEPFSGEERILIPSPKVQTYDLQPEMSAFELTEKLVEKIHSQEFALIVVNYANPDMVGHTGNIKAAEKAVLAVDDCLAKVLNAVKKSSNTALIVTADHGNVECMFDEENNTPHTAHTLNKVPFIVSCDNLKLRDGRLSDIAPTILQLLGIKKPNEMTGSSLISCITLCHSS

SEQ ID NO: 40538 - protein, 343 aa, Actinidia chinensis
MVCEKNIVEEVSGWLRVFDDGSVDRTWTGPPEVKFMAEPVPPHSEFINGVATRDVVIDPKSGLRVRIYLPDTADYEKLPILLHFHGGGFCISQADWYMYYSIYTRLALSAKAICVSVYLRLAPEHRLPAACHDGFSALLWLRSLAQSGSSSSHEPWLNAYADFNRVFLIGDSSGGNLVHQVAAWAGKLDLGPLRLAGAIPIHLGFVRSQRSKSELEEPESPFLTLDMVDKFLKLALPVGSTKDHPITCPMGAGISGLRLPPMLFCVAEKDLIRDTEMEYYEAVKNACNTNNNNYEEVDHVELLISSGMGHSFYLNKIAVDMDDKTAQETQKLIQGIADFINKH

SEQ ID NO: 40539 - protein, 493 aa, Ustilago maydis 521
MVFNLATSQALRAVARTSVASRAQIMPSVIATPLSVRFLATPSSSSKPPPPSPSGSPASSKPAKAESTDDAQSQPQPQPPAEPELARKGSSLFDIDTSATPLASQLIEAEEAASRSDAGKGSTRAKAKTGARSMSSIERRRQNTVRILTGFVLIGAGLSAYKLGRPWESSAEAERFADSADAQTFVGRIKLRLNAMYDDYNKPLFEQLLPDPLPFPYSRPFTMVIDIDDLLVHSEWSREHGWRTAKRPGLDHFLGYLSQFYEIVLFTTQPFFTAGPIIEKLDPDRRFITYTLFRESCRTVDGKLVKDLNHLNRDLSKVVVVDTNPDSFHLHPENGILVKPWKGEREDRELIGLIPFFEAIGIYNIDDVRNTIKAYTGTHIPTEHARRTAAIRERELADNKARLERMGKFGSVFGRVSRSASAGLPADKTLYDLERERYLQAYLEEQKYWNENGDAIRKQAKDEQDRQIREMKINTWGFFTGGLKPQQPETPAQ

SEQ ID NO: 40540 - protein, 159 aa, Ustilago maydis 521
MSVLPIRSRTRGPAPPLIDPARPDIIDEAIDLFRANSLFRNFEIKGPADRVLIYLILFISDCLTKIASSKVAWSTNEAQKQLATYSVDSFALPGDANFPLNSLYAPPASRADADALRSYLTQVRQETAARLVDKVFHDGTPSKWWLAFTKRRFMGKSLT

SEQ ID NO: 40541 - protein, 212 aa, Cytophaga hutchinsonii ATCC 33406
MKESYQKLLNNNKIWALGKIQDDADYFKRMKLAQTPEYLWIGCSDSRVPETEVTGTLQGQLFVHRNIANMVVHTDLNLLSVVEYAVEVLKVKHIIVCGHYGCGGVAAATKNNSFGYVDNWLRNIKEIYNKNTVELLAIENEEERINRLVELNVVEQVRNLAKTKPVQRAWKNRALEIHGWVYGLDTGIIKDLHSLYDEAEDLEPIFRYTFED

SEQ ID NO: 40542 - protein, 355 aa, Streptococcus thermophilus LMG 18311
MCYNENVKYIKGVSGIMKRIAVLTSGGDAPGMNAAVRAVVLKAISEGIEVFGINRGYAGMVEGDIFKLDAKRVENILSRGGTFLQSARYPEFAQLEGQLKGIEQLKKYGIEGVVVIGGDGSYHGAMRLTEHGFPAVGLPGTIDNDIVGTDYTIGFDTAVATATEALDKIQDTAFSHGRTFVVEVMGRNAGDIALWAGIASGADQIIVPEEEYDINEVVRKVKEGYESGEKSHHIIVLAEGVMGAEEFAAKMKEAGDTSDLRATNLGHVIRGGSPTARDRVLASWMGAHAVDLLKEGIGGVAVGIHNEQLVESPILGTAEEGALFSLTEDGKIIVNNPHKARLDFAELNRSLANLK

SEQ ID NO: 40543 - protein, 394 aa, Zea mays
  misc_feature (31)..(31): Xaa can be any naturally occurring amino acid
  misc_feature (57)..(57): Xaa can be any naturally occurring amino acid
  misc_feature (104)..(104): Xaa can be any naturally occurring amino acid
  misc_feature (131)..(131): Xaa can be any naturally occurring amino acid
  unsure (1)..(394): unsure at all Xaa locations
MLACIACSAKDGGDQDGSRAATPHGRDAGKXLQGRCSSLELISSSEAGSSKQIPLLXALSSWRLQRNSRRAADTGVIDDLGFTSHGATEGYGYMRTTTHATGCXAGTKVGRGFPQHVRSPSASWIPSIGEXEDDEEDEEVVVLEEDRVPREWTAQVEPGVQITFVSTAGGAGNDIKRIRFSRDMFNKWEAQRWWGENYDRVVELYNVQTFSRQQGVSTPTSSIDDATQRDSSFYSRAGSTRDSPVILPPTAVGREQPIARATSCRATAAAASTARAACNPSSSAVPDPSDHVWAHHFNLLNSAPAPAPAAPHLDPSRATTSSLDEASVSVSNASDLEATEWVEQDEPGVSITIREFGDGTRELRRVRFSRERFGEERAKVWWDQNRNRIHAQYL

SEQ ID NO: 40544 - protein, 148 aa, Clostridium thermocellum ATCC 27405
MKIVYSILSNKTVTVPMIAWFVAQFLKVVNVIVVERKLDFTRFIGSGGMPSSHSSFIVSLATVVGKMRGLDSVEFGISAAVAAIVMYDAAGVRRAAGKQAKVLNKLIFSQKDEDRKNFDENLKELIGHSPFEVFVGAMLGMLIGLCFA

SEQ ID NO: 40545 - protein, 230 aa, Oryza sativa (japonica cultivar-group)
MKAGRKNLRRACSEGAVTLGEGESIMQVLALRGSNVIEVMDAKGVKSLALFPAKFQKSFWIKNGNFVVVDASGRDQALESGSKIACVVSQVLFHDQVRAMEKSEEWPAIFKSTSKEGSEAGTQEGTRPQIEEEPDSDEDDDLPPLEANTNRQRPFELFPYLLHSGFPDFATKPSRYFWITRIIFSQSFGEICFGNLVSAVVHDSIIYAKISVTKFVGEGNFVDRSYVHTL

SEQ ID NO: 40546 - protein, 397 aa, Chlorobium tepidum TLS
MQKKTLSDISLQGKRVLMRVDFNVPLDQDRNITDEKRIVEALPSIRKVIDNGGRLILMSHLGRPKGKVNPAFSLSPVAKRLSELLDCPVTMAGDCIGTEVMQQVLALQDGDVLMLENLRFHPEEEANDPDFARELASLGEIYVNDAFGTAHRAHASTEGITHFMQTAVAGYLIEKELRYLGTALNDAQRPFVAILGGAKISGKIDVLESLFEKVDTVLVGGAMVFTFFKAQGLDVGNSLVEENKLELAVSLLEKAKAKNVRLLLPEDVVVAGEISADAPSRVEPVSAISAGMIGLDIGPATIETYRKEILDAKTVLWNGPMGVFEIDQFARGTFAVAQALADATAEGAITIIGGGDSAAAIAKAGLSDKVTHVSTGGGASLEFLEGKELPGIAALND

SEQ ID NO: 40547 - protein, 469 aa, Triticum aestivum
  misc_feature (152)..(152): Xaa can be any naturally occurring amino acid
  unsure (1)..(469): unsure at all Xaa locations
MAGAAAAAAAVASGISVRPVAAPKISRAPRSRSVVRAAVSIGEKAYTVQKSEEIFNAAKELMPGGVNSPVRAFKSVGGQPIVFDSVKGSHMWDVDGNEYIDYVGSWGPAIIGHADDEVNAALIETLKKGTSFGAPCALENVLAQMVISAVPXSIEMVRFVNSGTEACMGALRLVRAFTGREKILKFEGCYHGHADSFLVKAGSGVATLGLPDSPGVPKGATVGTLTAPYNDVEAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKEIMEMVAPAGPMYQAGTLSGNPLAMTAGIHTLKRLMEPGTYEYLDKVTGELVQGILDAGAKTGHEMCGGHIRGMFGFFFAGGPVHNFDDAQKSRLVPVRNSRDIVDPRVRQLKAIQARYAGNQERNSLRLLVCTSKLESIL

SEQ ID NO: 40548 - protein, 156 aa, Haemophilus influenzae
NRTNTPVLVDGKDVMPEINAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 40549 - protein, 361 aa, Oryza sativa (indica cultivar-group)
MPGSSGRAPLFACRGAAAVSASSMLGGGGAAYQAAVVAHVAPVPAIRPCASWVVEAMRASSPTRPAAAAAVDAEYDAWTQRKHPSALGSFEQVAAAASGKRVVVFLDYDGTLSPIVADPDMAFMSDEMRAAVRDVAEHFPAAIVTGRCVDKVQSFVGLPELYYAGSHGMDIKGPSSNEEEDTKILLQPAREFLTVINKAYKALMEKTKSTPGARVENNKFCLSVHFRCVDEKRWNPLAEQVKAVLRDYPELKLTQGRKVLEIRPSIMWDKGKAVEFLLKSLGFDDDRRDVLPVYIGDDRTDEDAFKVLRKRGQGLGILVSKCAKETDASYSLQDPTEVMEFLVRLVQWKLRRSSSAMRPRV

SEQ ID NO: 40550 - protein, 432 aa, Colwellia psychrerythraea 34H
MSKISKILAREIMDSRGNPTVEADVYLESGAFGRAAAPSGASTGSREALELRDGDKARYLGKGVLKAVAAINVNIQAALIGQSALDQANIDQIMIDLDGTENKEQFGANAILAVSLANAKAAANEKKVQLFEHIADLNGTPGVYSLPLPMMNIINGGEHADNNVDIQEFMVQPVGAKSFREALRMGAEIFHALKKVLSSKGMSTSVGDEGGFAPNLESNADALAVIKVAVEAAGYELGKDVTLAMDCAASEFYDADKGIYDLTGEGKQFTANEFSDFLGELCKEYPIVSIEDGLDESDWDGFKYQTDLLGDKVQIVGDDLFVTNTKILARGIENGIGNSILIKFNQIGTLTETLAAIKMAKDAGFTAVISHRSGETEDATIADLAVGTAAGQIKTGSLCRSDRVSKYNQLLRIEEFLGDKAIFNGLSEVKGQ

SEQ ID NO: 40551 - protein, 132 aa, Brassica napus
MAKGEDASKVIHVKFVTKLDPPFKAPVTSVVIPSSVTRLGLSSIVNSLLTLEKPEAFDFLIDGELIRMSLEQFLLAKGISAERTLEIEYIRAVAPRKEEKPSLHDDWVSAVDGSSPRFILTGCYDGLGRIWS

SEQ ID NO: 40552 - protein, 511 aa, Mycobacterium smegmatis str. MC2 155
MTVTTFRPSDVATLTNPDAASDVADLSMFIAGEAVSAADGATFDSYEPRSGRVWARLPRANSTDIDRAVRAARAAFEGPWGAVSPADRGRFLMKIAAVVDRHRDQLTVIESRDNGKPVREVRAEIDAVVRYFEYFAGVCQTTVGETHPQAATAFSYTRREPVGVVGAIVPWNSPLLMLAWKLSPALAGGNTIILKPAEETSVSAVVFAQLIAEVGLPDGVFNVVTGIGEEAGAALVAHPDVDKIAFTGSTEVGKQIAATAASDLKLVTFELGGKSPTVIFDDADLDAAVHRTAYGIFSAAGQTCQAASRIFVQDTIHDEFLDRFAALARRIRVGDPLSERTQMGAQISAQHRERIAGYVASGIQEGANLVCGGTQPTEAPLAQGYYYSPTILDGVNRDMRMIREEIFGPVTGVMSFTDEADAVAKANDTEYGLAGSVWTRDVSRAHRVAASIAAGLIWVNTTRTINHLVPFGGYKQSGYGREGGQAVMEHYTRIKSVWVDMQDDLPNWYAD

SEQ ID NO: 40553 - protein, 142 aa, Oryza sativa (indica cultivar-group)
MTTLGKRHRNNSSMRRTTSMSGFAVAEEEEQQGRQPPARAARGGGGGGSAAPSPGWGAMQRRHSGDFAVAETAAFLKACGICNRRLGPGRDTFIYMGEVAFCSHECRQQQMNLDELNEKKCFQRESGGGSDKSGNSGAVAAA

SEQ ID NO: 40554 - protein, 249 aa, Prochlorococcus marinus str. AS9601
MSNTDSLSGKVALITGASRGIGKEIALELSRLGAEVFINYSSSDEKAEEVVNSIKNSGGKAHKLKFDVSREDSVSSAFEEIIKINGSIDILINNAGITRDGLLMRMKSEQWDDVLNTNLKGVFLCTKYASKFMMKKRSGSIVNISSVVGIIGNPGQANYSAAKAGVIGFTKTCAKEFASRGINVNAIAPGFIETEMTEKLNTEEILKVIPLGKLGSCTQIANLVSFLVSSNAGSYITGQTISIDGGMSI

SEQ ID NO: 40555 - protein, 194 aa, Colletotrichum trifolii
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQVDLREDPSVREKLSKQKMSPVRKEDGERMAKDLGAVKYVECSALTQYKLKDVFDEAIVAALEPPAPKKKSHKCLVL

SEQ ID NO: 40556 - protein, 383 aa, Cryptococcus neoformans var. neoformans JEC21
MSTEGQVITCKAAIAWEAGKPLSIETVEVAPPKDGEVRIKILYTGLCHTDAYTLSGNDPEGAFPVILGHEGGGIVESVGEGVDNVKVGDHVVPLYTAECRECKFCKSGKTNLCGRVRTTQGKGVMPDGTTRFKCKGQDILHFMGCSTFAQYTVVSKFSVVAINPKAPLKTSCLLGCGITTGYGAATKSPGIEGSNVAIFGVGCVGLSVLQGAKAKGCKRIFAIDTNPKKKEWAVKFGATDFINPKDLPEGKTIVDYLIEETDGGLDFTFDATGNVGVMRNALEACHKGWGVCTIIGVAPAGAEISTRPFQLVTGRVWKGSAFGGVKGRTELPGIVEDYLAGKLWVNEFVTHNETLEGINKGFDDMHAGDCIRCVVDMGFNEAP

SEQ ID NO: 40557 - protein, 856 aa, Ustilago maydis 521
MSQTADSSPRGSNSPSPYPYQRPTGASTIDGIAASARAGPSSCTHLVDTDMHDRSESPADFAARHGAPLARPPPSPSSTSVSDDGVAQPDFADLASIDDADTQTRSVERSFDPSAVRLSRRGTLVPASPTSSNGTWSFQDAPQSTASNLPHEILLHIFQYLVLYPPDLLSCLLVCKSWCLNGVELLWYRPALFKISSLFKLVGVIRKPEQLFPYAQFVRRLNFTLLANQLEDQLFLMMSACTRLERLTLAGCSNITDATLVKVFQNTPQLVAIDLTDVANITDNTLLTLAANCPKAQGINLTGCKNISSHGVAELARNCKRLKRVKLCACENIGDEALLALTEHCPSLLEIDLIHCPKVSDKSLRQMWSRSFQMRELRLAHCNNLTDNAFPSARGTTGVPMLGTSHSQSSRSAIPAASAYTTDSAPTSRGESPSVNMPFDAVRDGVLLTRSASIPNDMAQNRLFEHLRILDLTACTSISDDAVEGIIANVPRLKNLALTKCTRLTDEALYSIAKLGKNLHYLHLGHVSNITDRAVTHLARSCTRLRYIDVACCPNLTDLSITEIANNMPKLRRIGLVKVVNLTDQAIYGLVDRYDSLERIHLSYCENVSVPAIFCVLQRLDRLTHLSLTGVPAFRRPELQAMCRAPPKDFNDHQRQAFCVYSGKGVNDLRKYLQHVYSDEQLAAEFGQLEPRAMNALGGFGEHPGAETAMSQWTAHHAHYAPATFGGGPGAAGIAYAHAQPHAPPQPGAPPLGLVGGAPAPAPIAAGLYHPTAGGIHHAGAGAGITRRRQLTTAEQMYFEQQRQLARYANARRAAQDATLLNRSASTDGANRRGKESGHAVGGKRPVCCSTCHAPR

SEQ ID NO: 40558 - protein, 612 aa, Oryza sativa (japonica cultivar-group)
MVRSGSVRRTAASSSPAAAAVPTAFTASPGDYRLLEEVGYGANAVVYRAVFLPSNRTVAVKCLDLDRVNSNLDDIRKEAQTMSLIDHPNVIRAYCSFVVDHNLWVIMPFMSEGSCLHLMKVAYPDGFEEPVIASILKETLKALEYLHRQGHIHRDVKRNIIQAGNILMDSPGIVKLGDFGVSACMFDRGWLQKFSSLEQDIISSTLGKNSNYHKNTGNKVLLMTLQNAPPGLDYDRDKRFSKSFKEMVAMCLVKDQTKRPTAEKLLKHSFFKNAKPPELTVKSILTDLPPLWDRVKALQLKDAAQLALKKMPSSEQEALSMIHDDDPPEIKEDVDNDRINEADKEPFSGNHFGQPKILSGKHFRLNHEQTCVTAVSPGGNMHETSRGLVSEPGDADSERKVDGYRKQGEAAVKLASDKQKSCTKRTTNLSGPLALPTRASANSLSAPIRSSGGYVGSLGDKSKRSVVEIKGRFSVTSENVDLAKVQEVPTSGISRKLQEGSSLRKSASVGHWPVDAKPMDLITNLLSSLQQNEKADATQYRLGNMDGDTEVETSISEGERSLLVKIFELQSRMISLTDELITTKLQHVQLQEELKILYCHEEIIDTREVDNA

SEQ ID NO: 40559 - protein, 348 aa, Streptococcus thermophilus LMG 18311
MLNMTKKIVTLSGDGIGPEIMAAGLGVLDKVASKIEFDYDVDAKPFGGAGIDAEGHPLPKATLEAAKSADAILLAAIGGPKYDNAPVRPEQGLLAIRKELNLFANIRPVRIFDALKHLSPLKPERIEGVDFVVVRELTGGIYFGEHILEEDKARDINDYSADEIRRIMRRAFKIAQGRGKKVTSIDKQNVLATSKLWRKVADEVSLEFPDVTLEHQLVDSAAMIMITNPARFDVVVTENLFGDILSDESSVLPGTLGVMPSASHSENGPSLYEPIHGSAPDIAGQGIANPISMILSVAMMLRESFNETEGAELIENAVDKTLNQGILTRDLGGQASTAEMTAAIISNL

SEQ ID NO: 40560 - protein, 171 aa, Prochlorococcus marinus subsp. marinus str. CCMP1375
MNFSQLLIYPPFLEFLDNAVLAWALIACGLAQFSKLFVELIFYQKWRPSVLLETGGMPSSHSALVMGTASGIGLEQGFDHPAFALAITVAFIVMYDASGIRRSAGLIATRVNELPTNNWPSPPETPLKEALGHSRLEVFIGSLFGPSVALPGIILIGSPLDFLHSIGLMTV

SEQ ID NO: 40561 - protein, 230 aa, Streptococcus thermophilus LMG 18311
MVKLVFARHGESEWNKANLFTGWADVDLSEKGTQQAIDAGKLIKEAGIEFDKAYTSVLKRAIKTTNLALEASDQLWVPVEKSWRLNERHYGGLTGKNKAEAAEQFGDEQVHIWRRSYDVLPPKMDRDDEYSAHKDRRYASLDDSVIPDAENLKVTLERALPFWEDKIAPALKDGKNVFVGAHGNSIRALVKHIKKLSDDEIMDVEIPNFPPLVFEFDEKLNVVSEYYLGK

SEQ ID NO: 40562 - protein, 474 aa, Populus trichocarpa
MVRKEEEKQKKEKGMQLGKYELGRTLGEGNFGKVKLAKNIETGQPFAVKILEKNRIIDLKITDQIKREIATLKLLKHPNVVRLHEVLASKSKIYMVLEYVTGGELFDRIASKGKLPEAEGRKMFQQLIDGVSYCHSKGVFHRDLKLENVLVDAKGNIKISDFGLSALPQHFRDDGLLHTTCGSPNYVAPEILSNRGYDGATSDIWSCGVILYVILTGYLPFDDRNLAVLYQKIFKGDAQVPKWLSPGAKNMIKRILDPNPVTRITTADIKADEWFKLDYTPMDSAEEQDDVYIDDAAFSIQEAPSEDGSPKSPNLINAFQLIGMSSCLDLSGLFEKEDVSERKIRFTSNHSMSDLLEKIEDIVTEMGFRVQKRNGRFQVIQEHRGKKSSGSLSVATEVFEISPSLYVVELRKSYGDSSAYRQLCTKLSNDLGVPSSPGLLTTEGTSRPLEHMPTTRLPFLKWRNLSLDARTLDR

SEQ ID NO: 40563 - protein, 218 aa, Colwellia psychrerythraea 34H
MTQDEMKNAAAIKALEFIENDTIVGVGTGSTVNFFIEALASMKDKIAGAVSSSEESTKRLKAHGIEVFDLNSVDVLDVYVDGADEITRHMSMIKGGGAALTREKIVAAVAKKFICIADDSKQVKVLGNFPLPVEVIPMARSYVARELVKLGGDPVYRQGVTTDNGNVILDVYNLEILDPKALETQINAIVGVVTNGLFALRGADILVLGSKDGIQVIQ

SEQ ID NO: 40564 - protein, 156 aa, Arabidopsis thaliana
MDYQQKPPQSSDPSPSPPDRPPGIRSPETPSNNQNNDIEDIMACVTALEAALLPCLPARELQAIDRSPHPSHQIDVERHARDFMEAAKKLQLYFMGLKREDRAPSRAESLKKDIAVMEEELKTKDELIKKHMRLFQESQKLVKEQIEKHRDELEKV

SEQ ID NO: 40565 - protein, 549 aa, Methanothermobacter thermautotrophicus str. Delta H
MPVITFDYDDLKELGIDIDREKLLDVLPMMGSDIEDFDDESIKVEFFPNRPDLLSVEGVARSLRGFLGIEKGMPSYDVHDSGVEVTVDESVLDVRPYLGMAVIEDVQFTDKKLKQVMEFQEDLHWVIGRDRRKVAIGIHDLDRVEPPFLYSGVEPEGVTFTPLDSVCEMTPHEILEEHPKGVSYAHLLRDHDRYPLITDKNGDVLSMPPIINGELTKLTVNTRRILVDVTGTDDRAVRQTLNIICTSFAEAGGRIGSVRVKRPDGELHLPDLTPREMRVSVSEASRITGLELSADEVMDLLMKARMDARRTSDDEVVAVIPAYRVDILHEVDLVENIAVQHCIGRIEPELPDIATIAEEDTWSRADASIREVMVGLGFQEVMSLMLTSEESHYRRMRLEEDERVEVAQPISQDRTMIRKSLLNGLLEFFEDNKHEDLPQKIFEVGDVVYINPESETRSRVVTKLACAVTHSSAGFTEIKSLAAAVVENLGYEFRIEPLEHPSFIEGRCAAIESEGKSSAIGGFFGEVHPEVVTNFNLEYPVIALEIEFK

SEQ ID NO: 40566 - protein, 878 aa, Microbispora rosea
MPKYVYDFTEGNKDLKDLLGGKGANLAEMTNIGLPVPPGFTITTEACRHYLQHGGMPDGLAEEIDEHLAALEERMGKRLGQADDPLLVSVRSGAKFSMPGMMETVLNIGLNDDSVVGLAKQSGNDRFAWDSYRRLIQMFGKTVLGIDGELFENAMDELKGERDDTDLEAADLQRLVDTFKRIVRDQTGRDFPADPREQMDLAVRAVFDSWNAPRAILYRRQERIPADLGTAVNVVAMVFGNMGPDSGTGVAFTRDPGSGRQGVYGDYLRNAQGEDVVAGIRNTIPLQELESINPQAYRELLDIMATLERHYRDLCDIEFTIERGKLWMLQTRVGKRTAEAAFRIATQLVDEGLIDMDEAVARVTGDQLAQLMFPRFAATADARRLTTGMNASPGAAVGKAVFSSERAVELAGQGEAVILVRRETNPDDLAGMIAARGVLTSRGGKTSHAAVVARGMGKTCVCGAEELEVDPHARRFTAPGGIVVNEGEVISIDGSTGAVYLGEVPVTASPVARYFEGEPAEDELVRAVDRIMTHADSVRRLAVRANADTPEDAARARRYGAQGIGLCRTEHMFLGERRRLVEDLILAATPEERQAALDALEPLQTEDFTGIFTAMRGLPVTIRLIDPPLHEFLPDLTELAVKVAVAGEAADDRDRRLLEAVKRLHEQNPMLGLRGVRLGLTIPGLFAMQVRAIAAAARRVEDARAEIMIPLVGAVQELEIVREEAERILAEAGVTAAIGTMIEVPRAALTAGQIAEAAEFFSFGTNDLTQMTWGFSRDDVESAFFGQYLDLGVFGVSPFESIDREGVGRLMRIAVEEGRRARPGLKLGICGEHGGDPDSVRFCHEIGLDYVSCSPFRIPVARLEAGRAALTCAASDTR

SEQ ID NO: 40567 - protein, 328 aa, Triticum aestivum
MSSRMAGSVLLRRAGAGAGRLFATTASPAARTALGGGGGAWVRMMSTSAASQVKDEAAKGVKAEAAKGDGEKKEVAISSYWGIDQSKKLVREDGTEWKWSCFRPWETYTADTSIDLTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMQLKATPAPIGYH

SEQ ID NO: 40568 - protein, 384 aa, Acinetobacter sp. ADP1
MQPLSSKLPNQGVTIFSTMTALAQRLNAINLSQGFPDFATPDALIEALCDATRAGFNQYVSGDGWLPLREQVVQQFEQRDQVRLDPVHEITITPGATIAIFAAIQAVIHTGDEVVIFDPSYDSYAPAVRVAGGIPVHLALTAPDFRVDWQQVQDNINARTRMIIVNTPHNPTGTLWTLDDWHHLIELAEKHDLIVLSDEVYEHLVFDGHHHYSALHFSTLRERSFVVGSFGKTFHVTGWKTGYCVASPMLMKLFRQIYQYANFCGNTPAQVALSQYMQQHPEHIQELGSFYQAKRDLFNQGLTQSRFKFQPTHGTYFQTVDYTAIRPDLNDLEMCYFLAEQYGVVAIPLSVFYQQPDPELRLIRFCFAKTEQTLKDATQRLSQC

SEQ ID NO: 40569 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 40570 - protein, 170 aa, Helicobacter pylori
GSGMHTHVSMWKNNENLFSGEAYKGLSELALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIREKGIKQMPHTLRRSLEEMLADKQYLKEGH

SEQ ID NO: 40571 - protein, 170 aa, Helicobacter pylori
GSGMHTHVSVWKNNENLFGGETYKGLSELALHFLGGVLRHARGLAAFTNASTNSYKRLIPGYEAPSILTYSANNRSASVRIPYGISKNGARFEFRFPDSSSNPYLAFAAILMAGMDGVKNKIDPGEAMDINLFKLTLDEIREKGIKQMPHTLRRSLEEMLADKQYLKEGQ

SEQ ID NO: 40572 - protein, 359 aa, Magnetococcus sp. MC-1
MAKKVLVLPGDGIGQEITAEAVKVLNWAIQNGADITLEEGLIGGTAYDATGTPLPAETITQAKAAQAVLLGAVGGTKWEPLDISVRPEKGLLGIRKALDLYCNLRPAAVYPQLADASTLKKEVVAGIDIMVVRELSSGIYFGQPRGVEDLGDGRKKGFNTLVYTTDEIERIARKAFEAARKRSNRVCSVDKANVLESTELWREVVSDLHKREYADVELSHMYVDNAAMQLIRNPRQFDVIVTTNMFGDILSDAASMLTGSIGMLPSASLGDQFALYEPIHGSAPDIAGKGIANPLATILSVAMMLRYSLELPQLADGVEAAVVTVLDQGLRTADIMQPGMTQVGTAQMGDAVLAALNNA

SEQ ID NO: 40573 - protein, 392 aa, Malus x domestica
MAVECMIKPSSLQTMTQPPSPKTQQTQQHKEDDQKPLVFDASVFRYQTEIPSQFIWPDHEKPCKNTPELQVALIDLGGFLSGDKEAVAKASQLVGEACQKHGFFLIVNHGVDNKLIADAHCYMDDFFGMPLSEKQRAERKAGESCGYASSFTGRFSSKLPWKETLSFSYSAEKGSTNFIQDYFCDKMGEEFKEFGRVYQDYCKAMSTLSIGIMELLGLSLGVDRAYFKEFFEDNNSIMRLNYYPPCQRPEQTLGTGPHCDPTALTILHEDQVGGLEVFVDDQWHSVTPNLNAFVVNIGDTFMALSNGKYKSGLHRAVVNSETPRKSLAFFLCPRDDKVVKPPSGLVDTSSPRKYPDFTWSMLLEFTMKHYRADMKTLQVFSNWVQQKSNQKL

SEQ ID NO: 40574 - protein, 549 aa, Legionella pneumophila str. Lens
MKSIKQLIRLIHINYILAKNGLDNVVVSIKLFAPLRFIVYLNPWNWLRKEKLTRGEALRKSLEELGPIFIKFGQALSTRPDILPEDIAKELSKLQDKVPPFPSHIAMNIIEQAYKQSAYDVFAQFDPIALASASMAQVHAATLKTGENVVVKILRPNMRRLIEQDLSIMYTIAALADRYWPEGKRFKPKEIVKEFEHTLLDELDLMREAANAAQLRRNFNQSPMLYIPEIYWDYCHHNILVIERIHGIPVTDIASLRAHGIDIKKLAERGVEIFFTQVFRDCFFHADMHPGNIFVSYQNPKDPQYICVDFGIIGTLTDNDKRYLAENLVAFFNRDYKRVAELHVESGWVSRDTPVAEFESSIRTVCEPIFEKPLKDISFGQVVFRLFQVARRFHMEVQPQLILLQKTLLAIEGLGRQLYPELDLWATAKPFLEKWVREQMGPKAFIKRLKQNLPFFTEQLPHMPKLIFDILEMKKDQLLTVHELTRMQSENNNPTIQWKSVGLGVFFSFLSLGVISYFDLLDYNHLTTITIAGSVLAGVFVLINRKIRN

SEQ ID NO: 40575 - protein, 549 aa, Oryza sativa
MAAAAARRGSSLLSRCLLSRPAAAASPAVPSALRRADGTQGLLPGILQRFSTAAVAEEPISPPVQVNYTQLLIDGKFVDSASGKTFPTLDPRTGELIAHVAEGDAEDINRAVHAARKAFDEGPWPKMTAYERSRILLRFADLIEKHNDEIAALETWDNGKPYAQAAQIEVPMVARLMRYYAGWADKIHGLVVPADGPHHVQVLHEPIGVAGQIIPWNFPLLMFAWKVGPALACGNTVVLKTAEQTPLSALFASKLLHEAGLPDGVVNVVSGFGPTAGAALASHMDVDKIAFTGSTDTGKVVLELAARSNLKSVTLELGGKSPFIIMDDADVDHAVELAHFALFFNQGQCCCAGSRTFVHERIYDEFVEKAKARALKRVVGDPFKNGVEQGPQIDDEQFNKILRYIKYGVDSGANLVTGGDRLGDKGYYIQPTIFSDVQDNMRIAQEEIFGPVQSILKFNDLNEVIKRANASQYGLAAGVFTNNLNTANTLTRALRVGTVWVNCFDVFDAAIPFGGYKQSGIGREKGIDSLKNYLQVKAVVTPIKNAAWL

SEQ ID NO: 40576 - protein, 403 aa, Oryza sativa (japonica cultivar-group)
MTTPRTPRPPPNLRLSPPRFARRRDLRRSASPSPSASSTRPAAASPPRPAPTTSLDASAEVLSDAASSVSVPADVLADAAASVPVSAPAPFPGEVAAAAADSFAPVAALQHLIDGVHSLTGLNWWACIALTSLLIRTLTVPLLLNQMKATAMRPEIEAINLEMRTISSTRIAGNEKSSTRVTDEGSMSTDPQSMLEGKRKLGELFLRHGVTPLTPLKGLFIQAPIFMSFFFAISNMVEKVPSFKGGGIYWFTDLTTPDELLILPMLTSLTFLVTVELNMQDGMEGNPMLKTMKNFSRVMAVLTIPFTMSFPKAIFFYWVTSNLFSLGYGFVLRKPAVRSFLDLPPIETQFAPAQQPTFNLFGASKSVPAAGSSIAESDRSSSVLSQRFSDLENRAKSRRESQD

SEQ ID NO: 40577 - protein, 290 aa, Streptococcus thermophilus LMG 18311
MTKLKKIDAAIRDFYQKKTPPVSSDLIIAILYSVDSGGKRIRPLIFLDLLEGFGLELTPSHFDVAASLEMIHTGSLIHDDLPAMDNDDYRRGRLTNHKKFDEATAILAGDSLFLDPFALVAQTELSAEIRVQLIHALSHASGTFGMVGGQMLDMKGEGLELDLSQLAKIHENKTGKLLTFPFVAAGIVAQQEDRVMENLQEAGRLIGLAFQVRDDILDVTADFESLGKTPGKDVVAGKSTYPALLGLEKSYAILEESLNKAEAIFKDLAEYQGFKQDNIMKIIERLRFHA

SEQ ID NO: 40578 - protein, 336 aa, Clostridium thermocellum ATCC 27405
MVTKEDFVFSVEKVQNFEKDILRMISPQVRDVLKKIPLNELITTEEIRLRANKPLMIQNEKGSFFVNLEGRLTANRMNLFYVSQEQIAKTLELISENSIYAFQDEIRNGFLTIRGGHRVGIVGRVVLNGDTVKNIKDVSGLNIRISREITGCSSKVLKYIISSEKQVYNTLIVSPPQCGKTTLLRDITRAISDGVEEMGFKGVKVGVVDERSEIAACYKGVPQNRVGTRTDVLDACPKQIGMIMMLRSMSPDVIVTDEIGNKGDKDALIQVLNAGVKVISTAHGYNISELKSRKEVLSLIEEKMFERYIVLSARKGPGTVEEIIDGTDMSILYKGE

SEQ ID NO: 40579 - protein, 175 aa, Triticum aestivum
MAPPVWALWATSVVPFQGLKSTAGLPVSPRFHGGSLGSVSNGGRIRCMQVCPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQWVSFIAFKPPGCEESGKA

SEQ ID NO: 40580 - protein, 248 aa, Burkholderia sp. 383
MYKLVLIRHGESTWNKENRFTGWVDVDLTEQGRNEAYQAGELLKEAGYTFDIAYTSVLKRAIRTLWHVQDKMDLMYLPVVHSWRLNERHYGALSGLNKAETAAKFGDDQVLVWRRSYDTPPPALEATDERAPFNDPRYAKVPREQLPLTECLKDTVARVLPLWNESIAPAVRAGKQVLIAAHGNSLRALIKYLDGISDSDIVGLNIPNGVPLVYELDENLKPIKHYYLGDQDAIAQAQAAVAKQGKAG

SEQ ID NO: 40581 - protein, 443 aa, Vibrio sp. Ex25
MSYVFHRHCHATLPIIDKGEGVYLFDKQGKQYLDACGGAAVSNLGHSHQAVKKAMLEQLERVPFAHTGFFTSDSGERLAELICQYMPEQFNHVYLVSGGSEAVESALKMARQHFVESGKPEKKQFIARQQSYHGNTLGALAVGGNEWRREPFKPILHPSHHIAPCYAYRYQQTHESELDYSLRTANELEAKILELGAENVMAFVAEPIVGATAGAVPATQGYFKRIREICDQYDVLLILDEVMCGVGRSGSFFAFEQEEAEPDLVCMAKGLGAGYQPIGAVVANDRVYQAIADGSGFFQHGHTFMAHPVACAAAVATIETIFQDDLLTAVNQHSVLLRNELTSALAHLPYIGDIRGKGLFVGIELVADKESKSPLSKATLADKRIKQRAMENGLMCYPMGGTIDGVNGHHILLAPPFIVQPHHIDELVGKLSLTLKEVAETWK

SEQ ID NO: 40582 - protein, 724 aa, Spinacia oleracea
LTVTPIRDDKGCVIKFIGMQVEVSKFTEGINDKALRPNGLPKSLIRYDPRQKEAALGSIIEVVQTVKHPRSLSQPLSNNDADRREVAGKFNLDYMLPKLAEIDNVGTPGRLSSPSRLSTPGRQTPKIDASSRDSDKSSRKSARISLLGFKGRSSAKHERPPSPEPEFLIPKDIDRDDSWERAERERDVRQGIDLATTLERIEKNFVISDPRLPDNPIIFASDSFLELTEYTREEILGRNCRFLQGPETDQTTVQKIRDAIKEQRDITVQLINYTKSGRKFWNLFHLQPMRDQKGELQYFIGVQLDGSDHVEPLRNRLSERTEIQSAKVVKATAENVDEAVRELPDANSRPEDLWAIHSEPVYPRPHKRGSSSWAAIQKITAAGEKVGLEHFNPIKPLGCGDTGSVHLVELKVPENWFAMKAMDKSVMLNRNKVHRACVEREIISTLDHPFLPTLYASFQTSTHVCLITDFCPGGELFALLDKQPLKIFKEESARFYAAEVVIGLEYLHCLGIIYRDLKPENILLQKDGHLVLTDFDLSFLTSCNPHIINHPQPKKRRSRSQPPPTFIAEPVTQSNSFVGTEEYIAPEVITGASHTSAIDWWALGVLLYEMLYGRTPFRGKNRQKTFANIMHKDLTFPSSIPVSLSARQLIYALLNRDPATRLGTQGGASEIKEHPYFRGINWPLIRCMDPPTLEAPFKLIGRDPNAKEVKWDDDGVLASPMDFF

SEQ ID NO: 40583 - protein, 365 aa, Arabidopsis thaliana
MAALKGYGLCSMDSALQFPCPKLFNSYKRRSSKWVSPKAAVVPNFHLPMRSLEVKNRTNTDDIKALRVITAIKTPYLPDGRFDLEAYDDLVNIQIQNGAEGVIVGGTTGEGQLMSWDEHIMLIGHTVNCFGGSIKVIGNTGSNSTREAIHATEQGFAVGMHAALHINPYYGKTSIEGLIAHFQSVLHMGPTIIYNVPGRTGQDIPPRAIFKLSQNPNLAGVKECVGNKRVEEYTENGVVVWSGNDDECHDSRWDYGATGVISVTSNLVPGLMRKLMFEGRNSSLNSKLLPLMAWLFHEPNPIGINTALAQLGVSRPVFRLPYVPLPLSKRLEFVKLVKEIGREHFVGEKDVQALDDDDFILIGRY

SEQ ID NO: 40584 - protein, 170 aa, Helicobacter pylori
GSGMHTHVSVWKNKENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 40585 - protein, 250 aa, Oryza sativa (japonica cultivar-group)
MDLATTPARRPMEAGMARRLWHVVLAVCHMLRRGLCRKRLMVDLHVLLGRGKLAGKALRGLLAHHAAAGHGHHLAASSSSSAALASFYGRRPREVEFSCTTTPSSYPHYGLFPFKSRGGGGGRRGGGGGGEYGGLDAAAVARAFEMMSAEVEGTPSSSAAAVQGGGGGGWATATPSPMVAWILGRSPAGVRPLRVTDSPFPAVPENGGGGGGEQRVDDAEFEDFINKFYEQLRMQPSAATPDCQLRRRGR

SEQ ID NO: 40586 - protein, 122 aa, Triticum aestivum
HQRDREGSSVADTKSIATAKLMGLCFIILTIGVAVSADECEGDRQAMIKECAMYQKWPANPKIDPSDACCVVWQKANIPCLCAGVTKEKEKIYCMEKVGYVANFCKKPFPHGYKCGSYTFLA

SEQ ID NO: 40587 - protein, 233 aa, Allium sp. AL-2003
VQLKRMENKINRQVTFSKRRNGLLKKAHEISVLCDAEVALIVFSAKGKLYEYSTDSSMEKILERYERYCFAEKSSTMSDIDSQEDWSLEYHKLKAKVESLNNRQRHLMGEQLESLSLREIGQLEQQLENSLKTVRTRKSQELLSSISELQDKEKTLRDENKALENELMKRARAKAILEQQARWKHHNHKQQDNLHNPNINIGNYQTRNNEGGVEPATDVQVRVVRNLLPHWML

SEQ ID NO: 40588 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKESQ

SEQ ID NO: 40589 - protein, 170 aa, Helicobacter pylori
GSGMHTHVSVWKNNENLFSGETYKGLSGLALHFLGGVLHHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKEGQ

SEQ ID NO: 40590 - protein, 170 aa, Helicobacter pylori
GSGMHTHVSVWKNNENLFSGETYKGLSEFALHFLGGVLCHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 40591 - protein, 329 aa, Arabidopsis thaliana
MAIRSLPSSSGCSNSSSSSSYSLASTSLSNRLETIFRKASELCTLCDIEACVIYYGPDGELKTWPPEREKVEDIALRYSQLNEALRRKKSVTLYDFLNKKKNKTNLEKKAKIKDNDLKRLSLEPHVSKVRERIRFVESQKHKETKPDHQSLASSSLNNQTQSLNPSQFSLFMYNHGDNILSQIPVSASNFNQDYFSALLEQSELKSQIMKQEVCGYEQNMCMSNNGDATLSQIPLSASNFNQEFSALLQEESGLMQQELCNYDQNMFMNNNNFQHSFVSNTQDHSAPAVQESVNNNYGLMPHVPCGYDQNLFTSDITNNNLLIDNSMFL

SEQ ID NO: 40592 - protein, 178 aa, Deinococcus radiodurans R1
MGVLDIAKGMGVTLGKLFQKPLTVSYPEQRATLQPRFRGRHVLTRHPDTGLEKCIGCSLCAAACPAYAIYVEAAENDPRDPVSPGERYAKVYEINMLRCIFCGLCEEACPTGAVVLGNEFEMADYRSRDFVYGKEDMLVGVTGSRPQRREALSAGRPVRLGFQVEGGPRAELEGVEYP

SEQ ID NO: 40593 - protein, 389 aa, Nocardia farcinica IFM 10152
MSRESRRSTIPPFYVMDVWKAAAERARTHGDVLVLAAGQPSTPAPAPVLRATKAAIDAELLGYTETFGILPLRRAIAEHHSRTYGYAVDPDDVVVTTGSSGAFTLIFLAAFDAGDTVVVARPGYPAYRNTLTALGCRVVELDCGPDTRFQPTVAMLDALPEPPAGLIVASPANPTGTMIDPAELAALARWCDEHGTLLVSDEIYHGITYGSAGADARTASAWETSRTAVVIGSVSKYFSMTGWRLGWMLAPADLRPALQRLASNMTVCPPAISQYAAVHAFGAEAKAELDGHVGRYATNRRLLLDGLAALGITDLAPADGAFYAYADIGHLTDDSLKWCAELLGQTGVALAPGIDFDTVAGHRFVRFSFAGATAEIEEALARLGRHLAS

SEQ ID NO: 40594 - protein, 356 aa, Prochlorococcus marinus str. AS9601
MHKVLAIETSCDETSVSIVSNIGDTFRIHSNIIASQIEDHSKWGGVVPELAARKHLELLPFVLDKALEEAKIKIEEVDYIASTVAPGLVGCLRVGSITARSLCMLHSKPFLGIHHLEGHLSSILFSENYPKKSFLTLLVSGGHTELIKVDDSRGMQRLGKSFDDAAGEAFDKVGRLLGLSYPGGPAIEKIAKNGDPMKFNLPKCKISDKKGGFLKYDFSFSGLKTAVLRLVERINLTGKTVPIPDIAASFERVVAEVLVDRTIKCAQDHSLDTVVVVGGVAANNTLRKMMISEASKKSIKVHLAPLDLCTDNAAMIGAAALFRIKFKDHFSSLKLGVAGRLSIEQADNLYEETPPF

SEQ ID NO: 40595 - protein, 200 aa, Nocardia farcinica IFM 10152
MLIGPERAPCVVTLRCRLRALTARAVSPLPRPGLRIRLRRTLPRLARRLRLRFGVDPYTIFSDIIAGRAPASTVYEDSDVLAFMDIRPMTPGHLLVVPKVPARSLAELDPAIGGKLFQVGQKLAAALRASEVACDGVNFFLADGVAAGQEVFHVHLHVIPRTAGDGFGLRGRPTSPPRADLDYLAGSIRGALTRAGSASS

SEQ ID NO: 40596 - protein, 247 aa, Mycobacterium smegmatis str. MC2 155
MATLILLRHGESQWNEKNLFTGWVDVDLTDKGRAEAVRGGQLMAEQGVLPDVLYTSLLRRAITTAHLALDAADRLWIPVHRDWRLNERHYGALQGLDKAETKEKYGEEQFMAWRRSYDTPPPPIEKGSKYSQDADPRYADIDGGPLTECLKDVVERFVPYYESAILPDLKAGKTVLIAAHGNSLRALVKYLDGMSDEEVVGLNIPTGIPLRYDLDENLKPVKIGGEYLDPEAAAAGAAAVAAQGAKK

SEQ ID NO: 40597 - protein, 159 aa, Prochlorococcus marinus str. AS9601
MTKMAKEKQEKDLETGIKAEASVDVAVEQKEKNTVSETKQTLSASNLIREFENEQLKKELPEIYVGDTVKVGVKITEGNKERVQPYEGVVIAKRHGGINQTITVRRIFQGIGVERVFMLHSPQVASLKVERRGKVRRAKLFYLRDRVGKATRVKQRFDR

SEQ ID NO: 40598 - protein, 585 aa, Mycobacterium smegmatis str. MC2 155
MAISVQMPALGESVTEGTVTRWLKQEGDTVELDEPLLEVSTDKVDTEIPSPAAGVLTKIVAQEDDTVEIGGELAVIGEAGEASAEAPSEDSAPAPEPEPEPEPEPQQTQPTAAPAESVESAPAESSAPSQGGGSATPILMPELGESVTEGTVTRWLKNVGDKVEVDEPIVEVSTDKVDTEIPSPVAGTLLSITANEDDVVEVGGELAKIGDAGAAAEPKPEPKPEPKAEPKPEPKPEPKPEPKAEPKPEPKPEPKPEPKAEPAPAASSDGSPYVTPLVRKLAAENGIDLSTVKGTGVGGRIRKQDVLAAAEKAKEAKQAPAASPAAAAPAAPAAASATPAPALAHLRGTTQKANRIRQITAKKTRESLQATAQLTQTHEVDMTKIVALRARAKAEFAEREGVNLTFLPFIARAVIDALKIHPNVNASYNEDTKEITYYDAEHLGFAVDTDQGLLSPVIHNAGDLSLGGLARAIADIAARARSGNLKPDELAGGTFTITNIGSQGALFDTPILVPPQAAMLGTGAIVKRPRVIVDEYGNESIGVRSVCYLPLTYDHRLIDGADAGRFLTTIKRRLEEGAFEADLGL

SEQ ID NO: 40599 - protein, 702 aa, Burkholderia pseudomallei K96243
MPTPTPDRLEPGRSYPLGAHWDGLGVNFAVFSAHARRVQLCLFDPTGRREIARLDLPECTDEIWHGYLPDAHPGTVYAFRADGAYEPQHGHRFNPHKLLLDPYARKLVGQFRWSDALFGYRLHSSRADLSIDRRDSAPAMPKCVVVDEAVDWSTDRRPCVPWRDTVIYEAHVRGVSMRRAELRAPERGTFAALACPAFIDHLLALGVTSIELLPVHAFMHARALVNLGLCNYWGYDTAAFFAPEPSYLATRRLDEMRIAIRQLHAAGIEVLLDVVYNHTCEGNQLGPTICWRGLDNASYYRLAPDDPRRHIDETGCGNTLDLSHPRVLQMVMDSLRYWSNAFNVDGFRFDLCATLGREAAGFDPGAGFFDALRQDPVLATRKLIAEPWDVGPGGYQLGRHPAGFAEWNDRFRDTVRRFWRGDAGMRPELAARLAGSADLFNHHGRRTWSTVNFVAAHDGFTLADLVSYAAKHNDANGEDNRDGRDDNCSANWGAEGPTEDRQVRAVRARVARSLLTTLFAALGTPMLLGGDEFGRTQQGNNNAYCQDNELSWFDWSAAESADGRTMIHFVGRLAALRRAYPVLSEPRYPSGERDGAPGLHEIDWFDERGDALTVPAWHDRERRALTMRRVGNGRAGRPEALLLMLNASSDAIVFHAPPPSLVYRILLDSAAPDAAPRLMPADGVEIAAHAAVIAAASVPEAG

SEQ ID NO: 40600 - protein, 172 aa, Streptococcus thermophilus LMG 18311
MKLEDYIATIENYPKEGVTFRDISPLMADGNAYSYAIREIVQYATDKKIDMIVGPEARGFIVGCPVAFELGIGFAPVRKPGKLPRKVISVDYEKEYGVDTLCMHADAIKPGQRVLIVDDLLATGGTVKATIEMIERLGGVVAGCAFLIELDGLNGREAIEGYDAKVLMNFPG

SEQ ID NO: 40601 - protein, 298 aa, Clostridium thermocellum ATCC 27405
MDIDVRVTGKTKLLGLVGNPVEHSISPQLHNTLSSLLGLDIVYIPLAVGKEDLETVVKALKALDFIGFNVTIPYKRDIMKYLDENSKEAILMGAVNTVKKIDGRLYGYNTDAEGFLRSFKEEAGVGFKGKKVVLIGAGGVARAIAVKIASEDAEKISVVNRTVEKSVELAEVVNENIKEIVQVYNFEDKTFRMAFEESDIIINTTSVGMYPKTRETPVKFTECFNKNQIVYDVIYNPEKTKFLNDAEKRGAKIINGLGMLFYQGISAYEIWTGVKFTEDKLKSVYESFKKYLQLKSAK

SEQ ID NO: 40602 - protein, 295 aa, Psychrobacter arcticus 273-4
MANPSKKAISKAVQDKNIIITGASSGIGERTAFLLSECGAHVILLARTEEKLKAVKEGIEELGGRASYYPCDLTNMDEIETVSAQILADFGHVDVLINNAGRSIRRSVHESTERFHDFVRTMDVNYFGAVKIILGFLPTMIERQTGQIVNISSIGVLANSPRFAAYVASKSALDAFSRCLAAEVKGDNVTITNIFMPLVRTPMIEPTKLYRYMPALMPDEAAMMVAKAIVHKPNSIASNMGKFASATYSLAPAINVGIQSMGYRIFPSTRAGLTTDKKPNLAQRAFARILPGEYH

SEQ ID NO: 40603 - protein, 356 aa, Clostridium thermocellum ATCC 27405
MSYQISIQKTQNPKNKPDQDNLGFGQIFTDHMFIMDYTEGKGWHDPRIVPYGPLSLEPSTMVFHYGQAVFEGLKAYKTEDGRILLFRPRKNMERINISNERVCIPKIDVDFAVEACKTLVSVDRDWIPEAEGTSLYIRPFIISTDPFLGVRPSWTYKFIIILSPVGAYYKEGINPVKIYVESEYVRAVKGGTGYAKTPGNYAASLIAQVKAKELGYTQVLWLDGVEKKYIEEVGTMNVFFKINGEVITPSLDGSILAGITRESTIELLRASGIKVTERKITIEEIYNAHEAGTLEEAFGTGTAAVISPIGELSWNGKVIKINDGKIGETASFVYNTITGIQSGKIEDKFGWTVEVK

SEQ ID NO: 40604 - protein, 451 aa, Populus trichocarpa
MEKMGPILMNRYELGRLLGQGTFAKVYHARNLQSGQSVAIKIIDKGKVLRSGLIDQIKREISVMRLVRHPNIVQLNEVMASRTKIYFVMEFVKGGELFNLVSKGKLKEDVARKYFQQLIGAVDFCHSRGVYHRDLKPENLLLDENGDLKITDFGLSALSESRRQDGLLHTTCGTPAYVAPEVINKKGYDGPKADIWSCGVILFVLLAGFLPFHDQNLMELYRKITKGEFRCPNWFHPEAKKLLSRILDPHPSSRTSIEKITKNCWFRKGYKQIETPPSPQGHARSNLIKDVHSAFDSASDNESNSRENVMVAPRSPLRPTCYNAFDIISLSKGFDLSGLFEKDKNRRQEARFTTTKSASMIMSKFEQIAMAESFSFKKKDGTLMLEGSREGRKGLLAIDAEICEVTPSFYVVEMKKKSGDSFEYKEFCDHELKPSLKDIVWAWQGSEQPQV

SEQ ID NO: 40605 - protein, 351 aa, Gordonia sp. TY-5
MKALVFHGPGQKAWEDVPDPKLSEPTDVIVKMDTTTICGTDLHILKGDVPAVTPGRILGHEGVGTITEVGDAVTTLAVGDQVILSCISSCGKCSFCKQGVYSHCLGSEGTSGIGWIFGHLIDGTQAEYVRVPYAENSVHKLPSAVSPEQGTLLSDILPTGHEIGVRHGAVKPGDVVAVIGTGPVGLAAIATAGLYGPSRVIAVDIDANRVEQARRFGATDGVVSTSSGWREEILAMTDGLGVDVAIEAVGIPDTFQMCLDIVRPAGHVANVGVHGKPVELPIQDLWISNIVMSMGLVNTNTLGTLLKLVAQRRIDPEPFISHRFGLGEIIDAYDVFSRAAETKALKVIMSA

SEQ ID NO: 40606 - protein, 170 aa, Helicobacter pylori
GSGMHTHVSVWENNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 40607 - protein, 269 aa, Zea mays
KRPSSSPPSVPNLIDTRPRWAARFFVGGNWKCNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 40608 - protein, 297 aa, Polaromonas sp. JS666
MRPQMMNSQQLTRSGTDKAAPAWVDKQIQLSLKKPLDVRFYGRHRVGAVSPLVVHFHGGAFAGGSLDGGSCVARLLADAGAVVMSLDYPLAPAHPFPAAVETGYAALLWAWKARQKLAGQGAPLFIAGEEAGGNLAAAVSLVARDRQEPALAGQILLSPMLDPCLATASLRDAEAGPVGCVWADGWHHYLPRLEDASHPYAAPGSALRLTGLPPTLLVTAQDDPLRDETLEYAERLRAAGLVAQHAVLPVVTGWPCSYLQPASHEAAWAPAVRQLFTEFFAGTPALQAGHTHSSSVS

SEQ ID NO: 40609 - protein, 252 aa, Prunus persica
MPIRNIAVGRPEEAYHPDALRAGLAEFISTLIFVFAGEGSGMAFAKLTHGAATTPAGLVAAALAHGFGLFVAVSVSANISGGHVNPAVTFGAFVGGNISLLRGILYWIAQLLGSAVACGLLRFAPNYQTTSAFALSEGVGVWNAFVFEIVMTFGLVYTVYATAIDPKRGSVGTIAPIAIGFVVGANILAGGAFDGASMNPAVSFGPALVSWNWHNHWIYWAGPLIGGGLAGLIYEFVFIGNSSHEPLPTADY

SEQ ID NO: 40610 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFVDMLDGIFSFVLLDTRDNSFIVARDAIGVTSLYIGWGLDGSVWISSELKGLNDDCEHFESFPPGHLYSSKERAFRRWYNPPWFSEAIPSAPYDPLALRHAFEKAVVKRLMTDVPFGVLLSGGLDSSLVAAVTARYLAGTNAAKQWGTKLHSFCVGLEGAPDLKAAKEVADYIGTVHHEFHYTVQDGIDAIEDVIYHIETYDVTTIRASIPMFLMSRKIKSLGVKWVISGEGSDEIFGGYLYFHKAPNKEEFHQETCRKIKALHKYDCLRANKSTFAWGLEARVPFLDKDFIRVAMNIDPEYKMIKKEEGRIEKWALRRAFDDEEHPYLPKHILYRQKEQFSDGVGYGWIDGLKAHAEKHVTDRMMLNAANIFPFNTPTTKEAYYYRMIFERFFPQNSARLSVPGGPSVACSTAKAVEWDAAWSNNLDPSGRAALGVHASAYGNQVKAVEPEKIIPKMEVSPLGVAI

SEQ ID NO: 40611 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSTRFEFRFPDSSSNPYLAFAAILMAGMDGVKNKIDPGEAMDINLFKLTLDEIREKGIKQMPHTLRRSLEEMLADKQYLKEGQ

SEQ ID NO: 40612 - protein, 585 aa, Medicago sativa subsp. x varia
MADEPLYPIAVLIDELKNDDIQLRLNSIRRLSTIARALGEERTRKELIPFLTENNDDDDEVLLAMAEELGVFIPYVGGVEHASVLLPPLEAFCSVEETCVRDKAVESLCRIGSQMRESDLVEYFIPLVKRLAAGEWFTARVSACGLFHIAYPSAPEASKTELRSIYSQLCQDDMPMVRRSAATNLGKFAATVEYTHLKADIMSIFDDLTQDDQDSVRLLAVEGCAALGKLLEPQDCVAHILPVIVNFSQDKSWRVRYMVANQLYELCEAVGPEPTRAELVPAYVRLLRDNEAEVRIAAAGKVTKFCRILSPDLAIQHILPCVKELSSDSSQHVRSALASVIMGMAPVLGKEATIEQLLHIFLSLLKDEFPDVRINIISKLDQVNQVIGIDLLSQSLLPAIVELAEDRHWRVRLAIIEYIPLLASQLGVGFFDDKLGALCMQWLQDKVHSIREAAANNLKRLAEEFGPEWAMQHIIPQVLEMITNPHYLYRMTILRAISLLAPVMGSEVTCSKLLPAVVAASKDRVPNIKFNVAKVLESIFPIVDQSVVEKTIRPCLVELGEDPDVDVRFFSNQALQAIDHVMMSS

SEQ ID NO: 40613 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGH

SEQ ID NO: 40614 - protein, 587 aa, Medicago sativa subsp. x varia
MAMVDQPLYPIAVLIDELKNEDIQLRLNSIRRLSTIARALGEERTRKELIPFLSENNDDDDEVLLATAEELGVFVPYVGGVDHASVLLPPLETLCTVEETCVRDKSVESLCRIGAQMREQDLVEHFIPLVKRLASGEWFTARVSSCGLFHIAYPSAPEALKTELRAIYGQLCQDDMPMVRRSAATNLGKFAATVEAAHLKSDIMSVFDDLTQDDQDSVRLLAVEGCAALGKLLEPQDCVAHILPVIVNFSQDKSWRVRYMVANQLYELCEAVGPDSTKTELVPAYVRLLRDNEAEVRIAAAGKVTKFSRILSPELAIQHILPCVKELSTDSSQHVRSALASVIMGMAPVLGKDATIEQLLPIFLSLLKDEFPDVRLNIISKLDQVNQVIGIDLLSQSLLPAIVELAEDRHWRVRLAIIEYIPLLASQLGVGFFDDKLGALCMQWLKDKVYSIRDAAATNIKRLAEEFGPEWAMQHIIPQVLDMVNDPHYLYRMTILHAISLLAPVLGSEITTTNLLPLVVNAAKDRVPNIKFNVAKVLQSLIPIVDESVVESTIKPCLVELSEDPDVDVRFFASQALQSSDQVKMSS

SEQ ID NO: 40615 - protein, 219 aa, Chelidonium majus
  misc_feature (12)..(12): Xaa can be any naturally occurring amino acid
  unsure (1)..(219): unsure at all Xaa locations
GLVKKAHEISVXCDAEVALIVFSTKGKLFEYSTDSGMERILERYERYSYAERELVASELDQGNWSLEYTKLKAKIEILQKNQRHFMGEDLESMSLKELQNLEQQLDTALKQIRSRKNQLMYESISELQKKEKVLQEQNNQLGKKLKEKEKEVAQQQAQWDQQSQGQSSPSFLLSQSLPSLNIGGSYHMRGSNGSEEEGVRPQTTRTNTTLMPPWMVHHL

SEQ ID NO: 40616 - protein, 170 aa, Helicobacter pylori
GSGMHTHVSIWKNNENLFGGETYKGLSEFALHFLGGVLRHARGLAAFTNASTNSYKRLIPGYEAPSILTYSASNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQ

SEQ ID NO: 40617 - protein, 401 aa, Deinococcus radiodurans R1
MTAELQPEAGALLHTELMSLNVGPQHPSTHGVLRLVVDMDGEYVTRVEPHMGYLHTGFEKTMEHRTYQQNVTYAPRTDYLHSFSHELAYVLSVEKLLGAEVPERANVVRVILHELGRIHSHLVFVGTGLLDLGALTPFFYAFREKEACQDLFEAVCGYRMNQGYFRVGGLARDLPEGWTARVEAFLNQMERGVEEYTTLFAANPIFLDRAKGVGVIPADAALDLGLTGPNLRASGVPLDNRKDHPYCGFEDYDFNVISSPDGDSLARFNMRLLEFSESIKIIRQGLQKLRPGPIKDPNRKISLPPRHELETSMEAVIHHFKLVTEGFHPPLGEAYVPIESARGEVGYYVISDGGSMPYRVKIRAPSFVNLQALEYACVGVQFADLITILATIDPVLGDVDR

SEQ ID NO: 40618 - protein, 218 aa, Corylopsis sinensis
GLVKKAHEISVLCDAEVALIVFSTKGKLFEYSTDSCMEKILERYERYSYAERQLVATDPNSQGNLSLEYSRLKAKVELLQRNQRHFLGEDLDSLSLRELQTMEQQLDTALKRIRSRKNQLMYESISELQKKEKAMQEQNNMLAKKIKEKEKTMTQQAQWEEQNQDPGAASFLLQQPLPCLNIGNTYNQGVGGGAPEVRRNELDLTLEPVYPCHIGCFA

SEQ ID NO: 40619 - protein, 522 aa, Ipomoea batatas
MAAATIGALSSPYTGGVGERIDGDVSKASFRRLSFASSHLSGDKLMPLPPRRLRSGGKSSEVRTAPFIVSPKAVSDSQNSQTCLDPDASRSVLGIILGGGAGTRLYPLTKKRAKPAVPLGANYRLIDIPVSNCLNSNISKIYVLTQFNSASLIRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTLFGLDDQRAKEMPYIASMGIYVVSKDVMVNLLRQKFPGANDFGSEVIPGATSIGLRVQAYLFDGYWEDIGTIEAFYNANLGITKKPVPDFSFYDRSAPIYTQPRYLPPSKMLDADVTDSVIGEGCVIKNCKIHHSVVGLRSCISEGAIIEDTLLMGADYYETDADRRLLAAKGSVPIGIGRNSHIKRAIIDKNARIGNDVKIINNDNVQEAARETEGYFIKSGIVTIIKDALIPSGTII

SEQ ID NO: 40620 - protein, 229 aa, Corylopsis sinensis
VQLKRMENKINRQVTFSKRRAGLLKKANEISVLCDAEVGLIVFSTKGKLYDMERIFDRYERYSYAERQLVVTNHESQGSWTIEHAKLKARMEVLQRNQRHFMGENLDSVSLKELQNLEHQLDNALKHIRSRKNLLMQESISELQRKDKSLQEENNSLSKKIKEKENALAHRAQWEQQNQGLNSFPILLSQPPQSLNIGTYQTGCSEGEEGTPFQQRPNTLLPHWMVSHL

SEQ ID NO: 40621 - protein, 523 aa, Ipomoea batatas
MAAAIGAPKLAPYTCTAERNDGSARRAARFKSLSFASSNLSGDKLGSLVSRRCSRSGGKSSERRNAPIIVSPKAVSDSQNSQTCLDPDASRSVLGIILGGGAGTRLYPLTKKRAKPAVPLGANYRLIDIPVSNCLNSNVSKIYVLTQFNSASLIRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTIFGLDDQRAKELPFIASMGIYVISKNVMLNLLREKFPGANDFGSEVIPGATSIGMRVQAYLFDGYWEDIGTIEAFYNANLGITKKPVPDFSLYDRSAPIYTQPRYLPPSKMLDADVTDSVIGEGCVIKNCKIHHSVVGVRSCISEGAIIEDSLLMGADYYETDADRRLLAAKGSIPIGIGRNSHIKRAIIDKNARIGDNVKIINSDDVQEAARETDGYFIKSGIVTVIKDALIPSGTVI

SEQ ID NO: 40622 - protein, 267 aa, Prochlorococcus marinus str. AS9601
MSTSFKNVTPTGPGGTATLLIVLSFTGFLLLTQSLFVVPSGQVAVVTTLGKVSGPSRRAGLNFKLPFIQSVYPFDIKTQVQPEKFETLTKDLQVIRATATVKYSVKPNEAGRIFATIASRNSDVYQKIVQPSLLKALKSVFSQYELETIATEFAVISEKVGDTVAQELNSFDYVDVKSLDLTGLEIAEEYRAAIEQKQIAGQQLLRAKTEVEIAEQEALRYETLNRSLDDQVLFKLFLDKWDGSTQVVPGLPGSEGGSPPVIVGGRR

SEQ ID NO: 40623 - protein, 433 aa, Prochlorococcus marinus str. AS9601
MTDILNYTKSEEIFSAAQQLMPGGVSSPVRAFKSVGGQPIVFDRVKGPFAWDIDGNRYIDYIGSWGPAICGHAHPEVTTALQEAIEKGTSFGAPCVLENKLAEMVIDAVPSVEMVRFVNSGTEACMAVLRLMRAFTGRDKVIKFDGCYHGHADMFLVKAGSGVATLGLPDSPGVPRTTTANTLTAPYNDLEAVKKLFSENPDAISGVILEPIVGNAGFITPEPGFLEGLRELTTENGSLLVFDEVMTGFRISYGGAQEKFGVTPDLTTLGKVIGGGLPVGAYGGKKEIMSMVAPSGPVYQAGTLSGNPLAMTAGIKTLELLKQDGTYDKLDLITSRLIEGIIQSAENNGIAINGGSVSAMFGFFLCDGPVRNFNEAKTNDAELFGKLHKEMLRRGIYLAPSPFEAGFTSLAHSEEEIDKTIEAFDESFNAIKK

SEQ ID NO: 40624 - protein, 183 aa, Triticum aestivum
  misc_feature (70)..(70): Xaa can be any naturally occurring amino acid
  misc_feature (169)..(169): Xaa can be any naturally occurring amino acid
  misc_feature (176)..(176): Xaa can be any naturally occurring amino acid
  unsure (1)..(183): unsure at all Xaa locations
SFTYSVVGPAVMASSVTTVVPFQGLKSTAGLPVRRLSGSASLSSVSNGGRIRCMQVWPIEGIKRFDILSXLPPLSTEALLKQVDYLIRSKWVPCLEYSKVGFVFREHKSSPGYYDCRYWTMWKLSMFGCTDATHVLNEVEEVKKEYPDAYVRVIGFDNMRQVQCVSFIXAFRPPGXCEESGKV

SEQ ID NO: 40625 - protein, 517 aa, Vibrio sp. Ex25
MTKNIHDQRILILDFGSQYTQLVARRVREIGVYCELWSWDVEEADIREFNPDGIILSGGPESVTEENSPRAPQYVFDSGVPLLGVCYGMQTMAEQLGGKVAGSNEREFGYAQVKVSGECALFKDLEATQDVWMSHGDKVVEIPADFVKVGETDTCPYAAMANEEKKYYGVQFHPEVTHTKGGLQMLENFVLGVCGCERLWTSESIIEDAVARIKEQVGDDEVILGLSGGVDSSVVAMLVHRAIGDKLTCVFVDNGLLRLNEGQQVMDMFGDKFGLNIIKVDAEDRFLEALKGKSDPEEKRKTIGHVFVDVFDEESKKLKNAKWLAQGTIYPDVIESAASKTGKAHVIKSHHNVGGLPDEMEMGLVEPLRELFKDEVRKIGLELGLPYNMLYRHPFPGPGLGVRVLGEIKKEYCDLLRRADAIFIEELHAADLYDKVSQAFTVFLPVRSVGVMGDGRKYDWVVSLRAVETIDFMTAHWAHLPYDFLGKVSNRIINEVDGISRVVYDISGKPPATIEWE

SEQ ID NO: 40626 - protein, 261 aa, Ustilago maydis 521
MPESREDSVYLAKLAEQAERYEEMVENMKRVASSDQELTVEERNLLSVAYKNVIGARRASWRIVSSIEQKEESKGNETQVSMIKTYREKIEAELAQICEDILDVLDKHLIPSAASGESKVFYHKMKGDYHRYLAEFATGDKRKDSADKSLEAYKAASDVAVTELPPTHPIRLGLALNFSVFYYEILNSPDRACHLAKQAFDDAIAELDTLSEESYKDSTLIMQLLRDNLTLWTSDMQDSEKPTEAAAADAPAAEAKGEEAA

SEQ ID NO: 40627 - protein, 164 aa, Candida albicans SC5314
MSSPKVIIVSSDNEKFPVEPKIAEKSILIKNMINDLHPDGLEEDFEIPTPNVRANVLCKVLEWCEHHKNTVFQDDEDEDAKKSVPVEEWDRNFLKVDQEMLYEIILAANYLNIKPLLESGCKMVAEMIKSKSPEELRRTFNIINDFSPEEEAAIRKENEWAEDR

SEQ ID NO: 40628 - protein, 275 aa, Oryza sativa (japonica cultivar-group)
MGSFASPLDAAPAPPTAKPSPPPAPAPANGLVTQEELKRVAAHRAVEMVEPGMTLGLGTGSTAAHALDRLGDLLRSGELAAVAGVPTSLKTEAHAARVGIPMLPLGEAGGIDLSIDGADEVDPELNLVKGRGGSLLREKMIEGSGGRFVVIVDESKLVPRLGCTGAVPVEVVPFGCDHTLGLVRKVFDGLPGFSARLRTVASKDGEGKEEMFVTDNGNYIVEMFFEDGIRGDLNEISDRLLRITGVVEHGMFLGMATSVVVAKKDGTVALLHKKK

SEQ ID NO: 40629 - protein, 464 aa, Cytophaga hutchinsonii ATCC 33406
MSTKFDVIVIGSGPGGYVAAIRASQLGKKVAVVEKAELGGICLNWGCIPTKALLKSAQVYEYIKHAKEYGINVGNAEADFTAVVKRSRDVAAGMSKGVQFLMKKNKIEIIAGFGKLVKGKQVEVTDDKGNKSLYGADHIILATGGRARELPNVKIDNNKIIGYRKAMVLESKPESMVIMGSGAIGVEFAYFYATMGTKVTIVEYLPNIVPVEDEEISKQLEKEYKKMGINIMTGAAVESVDTAGKGCKVTVKKGDATEVIECDIVLSAVGVATNLEGIGLEDVGVATDKGRVLVDDYYKTNIPGVYAIGDIVKGPALAHVASHEGIICVEKIAGLNPEPMDYGNIPGCTYCTPEIASVGLTEKAAKEKGYELKVGKFPFSASGKASAAGAKEGFVKVIYDAKYGELLGVHMIGANVTEMIAEAVVARKLEATGHEIINAVHPHPTMSEAIMEATAAAYGEVIHL

SEQ ID NO: 40630 - protein, 170 aa, Helicobacter pylori
GSGMHTHVSIWKNNENLFGGETYKGLSEFALHFLGGVLRHARGLAAFTNASTNSYKRLIPGYEAPSILTYSASNRSASVRIPYGISKNSARFEFRFPDSSSNPYLAFGAILMAGIDGVKNKMDPGEAMDINLFKLTLDEIREKGIKQMPHTLRRSLEEMLADKQYLKEGQ

SEQ ID NO: 40631 - protein, 320 aa, Acinetobacter sp. ADP1
MQTVHFSFLLFHSDGKIGYFFKMTQQAPTIQGSIVAIVTPMHQDGSVDWKGLEKLVEWHIQQGTNSIVAVGTTGEASTLSMEEHTKVIQEIIRVANKRIPIIAGTGANSTHEAIELTQAAKDLGADAALLVTPYYNKPTQEGLYQHYKAIAEAVDIPQILYNVPGRTGVDLSNETAIRLADLTNIIGIKDATGDIPRGQALIEGLNGKMAVYSGDDETAWELITLGAKGNISVTANIIPKAMSELCATALQGQKEQAKVLNDQVANVHNILFCESNPIPVKWALHEMGLVDTGIRLPLTPLAEQYREPLRHQLKAAGIIQ

SEQ ID NO: 40632 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSARFEFRFPDSSSNPYLAFSAILMAGMDGVKNKIDPGEAMDINLFKLTLDEIREKGIKQMPHTLRRSLEEMLADKRYLKEGH

SEQ ID NO: 40633 - protein, 430 aa, Populus trichocarpa
MEVVGETPPASAGEVNLFGKYELGKLLGYGAFAKVYHARNVSTGQSVAIKAVSKAKVMKEGFVAHVKREISIMSRLRHAHIVRLHEVLATKGKVYFVMEYAKGGELFSKISKGRFSEDLSRRYFQQLITAVGYCHARGVFHRDLKPENLLLDENFNLKITDFGLSAVTEQVRPDGLLHTLCGTPAYVAPELLAKKGYDGAKVDIWSCGVVLFVLIAGYLPFNDTNLMAMYRKIYKGQYRCPKWTSPDLKRLLSRLLDANPETRITIDMIINDPWFKKGFKEEKKLYLDEFDFDKGFEEEEDEKSLNAFDIISFSSGYDLSRMFNESDTMILTERFVSAEKPEKVMERIEEVARKEGLEIAKRKNWGAKLEGCNGNFIMIIEVHRLTDHLVMIEVKEKKFKIGPGQETWEDKLKPQLRSLIYQPEQAVSGN

SEQ ID NO: 40634 - protein, 103 aa, Zea mays
MSGPGKGGKGLGKGGAKRHRKVLRDNIQGIPKPAIPRLARRGGVKRISGLIYEETPGVLKIFLEKVIRDAVPYTEHARRKTVPPMDVVYALKRQGRPLYGFGG

SEQ ID NO: 40635 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFSAILMAGMDGVKNKIDPGEAMDINLFKLTLDEIREKGIKQMPHTLRRSLEEMLADKQYLKEGH

SEQ ID NO: 40636 - protein, 329 aa, Mycobacterium smegmatis str. MC2 155
MVAGVDFGDPAFAADVRDGVARIEDLMSDELGKADELMAEAVQHLFQAGGKRFRPLFTVLSAQLGPEPDAWQVTVAGAVIELVHLATLYHDDVMDEAQMRRGAQSANARWGNNIAILAGDYLFATASRLVSRLGPDAVRVIADTFAQLVTGQMRETRGAADHVDSVDHYLKVVYEKTACLIAASGRFGATFSGANDEQIERLSRLGGIVGTAFQIADDIIDIDSDPDESGKTPGTDLREGVHTLPVLYALRETGPDADRLRELLAGPIERDEDVAEALALLRRSPGLTKAKETVASYAAQAREELSHLPECPGRQALAVLVDYTISREG

SEQ ID NO: 40637 - protein, 170 aa, Helicobacter pylori
GSGMHTHVSIWKNNENLFSGEAYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 40638 - protein, 449 aa, Mycobacterium smegmatis str. MC2 155
MSELHPKLQAVFEEVSHRNGGEKEFHQAVFEVLQSLGPVVEKHPEYADNAIIRRLCEPERQIIFRVPWVDDTGHVQINRGFRVEFNSALGPYKGGLRFHPSVYLGIVKFLGFEQIFKNALTGLPIGGGKGGSDFDPKGRSDAEIMRFCQSFMTELYRHIGEYTDVPAGDIGVGTREIGYLFGQYKRITNRYESGVLTGKGLTWGGSRVRTEATGYGTVFFVDEILQSRGQSFDGKRVVVSGSGNVAIYAIEKVHALGGIVVACSDSGGYVVDEKGIDLDLLKEVKEVQRARIDAYAEARGGATQFVSGGSVWNVACDIALPCATQNEVSGDDARALIESGCRIVAEGANMPCTPEAVKLFDQAGVTFAPGKAVNAGGVATSALEMQQNASRDSWTFDDTEGRLAGIMRRIHDRCLTTADEYDQPGNYVAGANIAGFTQVADAMLALGLI

SEQ ID NO: 40639 - protein, 561 aa, Oryza sativa
MEVRRRAPLPPPPGRVQAGDALPLPIRHTNLIFSALFAASLAYLMRRWREKIRSSTPLHVVGLAEMLAIFGLVASLIYLLSFFGIAFVQSIVSSSDDEEEDFLVGPARGSSAAAAVAPPPPPSSPAQCSLLGSPHDDAARERMPEEDEEIVSSVVAGKVPSYVLETKLGDCRRAAGIRREAVRRITGRQIEGLPLDGFDYASILGQCCELPVGYVQLPVGIAGPLLLDGQRFYVPMATTEGCLVASTNRGCKAIAESGGAVSVVLRDGMTRAPVARLPTARRAAELKAFLEDSVNFNTLSMVFNRSSRFARLQGVQCAMAGRNLYMRFSCCTGDAMGMNMVSKGVQNVLDYLQDDFPDMDVISISGNFCSDKKPAAVNWIEGRGKSVVCEAVIKEDVVKKVLKTNVQSLVELNVIKNLAGSAVAGALGGFNAHASNIVTAIFIATGQDPAQNVESSHCITMLEAVNDGRDLHISVTMPSIEVGTVGGGTQLASQAACLDLLGVKGANRESPGSNARLLATVVAGGVLAGELSLLSALAAGQLVKSHMKYNRSSKDMSKVIS

SEQ ID NO: 40640 - protein, 210 aa, Heuchera americana
  misc_feature (194)..(194): Xaa can be any naturally occurring amino acid
  unsure (1)..(210): unsure at all Xaa locations
SVLCDAEVALIVFSNRGKLYEFCSTSNMLKTLERYQKCSYGAVEVNRPCKELESSYREYLKLKGKFEGLQRTQRNLLGEDLGPLNTKELEQLERQLDSSLKLIRSTRTQFMLDQLSDLQNKEQVLMDSNRSLARKLDEISAKNNNLRLSWEGGEQSIPYSQQQAQPQGLFQPLDCNPTLQIGYNSIGSDPDDYXQLMHRMSTGFMPSWML

SEQ ID NO: 40641 - protein, 331 aa, Actinobacillus pleuropneumoniae serovar 1 str. 4074
MTTLLTLEQIQTLAKQDMQAVDAEILAQLNSEVVLINQLGNYIIAGGGKRIRPLIAVLAANALGYRGNKHVTCAAFIEFVHTATLLHDDVVDESDMRRGRATANATFGNAASVLVGDFIYTRSFQMMTDVDSLEVLKVMSAATNALAEGEVQQLMNVNDPNTTEANYMRVIYNKTARLFEAATQCVAIVAGVEKSVETALKDYGCYLGTAFQLIDDILDYSAKAESFGKNVGDDFVEGKPTLPLLHAMHTAQEKGNQAQVDIIRSAIENGGEREQIPAVLEIMAEHQSLEYAMTRAKQEAQKAVDALAVLPESEYKQALISLAYLSVDRSY

SEQ ID NO: 40642 - protein, 144 aa, Zea mays
MASSSIALFLALNLLFFTTISACGSCTPCGGGCPSPKPKPTPKPTPSPSSGKGKCPKDTLKLGVCANVLNGLLDLTLGKPPVEPCCSLIQGLADVEAAVCLCTALKANVLGINLNLPISLSLLLNVCSKKVPPWLPVLSNRIHM

SEQ ID NO: 40643 - protein, 464 aa, Cryptococcus neoformans var. neoformans JEC21
MSAPAQDPPPPNPPAGDSSKPQESSDVPQQTTQEIESAEQQQQQEVEQPKEDTFEDVPEHVVKSDAQEIKMQTRMIDNEIKMMRQENLRLSHEREQMVEKIADNTTKIKQNKVLPYLVSKVVEILDVDSEEQEGATHNEQNAKKSKCAVIKTSTRQTVFLPIIGLVPHNQLAPGDLIGVNKDSYLVLDKLPDEYDARVKAMEVDERPTETYTDIGGLDKQIEELVEAIVLPMQQADKFKTLGITPPKGCLMYGPPGTGKTLLARACAAQTNACYLKLAGPALVQMYLGDGAKLVRDAFELAKQKAPAIIFIDELDAIGTKRFDSDKSGDREVQRTMLELLNQLDGFSSDSRIKVIAATNRIDILDPALLRSGRLDRKIEFPLPNESAREHILQIHSRKLNHHGVNFEELARSTEDMNGAQLKAVCVEAGMLALRQNATQLTHEHFHGGILEVQARKAKEHHYFA

SEQ ID NO: 40644 - protein, 250 aa, Solanum lycopersicum
MVRIAFGSIGDSLSVGSLKAYLAEFIATLLFVFAGVGSAIAFNKLTSGAALDPAGLVAIAVAHAFALFVGVSMAANISGGHLNPAVTLGLAVGGNITILTGLFYWVAQLLGSTVACLLLKYVTNGLAVPTHGVAAGMSGAEGVVMEIVITFALVYTVYATAADPKKGSLGTIAPIAIGFIVGANILAAGPFSGGSMNPARSFGPAVVAGDFSQNWIYWVGPLIGGGLAGFIYGDVFIGCHTPLPTSEDYA

SEQ ID NO: 40645 - protein, 122 aa, Arabidopsis thaliana
  misc_feature (22)..(22): Xaa can be any naturally occurring amino acid
  misc_feature (41)..(41): Xaa can be any naturally occurring amino acid
  misc_feature (77)..(77): Xaa can be any naturally occurring amino acid
  misc_feature (101)..(101): Xaa can be any naturally occurring amino acid
  misc_feature (109)..(109): Xaa can be any naturally occurring amino acid
  misc_feature (115)..(115): Xaa can be any naturally occurring amino acid
  unsure (1)..(122): unsure at all Xaa locations
MAFLYALLRYLWLASSAKATMXVPFNGFKLHPLPFPATRKXANNDITSIKSKGGRVKCMEVWPPIGKKKCENLSYLXDLTDSELAKEVDYLIEKSGFCVEXELENGFVXREQGNXPGYYDGR

SEQ ID NO: 40646 - protein, 192 aa, Apium graveolens var. dulce
GNSIPPIMPIGRGAYGIVCSIMNTETNEMVAIKKIANAFDNYMDAKRTLREIKLLRHLDHENIIALTDVIPPPVRRNFSDVYIATELMDTDLHQIIRSNQVLSEEHCQYFLYQLLRGLKYIHSANIIHRDLKPSNLLLNSNCDLKICDFGLARPNTDDEFMTEYVVTRWYRAPELLLNSSDYTAAIDVWSVG

SEQ ID NO: 40647 - protein, 375 aa, Vibrio sp. Ex25
MTTEKINLLDFDRKGMRQFFAEELGEKAFRADQVMKWIYHFGVDDFEKMTNINKKLREKLLHKCEIKAPTVAEAQHSSDGTIKWAMNVGDQDVETVYIPEDDRATLCVSSQVGCALECKFCSTAQQGFNRNLKVSEIIGQVWRAAREIGLEKETGRRPITNVVMMGMGEPLLNMKNLIPALELMLDDLGFGLSKRRVTVSTSGVVSGLDQMTGKIDVALAISLHAPNDKLRSEIMPINDRWDIQDFLASVRRYIASSNANRGKVTVEYVLLDHVNDDMDHARELAELMKDTPCKINLIPFNPYPGSPYKKPSNSRIDRFQKTLMQYEHTVTVRKTRGDDIDAACGQLVGDVIDRTKRTAMLKASRGADTIEVKAV

SEQ ID NO: 40648 - protein, 476 aa, Wolbachia endosymbiont of Drosophila melanogaster
MIQNILRLLHIITVLTRYNILPYLLPPSKKSINKIQGHKLKCALEKLGPVFIKFGQSISSRTDVLNEDITNNLLLICDRLPSFSHKIAVKTIESEFNCKLSDIFSSFSEKPIAAASISQVHRAVTTEGKEVAVKVLRPNIEKTFSRDIKMLSWLAEIAEKFSEQSKRLRPIELVKTFAEICRLELDLRFEAAHSSELKENTKNDRGFYVPEIDWNRTSKKVLTLEWIEATPIYEVEKLNNRKQIAINLIESFCNQVYRDCFFHADMHPGNLMVDSNNNIIALDCGIMGRIDRETCYYVIEILKGFLNRDYDHVAKMHFRAGYVSSQHRNFVTACRAIGEPIIGQPIQKISFASLLAQLLKITGDFDMKVQTQLLLLQKTMILLEGTCRKIYSEINMWKVVEAWISSQHENKIGYREKIRSSYPVKTIQGIFSLIEKLNLIADKKLENIQIKNKSNGKVYFLLWFVIIILIVKLLIS

SEQ ID NO: 40649 - protein, 907 aa, Burkholderia thailandensis E264
MRRCARRSGSRPRRRAGSIRRRKHPPTSNLRPRDERRASLRRRDVHRIAARTAAARAGLRRRRVHALQPVAASAARARSATRGRRDAAARAARRLRAARSARPRAIDGRARRAARATRGCVARRARFVRRRARDAAVRRRAAVARARRARRGARRSMRAARARAARRARLARARLGRLHRVGRDRAAVRFRRGQARPRAADDRGLRGVRAMARRALARRSGRRRTRRRERELARSRRSRRTCEGRSARRHCRRCRRCGRASERRSRRRGRCGDHARRRIAARAVARPLLRAPATAHRERPLRRRNRAREKRAPEPHGRDVPSERSPVSRSRSARRDFARRGGTRADRRRPLRPIRLQRLRTRARRRRPARARRVRAELHGARQAGRARRAARARACRAARRVAGRRARLRAHRRQPAGCRLRRRNRRASGRRHRPKRPARAATHRAGRARRGRARLRERAASACGGRAGARSRAALPPLNRSPGRPSMNANPDALKLTRAHAAPPADWWARERLHYRDNSLHFCGRRVAELAAAFAEPVFLYDPQRAVDNVARLQRALGDLQRGDFHVYYAMKANRFRPLLSELRRSPIFGIDACSPEELREALACGFAPERISYTAHGMMPDEAALLAALPDVHVNCDTLSAIALLGSRSPGREIGIRVNPGVGIGYGDSERLSYAGATITKFGIYAEQFGAALELAARHGLTVTWLHCHAGCGYLDAQLDSFERVLDALDAFVARAPGLRGINLGGGLGLPHRATDRPLDLERWRAAVHARFGGRPLALAIEPGDFIAKDAGMLVLRVAYVELKRNRRFVGLNGGFNLAIEPAFYDLPCEPVPCVRRPGPTQSVCLAGNINEALDVWGDDVSLPPVEPGDFVALLNAGGYASSMSSNHCLRGQFRELALFDAAPH

SEQ ID NO: 40650 - protein, 141 aa, Vibrio sp. Ex25
MALERTFSIIKPDAVERNLIGEIYNRIEKAGLRIVAAKMVHLTEDQASGFYAEHEGKEFFPPLKEFMTSGPIMVQVLEGENAIARYRELMGKTNPEEAACGTLRADYALSMRHNSVHGSDSPESAAREIEFFFPESEVFSR

SEQ ID NO: 40651 - protein, 550 aa, Triticum aestivum
  misc_feature (148)..(148): Xaa can be any naturally occurring amino acid
  misc_feature (164)..(164): Xaa can be any naturally occurring amino acid
  misc_feature (171)..(171): Xaa can be any naturally occurring amino acid
  unsure (1)..(550): unsure at all Xaa locations
SHEYSGLSFLNKGNAFILLLLAVAVPSLLRTGEASVHEYSGLSFLYAPVSPANATAEEDDDEAAADAFIRFDKITFRRPEEANDSVKETSSSKVQIIVFEIEDREMIGGSAYGGQKAICCTSDLAKLGACVEGSVIYRPSQVNPGWPXLLFASFDGRDLIATLXTLGLFRXHYRTSLYKKAGWYRSGIPGISSTHASARTIPVKKTGMYNMYFIHCDPALAGLEIDGKTIWKNPTGYLPGRMAPLKNFFGLMSFAFVILGIYWFYQYMKFWREVLPLQNCITLVITLGMLEMALWYFEYAEFNETGVRAKAITFWAVTFGTIKRTVARLIILIVSMGYGVVRPTLGGLTSKVVMLGGTFFVATEILELVENLGTVNDLSGKARLFLVYPVAILDASFIVWIFISLAKTLSQLQARRLMAKLDIYRKFTIALAITVLVSIGWIGYEIYFKSTDVFNERWQYAWIIPAFWHALSFSLLCVISYLWAPSQSSMRFTNDASEKFDREDSLSLIRPRPIVSNNGWSVASSTDAKATKNTDSVTSFDEDDEENKRE

SEQ ID NO: 40652 - protein, 371 aa, Alkaliphilus metalliredigenes QYMF
MKDVMGIVNDIKIKRDLRDLVSHRSTAAVPFGGRYRVVDFVLSNMANGGIKNVGIFTQSNNRSLLDHVDSGKAWDLFNKRGGLFILPPTFSYERFGNRLGDIDHFYNHMDYLERSTQQYVLISNSNSIYNMDYSKIKEAYEKSGADIVILYQRKKEWDSSIKYVSMIMDEKSKIVDMSVNKLIGNNSFKDMGVAFMKKELFMEIIRECHSKGLNDFVKDGLIKNTKKYNMYGMPYDGYVANIDSINNYYKHNMNLLKPEIWKQLFFKEGLINTKVKDEAPSKYNKTAKVSNSLVANGCIIEGEVINSILFRGVKVGKNVTVKNSILMQKNVIHEGCQLEHVILDKDVVVTEGKVLKGDEGYPFVVSKKTVL

SEQ ID NO: 40653 - protein, 371 aa, Alkaliphilus metalliredigenes QYMF
MKKECIAMILAGGQGTRLGMLTKNIAKPALPFGGKYRIIDFTLSNCSNSGIDTVGVLTQYEPLVLNSYIGIGSHWDLDKKSGGVMVLPPYVKENGGNWYRGTADAVYQNLDFVEHYEPEYLLVLSGDHIYKMDYSAMLKHHKEKQADATIAVIRVPSEETYRFGIMNTDEEERIIEFQEKPENAKSDLASMGVYIFNWKKLKKHLIEEDQNPDSSLDFGKNIIPKMLNEGEKLFAYGFQGYWKDVGTVESYWEANMDLIEDDASLDLHERNWIIYSVNPSQPPQYIGPSAKVTESLLNEGCQIFGEVSHSVIFPGVYIGKGAVVKDSVIMANAIIGDHAKIEKSIIAEKAIIQKKEIIGDNKKNDITVVAT

SEQ ID NO: 40654 - protein, 395 aa, Bacteroides fragilis NCTC 9343
MDSNHLSPLRKGVVGVQFLFVAFGATVLVPLLVGLDPSTALFTAGISTLLFHLVTKGKVPIFLGSSFAFIAPIIKATELYGLAGTLSGMVGVAMVYFVMSALVKWQGIRLIERLFPPVVIGPVIILIGLSLAGTGVNMAKENWTLALLSLFTAVIVSIRAKGLLKLIPIFCGIIMGYIAALIFYDVDMSGVRNAAWLGFPQFVFPQFSWEPILFMMPVAIAPVIEHIGDVYVVNTVTGKDYVKDPGLHRTLLGDGLACLCAGLLGGPPVTTYSEVTGAMSLTKVTNPQVIRIAAITAILFSVIGKVSALLKSIPSAVLGGIMLLLFGTIACAGIANLVNNCIDLSRTRNIIIVSLTLTIGIGGAVLAWGEFSLSGIGLAALVGVGLNLVLPREER

SEQ ID NO: 40655 - protein, 170 aa, Helicobacter pylori
GSGMHTHVSIWKNNENLFGGETYKGLSEFALHFLGGVLCHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESH

SEQ ID NO: 40656 - protein, 560 aa, Bradyrhizobium japonicum USDA 110
MTHPGEQFYPEGVRWDDTIVQGTLPDLLSKAAADYGPRTALEFRERPITYTELAAMAERAAAAFLRAGCGKSASVALFLGNTPDHPVNFFGALKAGARVAHLSPLDGEIALTHKVSDSGSRLLVTSNLAALLPTALKFLEKGLIDRLVVCEDDNWGKVGTPQAAIPADPRIVTFKTFVEGAAAPAEWPQVTADDVALLQYTGGTTGLPKGAMLTHGNLTSAVSIYDVWGKPSRATRGDVVERVICVLPLFHIYALTVVLLSSLRRGNLISIHQRFDVEAVMRDIEVKRATYFPGVPTMWIAIAALPDLDKRDFSSLATIGSGGAPLPVEIANFFERKVGKKLRSGWGMTETCSPGTGHPPTGPDKPGSIGLMLPGIELDVVSLDDPTKVLPPGEVGEIRIKGPNVTRGYWNKPEGSAEAFIDGRFLTGDIGYVDTDGYFFLVDRKKDMIISGGFNVYPQMIEQAIYTLPGVHEVIVLGIPDQYRGEAAKAFIKLKPGAKPFSLDELRAQLAGKVGKHEMPVEVEFVDDLPRTPVGKLSRHELRQQQKPSQSTQPASGGRS

SEQ ID NO: 40657 - protein, 433 aa, Alkaliphilus metalliredigenes QYMF
MLFENLNIIKPIQRALTTEGYTEATPIQEKAIPSLLKGMDLLGCAQTGTGKTAAFAIPILQGLSSEQRNLKGSRQIQALILAPTRELAIQIADSFETYGKHLGLRTLVIYGGVSQHPQTKSLNRGIDILVATPGRLLDLINQKFVRLNSIKYFVLDEADMMLDMGMIHDVRRIIKYIPAVRQTMFFSATMPAEIAKLADQILKEPVKVEITPVSSTVDIIEQAVYYVNKSNKVQLLIHLLKSKAIVSALVFSRTKHGADKIVKSLEKAGLQAQAIHGNKSQNARQLALNNFKERKTRILVATDIAARGIDVEELSHVINFDLPEVPETYVHRIGRTGRAGLGGIAISFCAQEEKNLLKEIQKLISKSVPVVEDHPFPLVETLNESKEVFTRKSSAPKTTPANNRRNKEASFAKKSAAKNSKSRYYTKNKRKDN

SEQ ID NO: 40658 - protein, 516 aa, Triticum aestivum
SPSPTAMAADPSSDLANGAPAPAPAAGADKKKSRESERRRRRRKQKKSKAPASDAAASDADAAADAEEEKPDSKPPVEIEVEYVPEEPDLADGLLADFKSIFDKFTFKEPVAAEDGEKKDEAADAAKKGSGSDSDDDEQETQQKKKEGGISNKKKKLEQRMKIAELKQICNRPDVVEVWDATASDPKLLVYLKSYMNTVPVPRHWSQKRKFLQGKRGIEKQPFQLPDFIAATGIEKIRQAYIEKEDSKKLKQKQRERMQPKMGKMDIDYQVLHDAFFKYQTKPKLTSHGDLYYEGKEFEVKLREMKPGMLSRELKEALGMPEGAPPPWLINMQRYGPPPSYPSLKIPGLNAPIPPGATFGYRPGEWGKPPVDEHGRPLYGDVFGILQLDEPNYDEEPVDRSKHWGDLEEEEEEEEDDQGKKEEEEFSTGPLSILMLSVKNNTQVLINCRNNKKLLGRVRAFDRHCNMVLENVREMWTEVPKTGKGKKKALPVNKDRFISKMFLRGDSVIIVLRNPK

SEQ ID NO: 40659 - protein, 274 aa, Triticum aestivum
RRPKASQGGGRPRATGRRRRWRISSYWGIEQSKKLVREDGTEWKWSCFRPWETYTADTSIDPTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMQLKATPAPIGYH

SEQ ID NO: 40660 - protein, 311 aa, Deinococcus radiodurans R1
MKFYVIGDVTVDHLYHLDRLPAPGKEVTPKRSTMQPGGSGGTISVTLARLGHTVTLAARVGDDPFAEFALAEIKASGVSLSAIQKDPEHLTSTITVMQTSGGQRAMISDGAANRQLDPAKLKKKDVESADALIISAYSLTEGPQREYAQKAIEIARGAKKPVPVFIDLGTGAVEKVGTGLVAEVRGADYLTLNQHELLALTGTRSLSAGLARLAEAGVERVAVKVGKMGSVVWTPEDTELVDAVLPEGTVVDTTGAGDTFTAAFAHAVLSGLPLTQAARVANAAGALAATAVGAQSKPILVGDLERVAQSK

SEQ ID NO: 40661 - protein, 458 aa, Deinococcus radiodurans R1
MEEAGRAVAAAAQECCPAGRVLLLAGGGANGGDALVAARHLFALGRDVAVLALPAKHPLTRSNRRRLARIGVEVAPLTPASLRRELKTAALVVDGLLGTGFTPPLRAPLAELVAQVNASGVPTLAIDLPTGLDALTSEVSGDPLRAAWTVTLSGLKPALLFGPAAYLAGEVTLADLRSPPDWALEEALASRPTDAEIAALLPVRHADAHKGTAGRVWVVGGHPGTVGAAALAGVAALRAGSGLVTIHSATDVPLVMPELMMRCHADLSAALMEMPEEQRPDALCVGMGLGPDAASIARQLLGWRLPTVLDADALQPELAGAGHDACIWTPHPGEAARLLGTSTPDIARDPIAAARALQEKFGGVVVVKGGPSVIAHTGGVWVSRGGHPGMASAGMGDTLSGLLASLLGQGLSAPDAALAGVTLHARAGELAGAKHGYGLTATDVSAELGRAWLGLVGG

SEQ ID NO: 40662 - protein, 406 aa, Zea mays
  misc_feature (194)..(194): Xaa can be any naturally occurring amino acid
  unsure (1)..(406): unsure at all Xaa locations
SAASAQSTSPRCSLPRMPLIFFSAAAPLVAVSLLPLPTHCCLRLTATRAAATSTTATPGPAPASTFAVEDYLIASCHLTPPQALKASKSLAHLKSASNADAVLAFLADLGLSPKEVAAVVASNPRVLCARIDRSLAPISTELRALGLSPSQIARLAQIAGRYFLCRSFVSKVRFWLPLCGSLEWHLQASNWNLXLLSSDLEKVVEPNVAFLRKCGLSAVDIAKLLVAAPRLVTMPPEYVQDAVRRATQLGVAPGSQMFRHALSTAGCIGQEKVDSKVAVLKETLGWSQEEVSLAISKAPRILVASEERLRRNAEFLLNEVGLPPQYIARRSVLLMYSLERRIVPRHLVLVVLKEKGLVEQDRCFFNVVAPTEEKFLEKFVAPYEESIPGLADAYESACMGKVTRGL

SEQ ID NO: 40663 - protein, 343 aa, Haemophilus influenzae Rd KW20
MKDLDWNNLGFSYIKTDYRFIAHWKDGKWDEGKLTTDSTLHIHEGSTALHYGQQCFEGLKAYRCKDGSINLFRPQANAERMQRTADRLLMPRVPTELFVRACKEVVKANQDWLGPYGSGATLYLRPFLIGVGENIGVKTAPEFIFSVFCCPVGAYFKGGLAPSNFITTDYDRAAPMGTGGVKVGGNYAASLLPHELAAEQGTPERKFADAIYLDPKTHTKIEEVGAANFFGITKDNKFITPKSESILPSITKYSLLHIAKERLGMEAIEGDVYIDQLDQFVEAGACGTAAVITPVGGIQHNGKFHVFDSETEVGPVTRRLYDELTGIQFGDIEAPEGWIVKVE

SEQ ID NO: 40664 - protein, 201 aa, Shewanella sp. MR-7
MKLLKPLFDNNRRWAGRISQEHPDFFEQLAKQQNPEYLWIGCSDSRVPSNQIIDLMPGEVFVHRNIANMVIHTDLNCLSVLQYAIDVLKVKHIMVVGHYGCGGVRAAMGNQRLGLIDNWLGHLRDVYRLHQDELMQMDEAKRFDRLCELNVIEQVSNVTSSTIVQEAWARGQELAIHGWIYGIDNGLLTDLDVTVDRAQKI

SEQ ID NO: 40665 - protein, 495 aa, Arabidopsis thaliana
MDIISGQALLLLFCFILSCFLIFTTTRSGRISRGATALPPGPPRLPIIGNIHLVGKHPHRSFAELSKTYGPVMSLKLGSLNTVVIASPEAAREVLRTHDQILSARSPTNAVRSINHQDASLVWLPSSSARWRLLRRLSVTQLLSPQRIEATKALRMNKVKELVSFISESSDREESVDISRVAFITTLNIISNILFSVDLGSYNAKASINGVQDTVISVMDAAGTPDAANYFPFLRFLDLQGNVKTFKVCTERLVRVFRGFIDAKIAEKSSQNNPKDVSKNDFVDNLLDYKGDESELSISDIEHLLLDMFTAGTDTSSSTLEWPMTELLKNPKTMAKAQAEIDCVIGQNGIVEESDISKLPYLQAVVKETFRLHTPVPLLIPRKAESDAEILGFMVLKDTQVLVNVWAIGRDPSVWDNPSQFEPERFLGKDMDVRGRDYELTPFGAGRRICPGMPLAMKTVSLMLASLLYSFDWKLPKGVLSEGFGHGRDLWSNFA

SEQ ID NO: 40666 - protein, 431 aa, Mycobacterium smegmatis str. MC2 155
MTLLNWKYVESRADDDFVVAPGERLDWGRTIGIGAQHVVAMFGATFLVPVLTGFPPSTTLLFSGIGTVLFLLITGNRLPSYLGSSFAVIAPVTAAVAADGAGSALGGLIAVGVLLIIVGAVVHLVGTHWIDVVLPPVVTGAIVALIGFNLAPAAKNNFEQGPLVGLVTLVLLVGVLAFFRGIIGRLAIFGAVVIGYLLALVLGEVDTSAIAAAPWVGLPQFQTPTFSLGLLPLFLPAVIALIAENIGHVKSVGQMTKTDMDPLIGRALAADGVATVLAGAGGGSATTTYAENIGVMAATRVYSTAAYWVAAVVAIVLSLCPKVGAVISAIPAGVLGGATIVLYGLVGILGVRIWLTNHVDFSKPVNQMTAAIPLIIGIADFTWQAGELTFTGIALGSIAALAVFHGMRLLETLGGLGRRPAADQAPTPPTH

SEQ ID NO: 40667 - protein, 326 aa, Arabidopsis thaliana
  misc_feature (263)..(263): Xaa can be any naturally occurring amino acid
  unsure (1)..(326): unsure at all Xaa locations
MASNGDKGLIVSFGEMLIDFVPTESGVSLAEAPGFLKAPGGAPANVAIAVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGXAGDSFVGALLNQIVDDRSVLEDEERLRKVLRFANACGAITTTKKGAIPALPSDAEVRSFLEKK

SEQ ID NO: 40668 - protein, 578 aa, Psychrobacter arcticus 273-4
MEIKAPDLGVDSAEVSEIMVAVGDVIAKDDNIILLESDKASVEVPSSAAGKVTKISVAVGDQVSEGMVLIELESETENQDDSQSTEAAVADTQDKSRDTEQEETQKEEQSDKVTAESNTAQPAQQAATATTHALPDLGVDEAQVSEIMVSVGDMVTADQSILLIESDKASVEVPAPQAGKVEKILVQTGDMVANGQDFIVIIGQSSDNTNITSEAKAEDAQSQDPKPAATDEKADASQKADKQVTTAPKQAANATTSASNKLTEAQVNEKMVDVYAGPAVRKLARQLGVDISEVAGSALNARILKEDLFAHVKQSLTTQQASPATATGASRASLPSLPDMSNVEIWGETETQDLTRLQKVSIPQLNYNTYLPQVTQFDLSDITETEQLRSELKGGMKAEGIGLTILAFIVKATAYALTQHPRFNSHLSDDNTQVILRKSVNMGIAVATDDGLIVPVIKNAHEKGIKQIAIEIGELAIKARDKKLSTKDLQGASFTISSQGILGGTAFTPLVNWPQVGILGASEATMQPKWNAAKQAFEPRLMLPLSLSYDHRVINGADAAVFTRYVATLLADPRRILL

SEQ ID NO: 40669 - protein, 937 aa, Psychrobacter arcticus 273-4
MNYYKDADSSETQEWLQAFESVIKHADKDRAQFLLKALYNMGVQEGLPFNRLDTAYINTIAVEDEPMYPGDLTIERKIRALIRYNALAMVMRANKNDDDLGGHLATFASSATLYETGFNHFFRAASDHFGGDMIYYQGHSAPGIYARSYLEGRLTEEQLDNFRREVGGKGLSSYPHPYLMPDYWQFPTVSMGLGPIMSIYHAHVHRYMENRGLLEKEGRKIWTFLGDGETDEPESLGAISLAGREKLDNLIWVVNCNLQRLDGPVRGNGKIIQELESVFRGAGWRVIKVVWGGQWDTLLDKDVSGALKYRMEEVVDGEYQLYEARTAEFTREHFFNKYPELKEMADALTDEDISRLNRGGHDPMKVYAAFSEAMKTKGQPTVVLVKTVKGYGLSTQTQAVNKSHQVKKLDQEALMYFRDRFDLPFTDEQLETLPFYRPEEGSAEMKYLKGRREALGGHLPNRRSGHIPLNIPDLSIFDRVLKGSNGKEQSTTMVFVRLLSAMLKNKDIQDRVVPIVPDEARTFGLEGMFRQLGIYSAVGQKYTPEDSEALMGYKEAIDGHMLEEGINEAGAMSAWIALATSYSVNALPMIPMYIYYSMFGFQRIGDLAWAAGDCQAQGFLLGATAGRTTLNGEGLQHQDGHSQILFNVVPNCVTYDPCFGYELAVVMHDGLRRMYGEGERVYYYLTLMNENYEQPEMPEGVEEGIKRGMYLLEDNSSAQVQLLGSGVILREVQKASQILKDDFNITSNVWSVTSFNELTRDGMACDDYNRLHPMEEEIVPWVTEQLAPHEGIVVAATDYMRNYSEQIRAWLPDNRPYTTLGTDGYGRSDTRENLRSFFHVDAAHIVVATLKRLADEGEVEMRLVKDAISSFGIEADQPPAWQQQSYYDQFPDAPAPDNVNPSPVPEFISEEDEEISSEGRAEDKADATLLNNDDVTE

SEQ ID NO: 40670 - protein, 522 aa, Arabidopsis thaliana
MVVSADCRISLSAPSCIRSSSTGLTRHIKLGSFCNGELMGKKLNLSQLPNIRLRSSTNFSQKRILMSLNSVAGESKVQELETEKRDPRTVASIILGGGAGTRLFPLTKRRAKPAVPIGGAYRLIDVPMSNCINSGINKVYILTQYNSASLNRHLARAYNSNGLGFGDGYVEVLAATQTPGESGKRWFQGTADAVRRFHWLFEDARSKDIEDVLILSGDHLYRMDYMDFIQDHRQSGADISISCIPIDDRRASDFGLMKIDDKGRVISFSEKPKGDDLKAMAVDTTILGLSKEEAEKKPYIASMGVYVFKKEILLNLLRWRFPTANDFGSEIIPFSAKEFYVNAYLFNDYWEDIGTIRSFFEANLALTEHPGAFSFYDAAKPIYTSRRNLPPSKIDNSKLIDSIISHGSFLTNCLIEHSIVGIRSRVGSNVQLKDTVMLGADYYETEAEVAALLAEGNVPIGIGENTKIQECIIDKNARVGKNVIIANSEGIQEADRSSDGFYIRSGITVILKNSVIKDGVVI

SEQ ID NO: 40671 - protein, 477 aa, Streptococcus thermophilus LMG 18311
MAKQYKNYVNGEWKTSENSITIYAPANGEELGSVPAMSQAEVDEVYAAAKAALPAWRALSYAERAAYLHKAADILERDAEKIGQVLSKEISKGLKSAIGEVVRTAEIIHYAAEEGLRLEGEVLEGGAFDAGSKKKIAVVRREPVGLVLAISPFNYPVNLAGSKIAPALIAGDVVAFKPPTQGSISGLLLVEAFVEAGIPAGVLNSITGRGSVIGDYIVEHKAVDFINFTGSTPVGENIGRLAAMRPVMLELGGKDAAIVLEDADLDLTAKNIVAGAFDYSGQRCTAIKRVLVMDSVADELVEKVTALVGNITVGMPEESASVTPLIDTKAADFVQGLIDDAVEQGATAKTELKREGNLIYPAVFDHVTTDMRLAWEEPFGPVLPFIRVSSVEEAIKISNESEFGLQGAVFTQDYPRAFAIAEQLEVGTVHINNKTQRGTDNFPFLGVKGSGAGTQGVKYSIEAMTRVKSTVFDISDY

SEQ ID NO: 40672 - protein, 577 aa, Streptococcus thermophilus LMG 18311
MTKMLKGIAASDGVAVAKAYLLVQPDLSFETVTVEDISAEEARLDAALAASQDELSVIREKAVESLGEEAAAVFDAHLMVLADPEMTGQIKETIRAKQVNAEAALTEVTNMFIAIFEGMDDNPYMQERAADIRDVTKRVLANLLGKKLPNPATIDEESIIVAHDLTPSDTAQLNKKFVKAFVTDIGGRTSHSAIMARTLEIAAVLGINNITELVKDGDILAVSGITGEVVINPTEEQIAEFKAAGEAYAKQKAEWAQLKDAPTVTADGKHFELAANIGTPKDVEGVNDNGAEAVGLYRTEFLYMDSQDFPTEEDQYEAYKAVLEGMNGKPVVVRTMDIGGDKGLPYFDLPKEMNPFLGYRALRISISETGNQMFRTQLRALLRASVHGKLRIMFPMVALLTEFRTAKGILEEEKAKLVAEGVAVADDIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSILRTRSLMKKLDTAKMEEYANRALTECSTMEEVLELSKKYVNVD

SEQ ID NO: 40673 - protein, 292 aa, Yarrowia lipolytica CLIB122
MTELTHPSIVDGWFREISDTMWPGQAMALRVNQILHVEKSKYQDVLVFESTDYGNVLVLDGAIQATERDEYAYQEMIAHLALNSHPNPKKVLVIGGGDGGVLREIVKHDCVEEAVLCDIDEAVPRVSKQYLPTMSVGFNHPKTKVHIGDGFKFLQEYQNTFDVIITDSSDPEGPAASLFQKPYFELLSGALTEKGVITTQGESIWLHMKIIKELRQACKQVFPSADYAYCTIPTYPSGQIGFMVCSKDKDANLRKPLRSVSPEEESKLYRYYNKDIHSASFVLPTWARDDLA

SEQ ID NO: 40674 - protein, 361 aa, Oryza sativa (japonica cultivar-group)
MEPFKGNFSNLLNQGSSSQATNSEAQNSLSTQFPTSYPQNFRPSFLQNFHPFGPPSNYQPYRHPPIFQGAQQQEYYGQPTPGSLEGFQLQENLVHSFNQAFGFAANRSQFVDPIKGNDKKSEQYWKAVAREFNSNMPSNGNKRNPKQCRTHWDNVKRDVTKFCGFYSKARTTFTSGYSDDMIMEKACEWYKKHNNQKPFTLEYMWKDLKDQPKWRRVLEESSHNKRNKISESGAYTSSSNQDTEEETERKEKRPEGQKAAKQRQKGKGAPSPLGDKPSQNMVLFHEAITTKAAALLKAAEATLIGAEAKKEKAIAKKEKARAEKYQMYLKLMEKDTSTFSEAKLKRHENVLDQLARELAEE

SEQ ID NO: 40675 - protein, 206 aa, Michelia figo
  misc_feature (107)..(107): Xaa can be any naturally occurring amino acid
  misc_feature (204)..(204): Xaa can be any naturally occurring amino acid
  unsure (1)..(206): unsure at all Xaa locations
VQLKRMENKINRQVTFSKRRNGLLKKAYELSVLCDAEVALIIFSSRGKLYEFGSAGTNKTLERYQRCCYTPQDVVVSDRETQGWYQEVSKLKAKYESLQRSQRHLLXEDLGPLSVKELQHLERQLEVALSQARQRKTQIMIEQMEELRKKERQLGDINKQLKIKLEAEGQGPFRCIQGSWESGAMVGNNTFSMNAPQAAPLDAXSP

SEQ ID NO: 40676 - protein, 299 aa, Deinococcus radiodurans R1
MPRHFGAVPGVVPGMAFVNRQELRDAGVHLPTQAGISGSASEGADSIVLSGGYEDDRDEGDVILYTGEGGRDPLTGHQVKPQQLVRGNLALAISHRDGLPLRVTRGHRHSSQFSPQSGYQYAGLYRVDDHWREVGRSGFLIWRFRLTRLENQDAHHAGADPQHPDSQHPERRPTLVQRIVRDTATARAVKALYDHRCQVCGERLETPAGAYAEAAHIRPLGAPHHGPDVAGNILCLCPNHHVLFDFGAFSVGDDLRLLGLPGRLHVHPQHAVDREHLAYHRRHYALQAGLEWGCSVPLT

SEQ ID NO: 40677 - protein, 239 aa, Phytolacca americana
  misc_feature (235)..(236): Xaa can be any naturally occurring amino acid
  unsure (1)..(239): unsure at all Xaa locations
VQLRRMENKINRQVTFSKRRSGLVKKAHEISVLCDAELALIIFSPRGKLFEYSTDSSMEKILERYERYFYAERQLASNDPNTEVNWTFDFAKLKAKLELLQRNHRHYLGQDLDSLNIKDLQSLEQQLDNALKHIRTRKNQLMHESISELHKKEKAMQEQNNMLVKKIKEREKAMAEAQGMQWQRQQNEPPEASNFLLPPPLTSWNTAGDAYHGQIAGEVKRNDLDLTLEPVYSCXXGCF

SEQ ID NO: 40678 - protein, 282 aa, Deinococcus radiodurans R1
MLYTARMQEQPWSIPGTPVTGYVWAAESPRAAVLLTHGLGEYARRYVDHFGALIPHLVQAGYTVYAYDQRGHGNSPGERGLVDTAPLLEDHFRAREALRSQPLPVYTFGHSLGGLITAASAARDPRGLSGVILSSPALLIGEGQPQLTKALAPLLARVAPRLPVSELGTDALSRRSDEVRAYQDDENIYHGKVTAQTAWTMLRLSGELWPDYVRWQLPTLVVHGDQDQLADVKGSQRFIETIPAADKTLRVFEGGYHELLNDEPSDEVRQIILDWLAAHTAG

SEQ ID NO: 40679 - protein, 437 aa, Solibacter usitatus Ellin6076
MPDNNAPDRELGFATKSLHAGHTPDASSRARAVPIYQSTSFTFENSQHAADLFALQKFGNIYSRIMNPTTDVFEQRVAALEGGMAGLATASGQAAQFLAITSLLGPGDELVAASTLYGGTYTQMDVSFRRLGIDVKFVEPDDPENFRKAITSKTRAIYGETIANPRMNVLDIEAVSKIAHEAGVPLVIDNTMASPYLCRPIEHGADIVVHSATKFLGGHGTSIGGIIVDSGKFPWSDKFPAITQPSPGYHGMKFSEVFGPLAYIIKVRVEGLRDFGPCISPFNSFLFIQGIETLKFRMEAHCSNALAVAEWLGKQPAVTWVKYPGLKSSPYYALSQKYLPKGQGSIVTFGIKGGLEAGKKLIDNAKIFSHLANLGDAKSLIIHPASTTHQQLSDEQQLEAGVTKDLVRLSVGIEDVEDLIWDLGQAIEASQASAASA

SEQ ID NO: 40680 - protein, 416 aa, Desulfitobacterium hafniense Y51
MAVKNLPFNQEQLQKIMEDYGTPFHIYDEEAIRKNAQRLQAAFAWAPGFKEYFAVKALPNPYILKILGEEGFGADCSSLAELILAEKAGITEENIMLTSNNTPAEEFQKAKDLWAIINLDDITHIDYLEKHTGLPEVLSFRYNPGSLRAGNAIIGNPEESKYGLTKEQLFQAYEIVRDKGVKRFGLHTMIISNELNPDFFIETAEMMFDLAIELKEKLGIRLEFVNFGGGIGIPYRPEQEPVNLETIGEGVRKVYEEKIVAKGLDPLRICLECGRMITGPYGYLVTKVLHRKDTYKNYIGVDASMSDLMRPGIYGAYHHITVMGKEDLPEDHIYDVTGSLCENNDKFAVDRELPRIEIGDTLVIHDTGAHGHAMGFNYNGKLRHAELLLQADGSVKLIRRAETLEDYFATLDFSEL

SEQ ID NO: 40681 - protein, 794 aa, Psychrobacter arcticus 273-4
MAAQSTALVINLDQLGKDDIEMVGGKNASLGEMISHLSDLGVSVPGGFATTSNAFNQFLTETGLLDKINSELKTLDVNDVNKLAETGKKIRTWIIEQELPKDLEQAVRESFEEMSDGKEIAVAVRSSATAEDLPDASFAGQQETFLNIRGIDNVLIAIKEVFASLYNDRAISYRVHKGFEHEGVALSAAVQRMVRSETGAAGVMFTLDTESGFDQVVFITSSYGLGEMVVQGAVNPDEFYVSKQLLANGKPAIIRRNLGSKHKKMIYGDEGSTTKSVKVIDVEKQDRMQFSLSTEELTSLAKQAMTIEKHYGQAMDIEWAKDGDTNEIFIVQARPETVKSRQDSNVMERYIIDTTNAKVLCEGRSIGQRIGSGKVRIVSNLNEMDKVQEGDVLVSDMTDPDWEPVMKRASAIITNRGGRTCHAAIIARELGVPAIVGCGNATELLVDGQDVTASCAEGDTGFIYESQIDFEIQTNSVESMPELAFKVMMNVGNPDRAFSFTQMPNEGIGLARLEFIINRMIGVHPKALLNMNSLPREIAQAINERIAGYASPVDFYVDKLVEGISTLAVAFMDQPVIVRMSDFKSNEYANLLGGKLYEPSEENPMLGFRGASRYVSDNFRDCFELECKALKRVRDEMGLTNVEIMIPFVRTVGEAKQVIELLEKNGLKRGENGLRIIMMCELPTNCLLAEEFLEHFDGFSIGSNDLTQLTLGLDRDSGIVSHLFDERDPAVKKLLSMAIDACRKQNKYVGICGQGPSDHPDLAYWLMEQGISSVSLNPDSVLDTWFFLAGEEAK

SEQ ID NO: 40682 - protein, 374 aa, Streptococcus thermophilus LMG 18311
MTTVEIDGLKDMIACNTRISSIIDDHLSYAGYDISEFMNNKASFEEVIYLLWNGHLPTQMELKYFEAELRKNYDISDAVEQCILIQSRPHLHPMSVLRSTVSLLGVYNVDAEERSMEAVYQQSIELMAKLPTIITTFARLRTGKMPLKPRKDLGFAANFLYMLNGVEPSEIEIEAMNKTLILHADHELNASTFAARVCASTLTDIYSCVTTAIGALKGPLHGGANERVFDMLKEVRESGDVNAYLQEKLDSKEKIMGFGHRVYKKKDPREIFLRDMAKKLTEGTENEEFFNKSQEIEEFMRDKKGLIPNVDFYSATVYHTLGIDSDIFTLIFAMSRVAGWIAHIHEQQKNNKLIRPRSQYIGQENMTYIALEKR

SEQ ID NO: 40683 - protein, 518 aa, Zea mays
MDAVATSDAVLLLAAVAISLLITATFWSRHRRQGEAPSPPSLPLLGHLHLLGNGKPLHHSLAALAIARGTGGAPAPLLSLRLGARRALLVSEHAAAEECFTAHDAALGGRPRLLVGDRLNYGYTTVGWSSHGDHWRALRRFMAVELFAASRLAARAADRRAEVAALVGALVRDAPRAGAAVALRPRLFELVLNVMLRALTGAPGHGGGDVRGLQEIIEETFAVTGVMSVGDFYPALRWVDRLRGVDAALLRLQARRDAFVAGLVHDGRRSHNRKAGGGGGPTDTEKRSTIDELLSLQETDPGYYTDTVIKGIVSILLSAGTDTTALTMEWAMAQLLMHRDAMQKARAEIDANVGTSRLVDESDTTHLPYLQCVVKETLRLCPVGPVIPAHEAMEDCAVGGFRVRRGTMVLVNAWLIHRDPRLWEAPEEFRPERFLDATATVAAPLLPFGLGRRRCPGEGMALRLLSLTLAALLQCFDWEVGGCVDMAEGVGLSMPMAKPLAAVCRPREFVQTVLSAST

SEQ ID NO: 40684 - protein, 417 aa, Alkaliphilus metalliredigenes QYMF
MFIFLPFPCILITNTKDSKYKDKDDVYMNLQEESLKLHEEKVGKIEVTSKVSVKNRHDLSVAYTPGVAEPCKRINEHKDNVYKYTSKGNLVAVVTDGTAVLGLGDIGPEAAMPVMEGKAILFKEFANVDAFPICLDTKDVEEIVRTVKLMAPTFGGINLEDIAAPRCFEIEKRLKEELDIPVFHDDQHGTAIVVVAGLINALKVANKKMEDATIVVNGAGSAGVAITNMLLNMNPKDILLCDRAGILYPGAPENNSSKEEMAKITNKSVRKGDLKTAMTNADVFIGVSAGNVVTEEMVKSMNKDAIIFAMANPIPEIMPDVATKAGAKVVGSGRSDFPNQVNNVLAFPGIFRGALDVRATDINEEMKLAAAYGIASIIEEKDLTAEYVIPDAFDQRVVEKVAAAVAKAAIESGVAKK

SEQ ID NO: 40685 - protein, 349 aa, Burkholderia thailandensis E264
MKALVYHGPGRKSLDERPMPELAAPTDVIVRVTRTTICGTDLHILKGDVPSCEPGRIIGHEGVGVVHRAGAAVSTLKEGDRVLISCISSCGQCEYCRRGMYSHCTTGGWILGNRIDGTQAEYVRIPHAQTSLYRIAPGADEEALVMLSDILPTGFECGVLNGRVQPGGTVAIVGAGPIGLAALLTAQFYSPAQIVMIDPDPNRLAVAQRFGATACIDNGQVDAVAEVKALTGGGVDCAIEAVGIPASFELCQQIIAPGGVIANVGVHGVKADLHLETLWDRNITITTRLVDTSSTPMLLKTVGAGRLDPRRLITHRFPLADIEQAYETFGHAANTRALKVIVEVSDISE

SEQ ID NO: 40686 - protein, 167 aa, Oryza sativa (japonica cultivar-group)
MAATHPLLLLLLAAAAVVVLVVAATPAAASGNGTSTPTAYEMLERYDFPRGILPVGVEGYELREDGSFEVYFPRDCEFMLARTWLVRYGARIAGAAASGRLTSLQGVYVKVLFVWLPVGEVDRSGDTLSFYIGPVSTSFPLSDFAHSPHCRGYDHLPAAAAAAAAAL

SEQ ID NO: 40687 - protein, 238 aa, Pachysandra terminalis
VQLRRMENKINRQVTFAKRRNGLLKKAYELSVLCDAEVALIIFSARGKLYEFCSSSSMQNTLERYQKCSYGPLEPSQPAKETQSSYLEYMRLKARVEGLQRSQRNLFGENLGPLSTKELEQLEHQLEMSLNQIRSTKTQFMLDQLSDLQRKEQMLQEANRSLKRKLEESNAENSLGPSWESGGHGVPFGHQPAQSEGFFQPLECNSTLQIGYNHVGADQMSITVPPQNVNGFVPGWMV

SEQ ID NO: 40688 - protein, 238 aa, Peperomia caperata
  misc_feature (207)..(207): Xaa can be any naturally occurring amino acid
  misc_feature (238)..(238): Xaa can be any naturally occurring amino acid
  unsure (1)..(238): unsure at all Xaa locations
VQLKRMENKINRQVTFSKRRTGLLKKAHEISVLCDAEVALIVFSTKGKLYEYATNSSSMPGILDRYERHSFTDKEFFIKEGEPPEGAWTLEYAKLKARYELLQKNYRHYLGEDLGSLSGKELQQLEGQLDASLKNVRSRRTQALFHTISDLQKKEKSLLEQNSVMIKKLQDLEKAEKAQQSQLEMQNHERTQNQPPLILLPPPALSXGSFRQENGPSVEGEAAPRVAQKNSLLPPWMX

SEQ ID NO: 40689 - protein, 282 aa, Triticum aestivum
  misc_feature (135)..(135): Xaa can be any naturally occurring amino acid
  misc_feature (148)..(148): Xaa can be any naturally occurring amino acid
  misc_feature (157)..(157): Xaa can be any naturally occurring amino acid
  unsure (1)..(282): unsure at all Xaa locations
HASAFFPAPGSSAHGSTGRANPRATRPHRFLLLPGLLLLLSVSSASANGDVVTAGSGKVSMALYYESLCPFSTHFVVNSLARLFKDGLLDAADLTVVPYGNAKVDAHGAITCQHGPDECLLNNVEACAIDAWAGXNVHFGFINCVEDXVAMGRKRDXEWTTARSRVLDPKPVMECYNSDQGHKLSLKYGKQTDALVPPHKYVPWVVVDGQPLYEDYENFEAYVCKAYKGHPPKICQGLGRDYPIVQQVVEAGNGVTYNSGDFELDEGVDDKIKIKMVQGDDN

SEQ ID NO: 40690 - protein, 503 aa, Burkholderia sp. 383
MLNESLATTDHAPLRRYEHLYIDGAWVKPIDGELAESIDPATGQPWAIAPMGGPQDIDRAVEAARTAFHGTWRSTPGHVRAALLRRLADLFSAAIPELAIIESRDNGNLVREHRASLTAQVQWYQWFASLADKAQGATIPIDDSVHAFTTRVPIGVVGAIIPWNAPLLATCLKVGAALAAGCTVVVKPAEQTPVSALELARLVHEAGFPPGVFNVVPGYGRTAGAHLVKHPDVNKISFTGASQTAKHMVRDGADNLKRFTFELGGKAPHILFADADLDNAINAATASAWRLTGQSCALGSRVLVERPIYDRVVEAFRTRAKAVRVGLPSIDSNHMGPQSHETQLAKTLSYVDAGKQDGAELVTGGRRITTPELAAGYFVEPTVFAGVTNQMRIAREEIFGPIASLIPFDGEDEAIAIANDTPYGLTAGLWTRDVGRAHRVSNRIDAGMVWVNTYSFLRWSTPYGGFKASGWGRENGIDALDPYLETRTTVISTTGQFPNLYED

SEQ ID NO: 40691 - protein, 516 aa, Triticum aestivum
MSIMFSQELPIYTALVLLVLPLYYLYSKASCRSKNPAVLPTNWPILHMFPSFVANLHKMNDYFTLVLAGSGHNFRAHGPPGTGMRFFVTCDPANIRHIFTTNYTNFPKGAEFAAIFDIMSGGIFTIDGEPARRQRTKIKSVLSSPRLVARIEAWCRDKVENNLLLLFTHMASTGTSFNMQELMSRLMFDLAAMPLFGVDPGLLSLDMPPMEAAVAMDTVMEVAYFRVVVPASCWKLMRWLNIGPERKLKAAHKVLRVFVMEMTERRMINASSVGNGKQHEGVDIMSSFLDDPYYTEDDMFNALTISYMIAARDTVGTALTWIFYNLSQNPNIVSIIRNELSPIASHKVAAHPDAMVIFEPDETKSLVYLRAVLYETLRLYPPAPLERKMVAANDIMPSGHEVHAGDTILISLHSMGRMEGIWGKDCLNYNPNRWLSEDGNELRYVPSHKFLAFSSGPRMCLGKDIAVMQMKTVIASTLWNFDVEVMEGQCIEPKSSCILEMKKGLIVKLKKREMLH

SEQ ID NO: 40692 - protein, 212 aa, Brucella suis 1330
MKKIPRIGVGGPVGSGKMAIIEAVVPILIKLGYRILVITNDIVTTEDAKHVQRTLKGVLIEDRIVGVETGGCPHTAVREDPSMNLAAVEEMEAKFPDTDLVLLESGGDNLTLTFSPALIDFFIYVIDVAAGDKIPCKNGPGISQSDILVINKTDLAPYVGASLQVMDDDSRMMRGKKPFVFTNCKTNEGIDDLVHLIRENVLFDTEVSKESA

SEQ ID NO: 40693 - protein, 213 aa, Cryptococcus neoformans var. neoformans JEC21
MSNPQTPSSADFSSASTPLKKFKLVFLGEQSVGKTSLITRFMYDTFDNTYQATIGIDFLSKTMYLEDRTVRLQLWDTALFERFRSLIPSYIRDSSVAVIVYDITNRTSFQNTSKWVDDVRNERGQDVIIVLVGNKTDLNDKRQVTPEDLDKRAKELGVMSIETSAKAGHNVKTLFKKIAMALPGGSEAKDNGTTKIDVSSSPQEVPQASGCSC

SEQ ID NO: 40694 - protein, 343 aa, Thanatephorus cucumeris
MTVKIGINGFGRIGRIVLRNAIEHGEVDVVAVNDPFIDLDYMVYMFKYDSTHGRFKGEVKVDKEKKQLVINGKNIDVHSERNPGDINWDASGAEYVVESTGVFTTIEKASEHFKKSPSLKKVVISAPSADAPMHVVGVNLDAYDPKGPKISNASCTTNCLAPLAKIIHDEFGIVEGLMTTVHATTATQKTVDGPSAKDWRGGRGAAANIIPSSTGAAKAVGKVIPSLNGKLTGLAFRVPTADVSVVDLVVRLEKSATYDEIKATIKKASEGEYKGIMGYTEDDVVSTDFVGDEHSSIFDAKAGISLNKNFVKLVSWYDNEWGYSRRVVDLIAYVAKKDKEAGC

SEQ ID NO: 40695 - protein, 344 aa, Thanatephorus cucumeris
MTVKIGINGFGRIGRIVLRNAIEHGDVDVVAVNDPFIDLEYMVYMFKYDSTHGRFKGEVKADKDNKQLVINGKNIAVHSERNPGDINWDASGAEYVVESTGVFTTIEKASEHFKKSPSLKKVIISAPSADAPMHVVGVNLDAYDPKGPKVISNASCTTNCLAPLAKVIHDKFGIVEGLMTTVHATTATQKTVDGPSAKDWRGGRGASANIIPSSTGAAKAVGKVIPSLNGKLTGLAFRVPTSNVSFVDLVARLEKPATYDEIKAAIKEASEGPYKGIFGYTEDDVVSTDFVGDQHSSIFDSKAGISLNKKFVKLVSWYDNEWGYSRRVVDLIAYVAKKDKEAGC

SEQ ID NO: 40696 - protein, 344 aa, Oryza sativa (japonica cultivar-group)
MSSAASASAAGGAGEEGAAAAAQPQQEGPVVTCKGVNGLDKVVLREVRGSSAEVYLYGGHVTSWKDEHGEELLFVSNKAIFKPPKAIRGGIPICFPQFSNFGNLDPHGFARNRTWSVENDPPPFPVPTSNKAYVDLILTHTEEDLKIWPHSYEFRLRVALGPGGDLMLTSRIRNTNADGKPFSFTFAYHTYFSISDISEVRVEGLETLDYLDNLQERNRYTEQGDAIVFESELDRIYLGTPSKIAIIDHEKKRTFVVRKGGLPDAVVWNPWDKKAKAMSDFGDDEYKRMVCVEAAAIEKPITLKPGEEWTGKLELSAVPSSYYSGQLDPDRVLQDSSVPEDSIS

SEQ ID NO: 40697 - protein, 267 aa, Triticum aestivum
  misc_feature (229)..(229): Xaa can be any naturally occurring amino acid
  unsure (1)..(267): unsure at all Xaa locations
MDQPVPSICGLHPGIAVTGFCSACLRERLAGLHPSDPADSAELRRCRGFSYARSAAAYFEPQRRSCDARGAAALFHQEPTYLPGEEEHLPPTAAGRPMKDHIHQESSSKKTAGTFGGLGKKWQEWRRKSKLKKQEQGPITNRAAMPHENLRHRSFRDTRSEVAVDALGRRSIDVDSLLSMDPGRISVDEPRASCDGYHGARLRIPPMLSLVEDAPRPRSDGQIPVEEDXDTEPGGCPQTRDYYLDSSTSTRRARIVDGSSFSSRSHS

SEQ ID NO: 40698 - protein, 652 aa, Thiobacillus denitrificans ATCC 25259
MNAAIPNQAAKFLAATAHVDEAAVQPLPNSRKIYVEGSTPDIRVPMREIRQADTPLMFSGEAGTGAERSEPNPPIFVYDCSGPYTDPAAKIDIREGLPALRTKWIEARGDTEVLRDLSSEYGRQQAANPELATMRFPGLHRHPRRAKAGMNVTQMHYARQGIITPEMEFIAIRENNNRAAYLESLRASGPQGAKLAALMSRQHPGQNFGANLQGEITPEFVRDEVARGRAIIPNNINHPESEPMIIGRNFLVKINANIGNSALGSSIQEEVEKMTWAIRWGGDTVMDLSTGKNIHETREWIIRNSPVPIGTVPIYQALEKVDGKAEELTWEMFRDTLVEQAEQGVDYFTIHAGVLLRYVPMTANRMTGIVSRGGSIMAKWCLAHHKESFLYTHFEEICEIMKAYDVAFSLGDGLRPGSIYDANDEAQLSELRTLGELTQVAWKHDVQVMIEGPGHVPMQLIKENMDIQLESCSEAPFYTLGPLTTDIAPGYDHITSGIGAAMIGWYGTAMLCYVTPKEHLGLPDKDDVKEGIITYKLAAHAADLAKGHPGAQIRDNALSKARFEFRWDDQFNLGLDPDKAKSFHDETLPKESAKVAHFCSMCGPHFCSMKITQDVREFAAKEGLNEADALARGMEVKAVEFVKQGAEVYRKV

SEQ ID NO: 40699 - protein, 305 aa, Pseudoalteromonas tunicata D2
MPQFNDILQQISQQARCCFGQGKVANYIPALADVPAEQFSIAIHTVDGQTFSAGDAHATFSIQSVSKALTLTLAMQHHGDEIWRRVGKEPSGTAFNSLAQLEFETGIPRNPFINAGALVVCDALVSRVSAPVFNMLETARLLSANDKVVINKKVADSEYQHRHRNAAMAHLMKSFNNFDNDVDTVLRAYFSYCAIEMSSIELAKTFSYLANQGVCVQSGRQMLSAKQTQQVNSLLFTSGLYDAAGDFAFRVGIPAKSGVGGGIIGIVPGKFTVCVWSPELNEFGNSVAGLYALELLAEKLHISML

SEQ ID NO: 40700 - protein, 190 aa, Candida albicans SC5314
MSAKIELVTENVTNGHSGASETIQYTKSQMVGHGSFGVVFQIQLQPSNEIGAVKRVLQDKRFKNRELQIMKLVHHRNIADLKYYFYTNNEKNELYLNLILEFVPETLYKASHYYVSKRLNMPPLEVKLYTYQMFRALNYIHSQGICHRDIKPQNLLINPDTGELKLCDFGSAKILNPSEPNVLNLIWWWN

SEQ ID NO: 40701 - protein, 274 aa, Pseudoalteromonas tunicata D2
MQTDTDLEYLAIESEHCSATIFLQGAQLASFIPKNKPPLIWMSQDEDYQQGKGLRGGIPICWPWFGVCKNQDWPIHGVARTNLWRAEEVNEHAEYTEVILSLPMAQIDKTYWPYKSALKVVFHLSDVLKVTLINTNLDSQPIELTQALHTYFPTSDITATKVDGLQGSQFIEFGEGPFAQNDVVGFARETDMVYTQVGSMQHINTPEGTIAVGRENSTSCVLWNPWIDKAKRLSNFADDEYKTMLCLEAGNVMDDKVVLAPGESHSLSTIVYWV

SEQ ID NO: 40702 - protein, 472 aa, Erythrobacter sp. NAP1
MASAKDVVKQIKDGDIEWVDLRFTDPKGKWQHLTMAASVMDEDALDDGLMFDGSSIEGWKAINESDMILKPDMDAVYPDPFSETPMLSIFCDIVEPSDGQLYARDPRSTAKRAEAYLASTGIGDTVYVGPEPEFFMFDDVRFEDGYAGSGYRIDDIELPTNTGTDYTELGGGNMGHRPRAKGGYFPVAPVDSAMDIRGEMVSTMMEMGLNMDKHHHEVAAAQHELGITFSTLTKTADQVQVYKYVVQQVAHAYGKTATFMPKPIKDDNGSGMHTHMSIWNDGKPTFAGNEYAGLSETCLHYIGGVIKHAKAINAFTNATTNSYKRLVPGFEAPVLLAYSARNRSASCRIPYGAGEKAKRVEFRFPDAICNPYLAFSALLMAGLDGIENKIHPGDAMDKNLYDLPPAELAEVPTVCGSLREALEALEEDHEFLLKGDVFSMDQIEAYAELKWEEQLRLETTPSPVEFDMYYSS

SEQ ID NO: 40703 - protein, 495 aa, Prochlorococcus marinus str. MIT 9313
MAGRLNQQNQRVRPNSNEDQVVEQVKEHFERTLIEVGGTVAGSVAALEHQPHNKALNYGEVFLRDNVPVMIYLLTQKRYKEVKQFLSVCLDLQSTTYQTRGVFPTSFVEEQGELIADYGQRSIGRITSVDASLWWPILCWLYVKRSGDKNFGTNQKVQRGVQLMLDLVLHPTFEGTPVLFVQDCSFMIDRPMDVWGAPLEVEVLLYACLRSCIELMELSRKTHVSRLLDQRLLLTRQWVHDLRQFLLKHYWVTSKTMQVLRRRPTEQYGDNQHQNEFNVQPQVVPDWLQDWLENRGGYLIGNIRTGRPDFRFYSLGNSLACLFGLLTAPQQRALFRLVLHNRQHLMAQMPMRICHPPMEGAEWQNKTGSDPKNWPWSYHNGGHWPSLLWFFGASILLHERRHPEADVLLMGEMRALLEECYWSQLNQLPRQKWAEYFDGPTGTWVGQQSRTYQTWTMVGFLLLHHLLRVCPDDVLWLDLDELLPTHEVNATKNPA

SEQ ID NO: 40704 - protein, 431 aa, Acinetobacter sp. ADP1
MSSWFPKWRPYSGQIDHRPVATNEYLPAAQSAVLGIQHAFAMFGATVLAPLLMGFNPNLAILMSGICTILFFLFTGGRVPSYLGSSFAFIGVVAAATGHVTGSGANPNLSIALGGIVACGVVYAAIGFLVMLTGTRWIEKIMPPVVTGAVVMIIGLNLAPVTVKGVAGNPFDMWMALLTVLCMGTIAVFTKGLLQRLLLLVGLLISYLIYAIVSNGLGFGKAIDFGQIATAPWFGLPAFSAPTFETNAMLIIAPVALILVAENLGHIKAVGAMTGENLTPQLGKAFVADGIATTLSGSVGAPGMTTYGENIGVMAVTRVYSTIVFVIAGLFAIFLGLSPKFGAVISTIPSAVLTGASIVVFGLITIAGAKIWIENKVDFSNNKNLIVAAVTIILGAGNFELTFGEFNLGGIGTATFAAILLHLFFSLKDKS

SEQ ID NO: 40705 - protein, 443 aa, Acinetobacter sp. ADP1
MEKLMSTEKTQTSNLHRIVIVGGGAGGLELATRLGNQLGKHQHAEIILVDAALTHIWKPLLHEVAAGTLNSYEDELNYFAHASQHHFEFFLGRLTDLDRASKKIVLGALKDEDGKEVAPERCIAYDTLVLAIGSTSNDFGTPGAKEHCIFLDSRPQADRFQREFLSLYLEAQARNLIEPHENTLNIAIIGAGATGVELAAELHHAANQFSKYGLNSIDPKDVKISLIEAAPRILPALSERVSEGAEKELQKIGVNVLKNCRVTHIDAHKVYCEGDIQIPATLKVWSAGIKAPDFLKNIGGLETNRINQLVVKPSLQTTLDDDIFAMGDCACYIPTGAERPVPPRAQVANQEAIFLAKALAHRLQNKPLGTFEFKDKGSLVSLSNQSTVGNILGNINVEGLFARMMYVSLYRFHQVALHGVFKTSLMIIKDLLSKGSSPQLKLH

SEQ ID NO: 40706 - protein, 430 aa, Aspergillus nidulans FGSC A4
MESSREFDIVVLGPTGYTGKYCAEHIVTHLPTNLKWALAGRSTKKIEGVAQELKKLNPDRLDPGKTMYWCLWSGSADASIEIISVQLNKEELRSLAERTKLIINCVGPYHIYSTPVVEACANAGTHYVDATGETPWVKQTVDKYHGTAKSNGAIIIHCVGIESAPADMLAYALVKEVREKMSCQTKEITGSIYEFKSSGASGGTLASILTCIEDFSGSQLLESTKPFALAASPPPKDIPSESFVARILGVRTVRDLGTLTKSPTDFCDMTIIHRSSTLMPELYGPRFYFRQFLNVRNTFIGILWNYAFLVGTAFLILAPVRWLVKKAIYAPGSGPTTESGRNDRCEYRAIATPDQDTPKRVLGKLKYAGSSMYHFTGVLMAEAAMVILENEEKVKRVSGGGIVTPASLGQEYLDRLENNGCRVETQVLEN

SEQ ID NO: 40707 - protein, 206 aa, Peperomia caperata
SVLCDAEVAVIVFSTKGKLYEYATDAGMARILDRYEKHTFSNRELELTNLESEGAWSLEYGKLKARFELLQKSHRHYLGEDLGALNMKELQHIEHQLDSALRHVRSRKNQILSDTISDLQTKEKLIHEQNKILQKRIQEKEREITGQPQWEIVPSRQENQNPQPTLFPIPLHTLSIGYCKEDGKAIELGLENEPRPLSQKMPPWML

SEQ ID NO: 40708 - protein, 205 aa, Prochlorococcus marinus str. NATL1A
MESKLRVGIAGPVGSGKTAIIQRLCENLKDRLEIAVVTNDIYTQEDAKFLTNSKALAPERIKGVETGGCPHTAIREDCSINRIAVEELEHEFTTLDLVFVESGGDNLAASFSPELVDVCIYIIDVAAGDKIPRKGGPGITRSDLLVINKIDLAEMVGASLKIMERDTLLMRKNLPWCFTNTKTGEGIKIIAEFLCNQIPFARKMV

SEQ ID NO: 40709 - protein, 93 aa, Blastopirellula marina DSM 3645
MVSDFHRTMLKGGVFLYPPTAENPEGKLRILYEAFPIAFLCEQAGGKASDGTGRLLEIEPTSIHQRTPMVVGSQVEMEKFEAMVASGEISALV

SEQ ID NO: 40710 - protein, 502 aa, Burkholderia sp. 383
MLVDELHSRKNEVIDPSALRARLRDGALLETRAWLASGWQEGTDGRSFPVTNPATGDILARVASLGAAEVEQAIESSALAQQGWQKRTSHERAKLLRAWFDLILANADDLALIMTSEQGKPLAEARGEITYAASFVEWFAEEAKRVYGDVMPHPQGDKRILVIRQPIGVCAAITPWNFPAAMITRKVAPALAAGCSIIVRPADLTPLTALALAVLAERAGIPAGVLQVVCGPSREIGAVLTASPVVRKLSFTGSTEVGRVLMSQSSGTIKRLSLELGGNAPFIVFDDADLDAAIEGAMASKYRNSGQTCVCANRFLVQAGIHDRFVEALTRRVQALKVGNGIEPGVQQGPLIQKSACDHLNQLIDDAVSKGARIVTGGKGHPLGGTFFEPTVIADATPAMRLAREELFGPVGPVFRFDDEAEAIAMANDTEYGLAAYLYTRDNSRIWRVGEALEYGMVGLNTGVISNEVAPFGGVKQSGLGREGSRYGIEEYLEIKYMCSQV

SEQ ID NO: 40711 - protein, 169 aa, Wolbachia endosymbiont of Drosophila melanogaster
MTDTSFKYFMLKKLAWYWSFVELIKGFVITLKYMFKPKVTLRYPMEKGPLSPRFRGEHALRRYPNGEERCIACKLCEVICPAQAIVIEAEEREDGSRRTTRYDIDMIKCIYCGLCQEACPVDAIVEGPNFEFATETREELMYNKEKLLRNGEVWEDAIALRLKKNRPYY

SEQ ID NO: 40712 - protein, 468 aa, Pseudomonas aeruginosa UCBPP-PA14
MNARLHATSPLGDADLVRADQAHYMHGYHVFDDHRVNGSLNIAAGDGAYIYDTAGNRYLDAVGGMWCTNIGLGREEMARTVAEQTRLLAYSNPFCDMANPRAIELCRKLAELAPGDLDHVFLTTGGSTAVDTAIRLMHYYQNCRGKRAKKHVITRINAYHGSTFLGMSLGGKSADRPAEFDFLDERIHHLACPYYYRAPEGVGEAEFLDGLVEEFERKILELGADRVGAFISEPVFGSGGVIVPPAGYHRRMWKLCQRYDVLYISDEVVTSFGRLGHFFASQAVFGVQPDIILTAKGLTSGYQPLGACIFSRRIWEVIAEPDKGRCFSHGFTYSGHPVACAAALKNIEIIEREGLLAHADEVGRYFEERLQSLRDLPIVGDVRGMRFMACVEFVADKASKALFPESLNIGEWVHLRAQKRGLLVRPIVHLNVMSPPLILTREQVDTVVRVLRESIEETVEDLVRAGHR

SEQ ID NO: 40713 - protein, 180 aa, Haemophilus influenzae Rd KW20
MTTQLDLIKSSIKSIPNYPKEGIIFRDITTLLEVPAAFKATIDLIVEQYRDKGITKVLGTESRGFIFGAPVALALGLPFELVRKPKKLPRETISQSYQLEYGQDTLEMHVDAISEGDNVLIIDDLLATGGTVEATVKLVQRLGGAVKHAAFVINLPELGGEKRLNNLGVDCYTLVNFEGH

SEQ ID NO: 40714 - protein, 353 aa, Brassica napus
MGVLDEAFIQAPEHRPKTHLTNSGDYILSNEIPTIDLSSLQDPHCDKTALATEIAEACMRWGFFQVINHGLSLDLMRRVEKTVAEFFSLTLEEKRRVKRDEVNPMGYHDGEHTKNVRDWKEIFDFFLQDSTTVPATTEPEDTELRKLTNPWPQNPSDFREVCQEYAREVEKLAFKLLELISISLGLPGDRLTGYFKDQTSFLRFNHYPPCPNPELALGVGRHADAGVITVLAQDSVGGLQVSRRSDGQWFSVKPNPDAFIINIGNCMQVWTNDKYWSAEHRVVVNSSKERFSMPFFLFPSHDTNIEPLKELISEDNPPCYKKYNWGKFFAARNRSDYKKLQTESIQIDRFKAA

SEQ ID NO: 40715 - protein, 608 aa, Candida albicans SC5314
MSYSSASFRKLNNVGISQPSQTTTTTTSANQPQSQSQQQPLQQSQQQHLHMKPNPHIPHHQLPGTVGTRASIPQPALMASNSILTLGPFKHRKDLTRESVLSTYQIMGYIAAGTYGKVYKAKLKSNKLNKTDDDSGIDGINNKDIFSESMNDLHHDNSPSIMINTTTNITINNSLPQFFAIKKFKSDNHHHHINNNNNGGNHLSKGNNSIHQDEVLHYTGISQSAIREMSLCRELNNKNITKLVDIILENKSIYMVFEFCEHDLLQIIHYQSHPDFKPIPCPTIKSLIWQILNGVTFLHKNWILHRDLKPANIMVSSQGVVKIGDLGLARKFKSPLQSLYTGDKVVVTIWYRAPELLLGTRHYTPAVDLWAVGCILAELLSLRPIFKGEEAKIDLNNKKSVPFQKNQLQKIIEILGTPTTDIWNNLNKYPEYLSFTQHFNQNYPNNLSNWFKLINGGNNQNSEKCLELLSGLLKYDPELRLTADQALLHPYFLELPKVNENAFEGLNYKYPNRKIYTDDNDIMTTAANNNNNNNNNNNNNNNNNNNNNNNNNNNSGHQLSQQQNVQIQQVHQMQQQIHSQQLQSHGANSTYKRSGIDDLPGGIRKKRG

SEQ ID NO: 40716 - protein, 337 aa, Candida albicans SC5314
MAFLFKRNPKTPPELVRALNDQVSKLDYASPDNAKKYQDECARYLKNMKVILHGDDEVEPQPDQITQLAQEIYSTDCLYYLVVNLRKLDFDSRKDVVILFSTLLRRTMANKSPTVDYLVHSKPEIITMLIKGPENLEIGLICGQILRDCIKFEVINRFVLYSPSFYNFFKYVQIPTFEIATDAMMTLHELLTTHRKLVSEFLGNNYDVFITAINKLITSKNYVTKRQSVKLLNELVSQRSNQQFLSKFFDDANNLKLTMLLLSDKSKNLQLEGFHTLKFFVANPKRSQKVTDILIKNKANFIEFFKTFDIASFHDSNIIEERDYTLGEIKNLPDRIH

SEQ ID NO: 40717 - protein, 552 aa, Chromobacterium violaceum ATCC 12472
MYRYDEVDHRLVRERVVQFRDQTRRFLAGELSEDEFRPLRLMNGLYIQRHAPMLRVAIPYGHLRSEQLRKLADIARRYDKGYGHFTTRQNIQFNWPELDKVPDILEELSTVEMHAIQTSGNCVRNTTTDAFAGVAADQLFDPRPYCEIIRQWSTMHPEFSFLPRKFKIAVSGSIEDRAATMVHDIGLHVSRNETGEAGFKVIVGGGLGRTPMVGEVIREFLPRQHLLTYLDAVLRVYNRFGRRDNKYKARIKILVKAMTRDGFAAKVEDEWSHLKDGPATLRDEDVAHYASFFADPDYPALADDPAELTGPLAEDKAFARWFERNTRAHRRPGYRSVVLSLKESGAPPGDITSEQMEAAADWADRFGFGELRVAHEQNLVLPDVAQKDLYALWQAARSQRMATPNIGLLTDIISCPGGDFCSLANARSIPVANAIQQTFDDLDYLYDLGDIACNFSGCMNACGHHHIGNIGILGVDKNGEEWYQITLGGSQGSDTTIGKVIGPSFAQADVPVAFSKIMQVYIERRLDGERFIETLRRIGAEPFKERVYAPVH

SEQ ID NO: 40718 - protein, 273 aa, Acinetobacter sp. ADP1
MRISCMSSFLTSDVLIAFSVTFLAGLATLLGGAIVLFFKQPSLRLLSFGLAFSAGAMVYISLTEILNKSIHSFSEVFSAKVGFAFATFAFLTGVIAILLLDRCVPNPHTMLEKTTAQQLDQTQLRRTGLLTMLAITAHNFPEGLATFFATLDSPILGAPLAVAIAIHNIPEGIAIAVPVYMATGQKSYAIWASLLSGLAEPLGAALGYFILAPYMGATMYGIIFGLIAGVMVYLAMDELLPAAKKYSQGHETVYGLVTGMAALATSLVLFQWV

SEQ ID NO: 40719 - protein, 94 aa, Nostoc punctiforme PCC 73102
MSKDFSAEISSRICQHMNDDHADAIVLYAKTFGGVTDAIAAKMLSIDAQGMDLTAQANGETVPVRIQFDRVLADAEDAHQTLIAMVKQARVNAK

SEQ ID NO: 40720 - protein, 215 aa, Papaver nudicaule
  misc_feature (36)..(36): Xaa can be any naturally occurring amino acid
  misc_feature (168)..(168): Xaa can be any naturally occurring amino acid
  unsure (1)..(215): unsure at all Xaa locations
RHEMSMLCDAEVALIIFSNRGKLYEFCSSNSMFKTXERYQKCNYGQPEPNVSARESLEHASHQEYLKLKARVEALQRSQRNLLGEDLGPLSGKELEFLEKQLDSSLKQIRSTRTQYMLDQLTDLQRREQMLSDANKTLRRRLEEGAQASQQQWDMQHGVGYSRQQQSXHHQAADHNQGFFHPLECEPTLQIGYQQDQITVAQGAPMGSYMPGWLA

SEQ ID NO: 40721 - protein, 91 aa, Brassica napus
HQDTMMMGADFYQTEAEIASLLAERKVPIGVCENTKIRNCVIDKNAKIGKNVVIANADGVEEGDMQEERFYTRSRITVVLKNATIRDGLVL

SEQ ID NO: 40722 - protein, 327 aa, Burkholderia sp. 383
MTSVHWLPLTEVADDARDAVRAFRELGGRHYGSFSVDQSRVNFVRACELNGLTGDEAVVHEDIDVPVAGGSIRVRLYRPPAGASADGNPLVVFIHGGGWVIGSVDTHDGICRHLARHGGCAVASVEYRLSPEHRWPVPLEDCEQALDYLTANAAALSINASRVILAGDSAGGNMATLIANAASVAGPAIIGQVLFYPVTDLTASLPSYRRIQGGFPLVAESMLWFREHYVPDGTPFDLPRLSPLLHAEGRRQPPMFMATVGLDPLCDEGIAYASCAARAGSQVEHHHLPGHHHGIVTAARAIPAARYLLDRAASFVRRLAEKDGCDA

SEQ ID NO: 40723 - protein, 496 aa, Burkholderia sp. 383
MTKNQADSCSPEHVEVLIIGAGISGIDAACHLRMNLPDRSFAILEAMDGFGGTWWTHRYPGARSDSDLYTYAFGFRPWQGRSIATADEIHSYLGDVIKEYDLGSKIRYGHRVQTVSWSSEQKRWTVEVSRNDTGEHFSITTDFLWLGAGYYDHRQGFTPKWNGFDRYKGTVIHPQHWPEDLDYAGKRVVVIGSGATAATLIPAMAGTAAHVTMLQRSPTFFTAVPWTHQLDATLRELSLPEEWRSEILRRAHLKQTFDLINLAAANPDAVRDWLINETRQQLPEGFDVDKHFNPGYRPWQQRVAAVPEGDLFTAIRDGKASVVTDTIESFDENGITLASGEHLQADIVVTATGFDMSAFGQIAFHVDGDPVDMTKRVSYRGMMIEGIPNMAFIYGYYRSSWTLRADLVCEFTCRVLAHMDKVGAKTVEPRLRAEDADMQRLPWTDPNNFNAGYVMRSQHQMHSRGDRMPWQHHFEYEEERQTIPELSPDAEVLVYR

SEQ ID NO: 40724 - protein, 392 aa, Nocardia farcinica IFM 10152
MPSRPATVERLRPFASTIFAEMTELAVRHEAVNLGQGFPDTDGPAGMLEVARRAIADGVNQYPPGRGMPVLRRAIAADRARRYGTEYDPDTEVLVTVGATEAISAALLGLVEPGQEVVLIEPYYDSYAAAVALAGAHRRTAHLVADGDRFVLDLDSLRAAVTPRTRMLVVNSPHNPTGTVLGRADLTAIAELACEHDLLVLTDEVYEHLVYDDNEHISLATLPGMAERTIVVSSAAKTFNVTGWKIGWVCAPAYLVDAVLAAKQFLTFVGGGPFQPAVAHALTEEQEWVARMRESLSDKRIRLSAALAETGFGVRASGGGYFVCADVTPLGTADGLAFCRALPGTLGVAAVPVSVFADDTAAWNHLVRFTFCKQDRTLDEGVRRLRAGARVG

SEQ ID NO: 40725 - protein, 478 aa, Haemophilus influenzae Rd KW20
MSKEIKTQVVVLGAGPAGYSAAFRCADLGLETVIVERYSTLGGVCLNVGCIPSKALLHVAKVIEEAKHANKNGIYFSEPRIELDEVRAGKEAVVAKLTGGLAGMAKARKVTVVEGLATFTDSHTLVARDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVEAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHRVLGGAIVGSNGGELLGEIGLAIEMGCDAEDIALTIHAHPTLHESVGLAAEVFEGSITDLPNAKAKEKIISI

SEQ ID NO: 40726 - protein, 316 aa, Burkholderia sp. 383
MALDLHLAGFLESLAGSGAKPLPQSSPEEARGLMQHLARAVRAPEAVVDVHGVEDLTVPGATGSLRARLYRPTQERNLPTVVYLHGGGFVIGDLDTHDNICRELARGANAVVVSVDYRLAPEHPYPAAADDAIAATKWVIANAGELGGSDVVAVAGDSAGGNLAAVVTQQLHADGISLSAQFLIYPAVAQDRAGFPSFKENGEGYFLDLETIAWFERHYVLDGTDREDPRLAPIRAKDLAGLPPAVILTAEFDPLRDEGEAYGRLLHASGVKVDTIRCDGMIHGFFDMGAISPGAQAWIEKGIASFRKVLGGAQHH

SEQ ID NO: 40727 - protein, 886 aa, Haemophilus influenzae Rd KW20
MSEILKNDVDPIETQDWLQSLDSLIREEGVERAQYIVEQVIGQARTSGVSLPTGVTTDYVNTIPVAEQPAYPGDHAIERRIRSAVRWNAIAMVLRSQKKDLDLGGHISTFQSAATMYEVCYNHFFKAATEKNGGDLIFFQGHAAPGMYARAFLEGRLTEEQMDNFRQEAFTDGLSSYPHPKLMPEFWQFSTVSMGLGPVNAIYQARFLKYLDNRGLKDTKDQKVYAFLGDGEMDEIESKGALTFAAREHLDNLIFTISCNLQRLDGPVNGNGKIVQELEGLFTGAGWEVIKVLWGSDWDKLFAKDTSGKLTQLMMEVVDGDYLTFKSKDGAYIREHFFGRYPETAALVADMTDDEIWALRRGAHDSEKLYAAYAKAQNATKPVVILAHQVKGYKIPEAESKNTAHQSKKMSYESLKGFRDFFELPLTDEQVEKLEYIKFAEGTPEYEYLHGHRKALNGYVPARRTKFDVEYKVPALEEFKALLEEQPRGISTTMAFTRALNILLKDKNIGKTIVPMIADEARTFGMEGLFRQVGIYNPHGQNYIPSDRDLVAYYREAKDGQVLQEGINELGATASWLAAANSYSVNNQPMIPFFIYYSMFGFQRVGDMMWAAGDQLARGFMVGGTSGRTTLNGEGLQHEDGHSHIQAGIIPNCITYDPSFAFEVAVIMQDGINRMYGEKQEDVFYYMTTLNEVMDQPAMPAGAEEGIRKGLYKFETVEGKKGKGHVQLLGSGAIMRHVREAAQILANDYGVTSDVFSAPSFNELAREGHDAARWNLLHPTETQRVPYVAQVLADLPTVASTDYVKGYADQIRAFVPSKHYHVLGTDGFGRSDSRANLREHFEVDARYVVVAALSQLAKEGTVSNQVVADAIAKFGLNVDRINPLYA

SEQ ID NO: 40728 - protein, 394 aa, Haemophilus influenzae Rd KW20
MYLFSATNYKITMAKKDYYEVLGLQKGASEDEIKRAYKRLASKHHPDKNQGSKEAEEKFKEINEAYEVLGDDQKRAAYDQYGHAAFEQGGGAGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRNCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 40729 - protein, 286 aa, Clostridium acetobutylicum ATCC 824
MKIEGVLIPLITPFKDGKVDLASYEKLIRHYSKKGVAGFMPLATTGETPTLSDYEYQSILEKTVECNELNLPIYVGFGGNNTEKMTKDIKMLDKYNIKGILSVCPYYNRPDQRGIYEHFKRISESTSLDIVLYNIPYRTGRNIENDTIRRLSELDNIVGVKDACGDFTQTTELLLNRPDNFSILTGEDAFFYSTLMLGGDGGIMASAHLNTEKYVEVFNKSKQNDYKSALEIWKQVANMIPLLFEEPNPAPIKYCLSKTGVIASEALRLPLVPISENLKEKLNKFL

SEQ ID NO: 40730 - protein, 509 aa, Mycobacterium bovis AF2122/97
MSYVIATPEMMATAAFDLARIGSQVSAASAVAAMPTTEVVAAGADEVSAGIAALFSAHAQEYQALSAQAAAFHDQFVHTLTAAARWYTATEIANAAAMRVVLGAVNAPTQTLLGRPLIGDGAHGTAPGQPGGAGGLLFGNGGNGAAGAVGQVGGAGGAAGLFGIGGAGGAGGAGAPGGTGGTGGWLAGGGGVGGMGGAGGGAGGAGGNAGLFGNGGAGGAGGAGGGAGGAGGNAGWFGHGGAGGVGGVGAAGANGATPGQDGAAGVAGSDDGAGGDGLAGSDGGDGGAGGVGGNGGRGGWLLGNGGAGGVGGVGGAGGAGAAGGAGGAGATGINGPAGISAAGGDGGAGGNGGAGGNGGVGGAGGAGGSAGLLGYVGRAGDGGAGGGGGLGGAPGDGGAGGNGGSWLAAGDGGAGGHGGDPGLGGAGGAGGGGGRRAAPVLARGPMVWRPATTGRSAAATAAKVAMAPTHRSPAVMAVTAVPVATAGWSVTVGPAVMAVTEPRVPAMPI

SEQ ID NO: 40731 - protein, 417 aa, Zea mays
  misc_feature (142)..(142): Xaa can be any naturally occurring amino acid
  unsure (1)..(417): unsure at all Xaa locations
MLAAVMDYFSTCWGPRSRAGHRGKGSDAAGRQDGLLWYKDAGQLVTGGFSMAVVQANQLLEDQSQVESGSLSLADYGPQGTFVGVYDGHGGPETSRFINDHLFNHLRRFATEHKSMSADVIRKAFQETEEGFLSLVTKEWSXKPQIASVGSCCLVGVICAGPLYVANLGDSRAVLGRLVKATGEVLATQLSAERNACYEEVRQELQSSHPYDPRIVVLKHNVWRVKGLIQSYQDTSGDITYEGRSCLQISRSIGDVYLKKPEYNREPLHSKFRLRETFQKPILSSEPQITEHRIQPNDQFVIFASDGLWEHLSNQEAVDLVQSSPRNGIARRLVKAAMQEAAKKREMRYSDLKKIDRGVRRHFHDDITVVVVFLDSDAMSKASWSKSPSVSLRGGGVTLPAKSLAPFSAPAQLNGTH

SEQ ID NO: 40732 - protein, 205 aa, Candida albicans SC5314
MILKTSSLLRSAVQPRQWLRYTSTVAPLEASRLIVEKTNNPKPKLPKDKLVFGKTFTDHMLEIEWTKEKGWHAPKISPYHNLSLDPSTIVFHYAFELFEGMKAYKDTNGNIRTFRGDKNMIRMNKSAERIALPTFDGEELQKLIDKLLLLDKDFVPEGKGYSLYLRPTLIGTTASLGVGTPDRALLVVLPLSLVLTTRSGSNQLA

SEQ ID NO: 40733 - protein, 291 aa, Chromobacterium violaceum ATCC 12472
MLTGSLVALVTPMSNDGAVDFAALQRLVEFHIENGTAGIVAVGTTGESATLSVEEHIAVVKAVVDYAKGRVKVIAGAGGNATSEAIELGRLSAEVGADMVLSVVPYYNKPTQEGIYQHFKAIADASPLPVILYNVPGRTVADMSNDTALRLAAHPNIVGLKDATGDIGRACDLALRAPEGFALYSGDDATGMAFMLCGGHGVISVTANIAPKQMSELCAAATSGDARKARSINDKLQGLHKQLFVEPNPIPAKWALERMQRIPAGIRLPLTPLSAVSRPLVEAALKQAEVI

SEQ ID NO: 40734 - protein, 361 aa, Burkholderia thailandensis E264
MSDKVYRIAVIPGDGIGVEVMPEGLRALDAVSRRFGLRFEYEPIEWASCGYYAKHGQMMPDDWKAQLSGMDALLFGAVGWPETVPDHVSLWGSLIKFRREFDQYVNLRPARLFDGVPCPLAGRKAGDIDFMIVRENTEGEYSAVGGTMFEGTEREFVVQQAVFTRHGTERVMKFAFELAQRRAKRLTVATKSNGIAISMPWWDARAAEMAARYPDVAWDKQHIDILCARFVMQPDRFDVVVASNLFGDILSDLGPACTGTIGIAPSANLNPERNFPSLFEPVHGSAPDIAGKQVANPIAMIWSAAMMIDFLGEGAGPAREAHDAIVAAIEHVLKHGPRTRDMGGQASTSEVGDAIVARLLG

SEQ ID NO: 40735 - protein, 348 aa, Mycobacterium bovis AF2122/97
MTQIADRPARPDETLAVAVSDITQSLTMVQAINRALYDAMAADERVLVFGEDVAVEGGVFRVTEGLADTFGADRCFDTPLAESAIIGIAVGLALRGFVPVPEIQFDGFSYPAFDQVVSHLAKYRTRTRGEVDMPVTVRIPSFGGIGAAEHHSDSTESYWVHTAGLKVVVPSTPGDAYWLLRHAIACPDPVMYLEPKRRYHSRGMVDTSRPEPPIGHAMVRRSGTDVTVVTYGNLVSTALSSADTAEQQHDWSLEVIDLRSLAPLDFDTIAASIQRTGRCVVMHEGPRSLGYGAGLAARIQEEMFYQLEAPVLRACGFDTPYPPARLEKLWLPGPDRLLDCVERVLRQP

SEQ ID NO: 40736 - protein, 309 aa, Bartonella henselae
DGNEGILLYRGYPIDQLAEKGDFLESCYLLLYGELPTKQEKIDFDRCIMQHTMVHEQFARFFHGFRRDSHPMAVMIACLGAMSAFYHDSIDITDPQQRMIASIRLISKVPTLAAMAYKYSIGQAFVYPRNDLSYAANFLRMCFSVPCEEYKINPVLTRAMDRIFTLHADHEQNASTSTVRLAGSSGANPFACIAAGVACLWGPAHGGANEACLKMLQEIGSVERIPEFIARAKDKNDSFRLMGFGHRVYKNYDPRAKIMQQTCHEVLKELNIQNDPLLDIAITLENIALNDEYFIEKKLYPNVDFYSGI

SEQ ID NO: 40737 - protein, 356 aa, Acinetobacter sp. ADP1
MTAFVQTIQEVLEKGHGPAARALDKLPSFVQESIAKVLGYPYQYPQLDSFIKCLMAVQIKQGQTGFIGSDVEKSRLAFETQMESILRKPTAITFVEDIRLPLQSGTIFARHYHPAPNKKLPMIVFYHGGGFVVGNVDTHDEACRLIAKYANAQVLSIDYPLAPEVSPQRLIQSCEDALAWVYQNKRHFKILKNQIAVAGDSAGGNISTVVAQRAIGKVYAPDAQFLIYPVVDFKSRHPSFYAYKDGLVLTGNDVDYVTDYYATKHAVHLDDPIISPTYGNFKKLAPAYIVTAGHDVLHDEGEIYSHKLRQAGVKIHFEEYLDQTHGFINLTPVSHKARANLIQMSKSFRKFWNKYA

SEQ ID NO: 40738 - protein, 707 aa, Bradyrhizobium japonicum USDA 110
MPMRDTLTSLRYRYWPDHLLGEILSKRWTETAIPVILLLIVGLALSRSIDNFLSPASLADTARQAGEIGFIALGLALVVIVGGIDLSVGSIFALTDFCALYLLDVLGWPVPAVVAATLLCGALLGAVNGVLIGYLRLRAFITTLITLIIYRSAYDLLIQRYSNAIASAFPDIPSWDFIGGGSIFGIPTVALVYIVIAIFGHIFMTRLRPGWHITAIGGSRRSAYNSGIPVRRTIALCYVASGVLTSIGALFFASRLGTVGGDIGVGLEVIVLTATVLGGITLGGGKGSVAKSAVGVLIVLLITNGLTTMNARGGVNRMALAGILLVAAMVDIRWQKNRTRIISKVYVAPTYHALPPPPPTEIGQGGPFEQNDKLRDVELIGLGRIEAPEDVILDRHDNLYAGSRHGDIIRFLAPDYQKMEVFAHIGGQPLGMAFDREDNLYICIGGMGLYRIKPDGTVEKATDETNRSMRSVNDDSRLRLADDLDITDDGLIFFSEATVRYEMDEWPIDGLEARGNGRIICYDTRTGATRTELRGLKFPNGICVASDGQSILFAETFGCSIKRYWFAGPKKGAVEVVMDNLPGYPDNINLASDGNYWLALVGMRSPSLDLAWKMPGFRRRMAKRVPVDEWLFPNINTGCVVKFNEQGKILESFWDLRGENHPMITSMREHRGYLYLGGIANNRIGRYKLDNADPDFVQYDKRWGKLS

SEQ ID NO: 40739 - protein, 665 aa, Haemophilus ducreyi 35000HP
MTERKVLANAIRFLSMDAVQKANSGHPGAPMGMADIAEVLWRDFLKHNPTNPKWADRDRFVLSNGHGSMLIYSLLHLSGYDLSIEDLKQFRQLHSKTPGHPEYGYAPGVETTTGPLGQGITNAVGMAIAEKTLAAQFNREGHKIVDHYTYAFLGDGCLMEGISHEACSLAGTLGLGKLIAFYDDNNISIDGHVDGWFADDTAQRFEAYGWQVIRNVDGHDATQIKIAIENAQAEKDRPTLIICKTIIGYGSPNKSASHDCHGAPLGNGEIALTRQALNWQYAPFEIPADIYADWDAKAKGCLIEKEWDAKFVAYQTAYPALAAEFKRRMAGDLPANWKTEASHFIETLQANPASIASRKASQNAIEAYAHLLPELLGGSADLASSNLTLWSGSKPIRADHNVDGNYINYGVREFGMSAIMNGIALHGGFIPYGATFLMFYEYAHNAVRMAALMKQRALFVYTHDSIGLGEDGPTHQPVEQTASLRYIPNLETWRPCDQVESAIAWKSAIERQDGPTALIFTRQNLAQQARMAEQLANVARGGYVLKEASGTPDLILIATGSEVELAIKAAEVLENEGKKVRVVSMPSTNIFDKQSEAYRESVLPRAITKRIAIEAQLSDFWYKYVGFEGRIIGMNSFGESAPADQLFKLFGFSVENVVAKAKEMW

SEQ ID NO: 40740 - protein, 91 aa, Prochlorococcus marinus str. MIT 9313
MSSDPLTPDVSARICRHMNGDHAEAVMNYARYYGGIKDPQTAKMILITSEKMELEVDGDALEIKFDHTLNDSEDAHHTLVAMLKAMPKSSG

SEQ ID NO: 40741 - protein, 461 aa, Burkholderia xenovorans LB400
MTFLKSPPPTPEDVADEYAATISGSSLPKYRIPEASSDRRAVFDLVRDELFMDGNSRQNVATFCTTYADDEVRHLMDLSIDKNMIDKDEYPQTAEIEMRCVHMLADLWHASKAWKTTGCSTTGSSEACMLGGLALKWQWKKRREAQGKPTDKPNFVCGPVQVCWAKFARYFDVEMRQVPLRGEATGLTPEDLAEYCDENTIGVVATLGITFTCVYEPVKALAGALDALQANVGLDIPIHVDAASGGFVAPFIQPDLEWDFSVPRVKSINASGHKYGLAPLGVGWVVWRSTQDLPDELIFRVDYLGGDMPTFALNFSRPAGQIIAQYYMLLRLGREGYRRIQQECADTAQALADGLAKIDQLEMIYDGRGALPAVCYKLKHPETAGFTLFDLSDQVRMRGWQIASYELPAGREDTIVQRVLIRRGVTRDMAAMLLEDIRHAIGHLTKNPVLHSSAGPTFHHN

SEQ ID NO: 40742 - protein, 383 aa, Pyrobaculum aerophilum str. IM2
MRKGTVAVRGYKHSDPYGALQPPIYLTALFRMEGEALKSDRGFDLKYSREENPTLRPLEEVVANLEGGVDSLAFNSGMAALSTVFFSLLSADASVLTPMEAYGATLRLLNALEKYGVRMRKAYPDTETYIEALKAVKPNLAFFETITNPMLRVLDGPEIIKAAKDLGAVVVVDNTFATPVLTTPISYGADVVVHSATKYLAGHNDVVGGIAVVARGDLLEELWIWRAMLGSIMQPFEAFLTLRGLKTLFVRFEKQCKTAMAVAQFLEGHGKVAEVIYPGLSSHPHHATAKRLFGDKFGAVVSFRIKGGRDAVVRFFKSLRLITPGPSLGGVESNATYPVASAASPIPEDERKILGITEDLVRLSIGLEEAEDLIEDLDRALNS

SEQ ID NO: 40743 - protein, 811 aa, Pyrobaculum aerophilum str. IM2
MRFIKWLDEIGKKDILLAGGKGANLGEVAKMVQVPPGFVITTEAYLHFLNVTGLKDRINEVLKEFISKGEPDEYEKASTVIRGLIESSPLPSDLEKELLEAYKKLGEIVGMANVPVAVRSSATAEDIPEASFAGQQDTYLNVKGAENVIYYAKKVWSSLYTPRALYYRDKMGIPHEKSLMAVVVQKLVNARSAGVIFTLDPTTGDRSKVVIEASWGLGEGVVKGIVTPDEFVVDKSSLKIVERRISPKKVAVVRDEAGLVKEVQLPPEKVNAPALSDEEVVELAKMAIKLEEYYGHPVDIEFAVDADMEYPRNLFILQVRPETVWSRKAERPAKAAEEAPVGTVVVKGIPASPGIAVGQAKICLTLEDAKRKLKKGDILVTKMTDPDWVPYMRLASAIVTDEGGRTSHAAIVSRELGIPAVVGAGNATSVLKDGETYTVDGSKGIVMVGAVVKKEEAKAVEVGVAAPPKEIILHIYRAVPTATKVYMNLGEPDKIDEYKDLPFDGIGLMRIEFVISSWVGQHPLYLLSIGQEHKFVNKMAEGIAKVASAIYPRPVVVRFSDFKTNEYRGLEGGEKFEPEERNPMLGWRGVSRYISPQYERAFRLELKAIKKARQEMGLNNIWVMAPFVRTVWESEKFAKLLEEEGLYRDRDFKVWAMAQVPSIAFMVQEFSEYFDGFSIGSNDLTQLVLGVDRDNDFLVRINPKYFDEREAPVLRAIYELIKRAHKMGRTVSICGQGPSVYPQLVEFLVRGGIDSISVNPDAVLQTRVLVASVELKVLRERLDAIYNALYKPDESSEFYDILKKVFGQVRY

SEQ ID NO: 40744 - protein, 1900 aa, Kluyveromyces lactis NRRL Y-1140
MNPQPKETNRSSISSGARNSAGSASSNNSISSKNSGRELQPRSDTDSEWQDVGMPTFKEDYSIDAITKKVKPGKKGFHSAIVRDAGSFAHNPQPPLAKPVKPTFERSRTANLTATSSRGNLPLLSRTSSTLSVSTATSHGHKGTTKPSRATNFFKKLTSRKSSLASQGGPPDSDNQISQGGRVSASDGEQQSPFHQQSLQQQVPTNALRRKMSTFIHGSSTMSAASTLTSANAPHMKHSGSKGSSLLHSGNEASNGSNLSGGNATSGVSNQQHGVSSAGRSIDTDLSRRNSGTSFDASKLSAAKEIFGVDLDLDKLSDMTDVVVTSNAPSAETTDKVPPKSPNASQDTKDATLALRKQWTAPESWDVDETVGLDVNKIKERHKMSKANRHRGKNRKRYSKSQGKHTKGSVPKNVIAKDTSEPVIPHVHHHDFEEDALSPRTSPPNRGSNDESGLHLSETKSSECDLCFTISPNGDEDSDISIETQSESLDDITSAKTQSRPGSPLSQKNIEQYTELDGETEYEEHMLEKYYSDLSDIDQTKKYAIRIFNVDDTFTTLSCRPNTSVAELIPQIKKKFNIQQGNFQLSLKVGKLSKILRPTANPILIQIKLLLLNGYKKSDPLHILGLEDVSFVFSFKFHPVTTSQLTIEQQQRLSKGDFIHVDLRNMDLTTPPIIFYQHTSEIESLDVSNNANIFLPIDFIESAVKLSSLRMVNVRASRFPANITQAYDLVSLDLERNFIKRVPESISKLSNLTILNLQCNQLDRLPSGFKNLKNLQLLDISSNAFTAYPEVINRCTNLLQVDLSYNKINSLPLSINELSKLAKMNLSNNKIQAVPDLSGMANLRTLNLKNNRIATIKSNAPNLQNLFLTSNRISVWEDSLPKLRSCDLTENPVTSFDYRGNVLSNLTSLSLNKAKLSSLPIDFLKTLEKLEKLELNDNNLTSLPAEIKYSKKLIHFSAANNKLDSIPEEIGELSNLKSLDLHCNNIRELPISIVNLELTTLNFSSNLLGYNPGLEDYENTPLSKSLLFLNTADNNLNNEMLPLFNFNTSLKIINLSYNDISDISALNLPSLTELYLSGNAITSLPGEVFQRMKNLKVIMLNGNKLMSLPSELSQLSNLTVLDVGSNQLKYNISNYHYDWNWMNNLNLKYLNFSGNKRFEIKSMIGPDTKTDLSDLTILKQLKILGLMDVTMKTSKVPDDGVNFRLRTTGSMINGMKYGVADTLGKKSSVSTRDIKYERFRGKDDECLFCLYDSVNENASSGHKISQIIRDIYDKILTRALEKYGDDTDENIRTALRFSFLQLNKEINGMLVSVENGLNKSELTTVDLLSGASATVVFFKGKSVYTANIGNIGAILAKNNGDYEVLTRLHVPTKRDEYERIRIAGGYVNSEKLDGVSEVSRAVGFFDLLPHIHASPDISDFKLTFSDQMIIIASHNLWNYIGYEIASDIARENGSEPMLAAEKLKDYAITYGCTDKLTVVCISVEKGATETNRFNISKKDLLSRKTAFEDSSLRRLQPEIPPPTGNVAIVFTDIKNSTFIWELFPDAMRTAIKTHNEIMRRQLRIFGGYEVKTEGDAFMVAFPTPTSALVWCLSVQLKLLEAEWPGEITSIRDGCLITDTSGNKIYQGLSVRMGIHWGCPVPEVDVVTKRMDYLGPVVNKAARVSGIADGGQVMLSNDFMVEFKKILSYHQQVTEDNIPLAKAYGEDIVGEILEREIHILSSIGWMFVELGEQTLKGLETKELVTIAYPKSLQARHTLATQDQNNSVISDDFLFQIRSVSNRLETVLSSVQGGLIGLENSANGRYTTFDSNTKQAVMKNSSEADLLAFLDHLITRIESSVVLMNLRQQVQGGLTIYKSGDAMKQKSIFQLLDDLLARNQLYIENSHNDESEQQSFKSFPEE

SEQ ID NO: 40745 - protein, 216 aa, Ranunculus bulbosus
  misc_feature (214)..(214): Xaa can be any naturally occurring amino acid
  unsure (1)..(216): unsure at all Xaa locations
GLVKKAHEISVLCDAEVALIVFSTKGKLFEYSTDSGMDKILERYERYSYAERELVTNDTDSQGNWSLEYTKLKAKVEILQKNQRHFRGEEIGNLGLKELQNLEQQLDTALKLIRARKNQLLFESISEYQKKEKALNEQNNQLEKQLKEKEKELAKRPQWEQPPNQGQTSQSFTLQSHPCLNIGGNYQGGSSGREDEVPQTQARPTILMPPWMVXHL

SEQ ID NO: 40746 - protein, 373 aa, Nicotiana tabacum
MAIEHNEQQELSQSFLLDALYCEEEEEKWGDLVDDETIITPLSSEVTTTTTTTTKPNSLLPLLLLEQDLFWEDEELLSLFSKEKETHCWFNSFQDDSLLCSARVDSVEWILKVNGYYGFSALTAVLAINYFDRFLTSLHYQKDKPWMIQLAAVTCLSLAAKVEETQVPLLLDFQVEDAKYVFEAKTIQRMELLVLSSLKWRMNPVTPLSFLDHIIRRLGLRNNIHWEFLRRCENLLLSIMADCRFVRYMPSVLATAIMLHVIHQVEPCNSVDYQNQLLGVLKINKEKVNNCFELISEVCSKPISHKRKYENPSHSPSGVIDPIYSSESSNDSWDLESTSSYFPVFKKSRVQEQQMKLASSISRVFVEAVGSPH

SEQ ID NO: 40747 - protein, 367 aa, Nicotiana tabacum
MVFPLDTQLLNPIFDVLYCEEDRFLDDDDLGEWSSTLEQVGNNVKKTLPLLECDMFWEDDQLVTLLTKEKESHLGFDCLISDGDGFLVEVRKEALDWMLRVIAHYGFTAMTAVLAVNYFDRFVSGLCFQKDKPWMSQLAAVACLSIAAKVEETQVPLLLDLQVADSRFVFEAKTIQRMELLVLSTLKWKMNPVTPLSFIDHIMRRFGFMTNLHLDFLRRCERLILGIITDSRLLHYPPSVIATAVVYFVINEIEPCNAMEYQNQLMTVLKVKQDSFEECHDLILELMGTSGYNICQSLKRKHQSVPGSPSGVIDAYFSCDSSNDSWSVASSISSSPEPQYKRIKTQDQTMTLAPLSSVSVVVGSSPR

SEQ ID NO: 40748 - protein, 612 aa, Aspergillus nidulans FGSC A4
MEGQGENDELYPIAVLIDELKHDDVLLRLNAIHRLSTIALALGPERTRDELVPFLDDSVEDEDEVLTALSEELGSFIEYVGGPEYGHVLLSPLENLAAIEEPLAVESLNKIGEQLSEKQIEEYFVPMVQRLSKADWFTSKVSATGLYCVPYRKSSSSLQQTLRQFFAGLVRDETPMVRRSAGNNLAKFVKEMTTPIVIDEMIPLFQYLASDDQDSVRLLTVDILIAIAEEIPKEQQPSHGVLLTSLRSLFEDKSWRVRYMVADRYEKIAKAVHEEVVTRDMVPSFVKLLKDTEAEVRTAVAGQIPGFCSLIDRETLLNEIMTSVEDLVSDPSQHVRAALGTQISGLAPILGKEETISHLLPMFLQMLKDEFPDVRLHIISKLELVNNVIGIELLSQSLLPAIVQLAEDKQWRVRLAIIEYIPLLASQLGVKFFDEQLSDLCMGWLGDTVFSIREAATQNLRKLTEVFGVDWAKESIIPKVMAMGQHPNYLYRMTTCFAISTLAPVVTLEIIENSVLPILERLTSDDIPNIRFNVAKSYAVLIDTLRRLPAQGTLTDLEKEGKTEAPSPRGQELIQQSVLPSLEKLQGDDDVDVRYFATTAAGGHEEVMQTSP

SEQ ID NO: 40749 - protein, 237 aa, Zea mays
  misc_feature (190)..(190): Xaa can be any naturally occurring amino acid
  unsure (1)..(237): unsure at all Xaa locations
MATSELPSESDAFTFPCGDDGTTSPALSPPVVISVLASILERHIALNERAMAAASGLDQSAPGDKDDDDNSDPAAAAARKRARAFDGGTVLDMSLHAFLERFSRYAHVSPQVYVVAYAYLDRLRRSAGVRVVRANAQRLLTTAILVASKFVEDRNYRNSYFAAVGGLAAAELSALELDFLFLMQFRLNVXAGVFRSYCRHLEREVSHGGWYRVDRRLGRPLVCAGEARAQHRQAAAV

SEQ ID NO: 40750 - protein, 756 aa, Haemophilus influenzae Rd KW20
MTEQLRQAALDFHEFPIPGKIEVTPTKSLATQRDLALAYSPGVAEPCLEIEKDPAASYKYTARGNLVAVISNGTAVLGLGNIGALAGKPVMEGKGVLFKKFAGINVFDIEVNEHDPDKLVDIIASLEPTFGGVNLEDIKAPECFYIEQKLRERMNIPVFHDDQHGTAIISAAAIINSLRIVGKKIEDVRLVASGAGAASIACLNLLLSLGMKRENITVCDSKGVVYKGRDDKMDQTKKEYAIEDNGWRKLADAIPNADIFLGCSAAGALTQDMVKSMAAHPIILALANPNPEITPPEAKAVRPDAIVCTGRSDYPNQVNNVLCFPFIFRGALDVGATTINEEMKRAAVYAIADLALEEQNEVVTSAYGGEGATFGADYVIPRPFDPRLIVRIAPAVAKAAMESGVATRPIQNWDAYVEKLTQFVYKTSLFMRPIFSQAKSAKQRIILAEGEENKALHATQEVISMGLANPILIGRRSVIEEKIKKLGLRLTAGVDFEIVDNEDNPRYEECWKHYYELTKRKGITPAIAKRVVRSNTTVLASTLLSLGYADALVCGLFGSYGKHLASIRDIIGLKDGVKTAAALNSLVLPTGNVFLTDTHVNSNPTAEELAEITLMAAEEIHRFGIEPAVALLSHSNFGSSDSLGAPKMREVLQIVKERNPHLMIDGEMRGDLAMNEAHRKELMPDSPLKGSANLLVFPDLSASRISYSLLRGTTTAITVGPILMGMNKSAHILNPGASVRRIINMIAYAAVKAQQE

SEQ ID NO: 40751 - protein, 284 aa, Bacillus cereus ATCC 10987
MTKIFILASTLSLSFFSGLNIGNAATENFSPVTNAIVQNNDHFAEGNSKDNNKPPGNDGSQDDSDSGGNGSDGSGSGDNGSGGNGSGGNGSGDNGSGGNGSGGNGSGGNGSGGNGSGGNGSGGNGSGGNGSSGNGSDGSGSGGNGSGGNDSGGNGSGGNGSGGSGSDGNGSGGSDSGGSGSSGNGSGGSGSDGNGSGGSGSGGNRGKGDSSSQGGNDSHGGNRGKGDSSSQGGNGSQGGNVKDNAKKQGDKLPNTATHYPASILMGLSTFLIGMLLFIRRKNAK

SEQ ID NO: 40752 - protein, 570 aa, Aspergillus nidulans FGSC A4
MPTISVDKAALFKELGRELSDIPLRNSMNCASSSTTNSDRPIVDGVQEPPQLKIEIPANRLVEPPSGELQKIIVKEDTSKIRPLVSGAILRNVTFDKARYESFIALQDKLHQNLARQRTLVSIGTHDLDTIKGPFSYEALPPKDIRFVPLNQTKEMDGEELMAFYDKDKHLGRYLHIIRDSPVYPVIYDANRTVCSLPPIINGEHSKITLNTKNVFIEITALDKTKVEIVNKIMVSMFSQYTSEPFTVEPVQIISEHNNETRVTPDIAPRTTQAEVSYINQCCGLQLSAEEICRLLTKMAYEATPSSTSPDLIDVHIPPTRADILHQADIMEDVAIAYGFNNLPRSFPSKSGTVAQPLPINKLSDIIRTEAAMAGWSEVLPLILCSHDENFAWLNRKDDGNTAVKLANPKTQEFQVVRTSLLPGLLKTIRENKSHSVPMKIFEVSDVAFKDLSMERKSRNERHFAAAWYSKTSGFEVVHGLLDRIMSMLKSAFIIGEEGLENAAVKDSQYWIEELDDPTYFHGHSASIHVRIAGKDHTIGTFGILHPTVLENYGLKYPVSTLEINIETFL

SEQ ID NO: 40753 - protein, 336 aa, Streptococcus uberis
MVVKVGINGFGRIGRLAFRRIQNVEGVEVTRINDLTDPNMLAHLLKYDTTQGRFDGTVEVKDGGFEVNGNFIKVSAEKDPENIDWATDGVEIVLEATGFFAKKAAAEKHLHANGAKKVVITAPGGDDVKTVVFNTNHDILDGTETVISGASCTTNCLAPMAKALQDNFGVKQGLMTTIHAYTGDQMILDGPHRGGDLRRARAGASNIVPNSTGAAKAIGLVIPELNGKLDGAAQRVPVPTGSVTELVAVLEKETSVEEINAAMKAAANDSYGYTEDPIVSSDIIGMAYGSLFDATQTKVQTVDGNQLVKVVSWYDNEMSYTAQLVRTLEYFAKIAK

SEQ ID NO: 40754 - protein, 594 aa, Nicotiana tabacum
MALPETQQDSKALPDAWDYKGRPALRSSSGGWASGAMILGVEAVERLTTLGIAVNLVTYLTGTMHLGNASSANNVTNFLGTSFMLTLLGGFVADTFLGRYLTIGIFATVQAMGVTILTISTIIPSLRPPKCEQVGSSSCIPANSKQLMVLYIALYMTALGTGGLKSSVSGFGTDQFDDSDKKEKGQMIKFFDWFFFFINVGSLGAVTVLVYIQDNLGREWGYGICACAIVIALVVFLFGTRKYRFKKLGGSPLTQIASVIVAAWKKRHLELPSDSSLLFEIDDIFGEGNKKSKQKLPHSKEYRFLDKAAIKEDDDLESNGTNVVINKWKLATLTDVEEVKILIRMLPTWATTIMFWTVYAQMTTFSVSQATTMDRHIGTFEIPPATLTVFFVGSILLTVIFYDRIIVPICRRFMNKPHGLTPLQRIFTGLVLSILAMIAAALTEVKRLKVAHLHGLTNDANATIPLTVFWLVPQFLLVGAGEAFTYIGQLDFFLRECPKGMKTMSTGLFLSTLALGFFFSSILVTIVHVVTGTTNPWLADNLNQGRLYDFYWLLAILSVFNLMFFLYSSRKYVYKEKRLAEMGIELEDDGPVCH

SEQ ID NO: 40755 - protein, 336 aa, Streptococcus parauberis
MVVKVGINGFGRIGRLAFRRIQNVEGVEVTRINDLTDPNMLAHLLKYDTTQGRFDGTVEVKDGGFDVNGKFIKVSAEKDPEQIDWATDGVEIVLEATGFFAKKAAAEKHLHENGAKKVVITAPGGDDVKTVVFNTNHDILDGTETVISGASCTTNCLAPMAKALQDNFGVKQGLMTTIHAYTGDQMLLDGPHRGGDLRRARAGANNIVPNSTGAAKAIGLVIPELNGKLDGAAQRVPVPTGSVTELVAVLNKETSVEEINSVMKAAANDSYGYTEDPIVSSDIVGMSFGSLFDATQTKVQTVDGNQLVKVVSWYDNEMSYTAQLDRTLEYFAKIAK

SEQ ID NO: 40756 - protein, 463 aa, Burkholderia thailandensis E264
MAKILENVEHIVVVMFENRSFDTMLGWLYPPGTQPAHVLPARGSPQFDGLKPDMSNPSRAGKTIAVTREATNNVIPDPQETFVNVTSQILGPGGAGNPWPPMQGFVVNYETTRTSDPGHVMQCHSVAQLPTLTALARAYAVSDAWFASVPSQTWPNRAFAHAGTSNGHVNNGAIPDPLEWDVPTIFDVLSSIGASWAVYSDTAVTPSLTHTMFPSLWNDKYADNFERFPDFVAACKNDALPRYAFVEPSFLFEPNDQHPPHDVLAGDKFLHDIWTAISTSPGWPRTLLVVTYDEHGGCFDHVLPPANATPPDAASNPGDETFEFDRFGVRVPAVVVSPYIEAGTVFRSPTNVPYDHTSILATLRDWLAIAPDKMLKSARIANAPTLAQLFTRSVPRGDLPAIAAPSADFVQPPPSAPLNDLQKSLVTGTSRRDGNDPAASVAPIATRQHALDFFTRRATAKPT

SEQ ID NO: 40757 - protein, 273 aa, Chromobacterium violaceum ATCC 12472
MTDRYAVIGNPISHSQSPFIHEEFARATGQDISYERLFADIGRFNDVVGEFVASGGKGLNITLPFKGDAFRYASELTERARAAEAVNTLTFRDGKVYGDNTDGVGLVRDIVENLDYPIVGRRVLILGAGGAVRGVLEPILEQKPASLTIANRTVIKAEALAHHFARYGKVEAVGYAALEGRSFDIVINATSTSLNNEMPPLPHGVFTPRTLAYDMVYSTGLTPFLQRAQGENAGMLADGLGMLVEQAAESFSIWRGAQPETRKVTNMLREVLA

SEQ ID NO: 40758 - protein, 142 aa, Oryza sativa (indica cultivar-group)
MATDGGKMVELISSDEEHFEVEEAVARLDHHAGDNGIPIPNVADNVIAKRYYMKHATLSSGTGDMKAMHEDELKKFDRVFIKVDNDTLRRLISAANVMGVKGLIDLACQRVADMLKAKRLKKMRQTSGINNHVREGEDPQVG

SEQ ID NO: 40759 - protein, 177 aa, Oryza sativa (indica cultivar-group)
MAAPVAPQETNAAAGEMVTLISSDGARFEVPEAAVRLSQTVLDEMKKDDYNAINGIPLPNVAGDVLAKVVEYCTKHASAAAAAINADTAKTSKEEEELMMKSFDDEFILVDNHMLYSLLTAADAMRIQGLMDLACQRLADMLKGKTSEQMRQTLGITNDFTPEEEEEFRREDEEQWL

SEQ ID NO: 40760 - protein, 472 aa, Chromobacterium violaceum ATCC 12472
MAVADVVKLIQENDVKFVDLRFTDTRGKEQHVSIPAHVLLEDADAWFERGHAFDGSSIAGWKGIQASDMLLIADPATARIDPFFDEPTVFMHCDVIDPADGKGYDRDPRSIAKRAEAYLKASGHGDTAYFGPEPEFFIFDGVTWGTDMSGCFVKIKAEEAAWASAEEFEGGNMGHRPGIKGGYFPVPPVDSSQDIRSAMVLLLEELGVPVEVHHHEVATAGQNEIGTKFSTLTQRADWTQILKYVVHNVAHSYGKTATFMPKPIVGDNGSGMHVHQSIWKDGKNLFAGEGYAGLSDTALYYIGGIIKHAKALNAITNPGTNSYKRLVPHYEAPVKLAYSAKNRSASIRIPHVASPKARRIEARFPDPLANPYLCFSALLMAGLDGIQNKIHPGDAADKNLYDLPPEEDKLIPTVCASLDEALAALDKDREFLTRGGVFSNEWIDAYIELKMQEVNLTRMTTHPVEFAMYYSL

SEQ ID NO: 40761 - protein, 239 aa, Prochlorococcus marinus str. MIT 9313
MPIISSTNIRRLRRPANIFCLGSTQAKKLKDQQKKMRQSSLLRFAKTLAAHYSNKEQAQKDPIHFARINIYFRPLLWDVFKGPGYYSEQSYDYDPWRPYRQGVHKLLANKEAFILENYSLQEPKRLAGAGFYPDLLNHLCADTLLPRRGCSMHFKEVKPNQYQGQVEPGNNCLVPRNNTMTYLVSEVEFDEKIWISRDRGFDPKTHEQLWGSKHGPLHFQRIVNLGDHLNESWLRSSSH

SEQ ID NO: 40762 - protein, 925 aa, Thiobacillus denitrificans ATCC 25259
MPDYRSWTTTRGRNMAGARALWRATGMKDGDFNKPIIAIANSFTQFVPGHVHLKDMGQLVAREVEAMGGVAKEFNTIAVDDGIAMGHGGMLYSLPSRDLIADSVEYMVNAHCADALVCISNCDKITPGMLNAALRLNIPTVFVSGGPMEAGKVVWEAKTIKLDLVDAMVSAADAKFSDAKVDELERSACPTCGSCSGMFTANSMNCLTEALGLSLPGNGSLLATHADRKSLFLAAARLIVKNARRYYDDGDTRVLPRSIASFDAFENAIALDIAMGGSTNTVLHLLAAAHEAGVDFTMADIDRMSRRVPHLSKVAPSIQTYHMEDVHRAGGVMAILGELERAGLVHRDVPTVLMKTLGEQIDVYDIRRTSDPDVKDYFRAAPGGVPTQTAFSQARRFATLDDDRVNGCIHDVEHAYSKDGGLAVLYGNIALDGCIVKTAGVDESIWKFSGPARVFESQDAAVEAILGDRIVAGDVVVIRYEGPRGGPGMQEMLYPTSYLKSKDLGKACALITDGRFSGGTSGLSIGHASPEAAEGGTIGLVEEGDTIEIDIPNRSIRLAVSDAELARRRAEMDARGAQAWKPVNRTRQVSAALRAYAAMTTSAAFGAVRDVSQVEHPTEAQEHADPRARFAIPGQLSFRTGAGGLVYADIDNAGGRATICLQGAHVVSFRPKSQHTPVIWVSDAAKFAPGKSIRGGAPVCWPWFGAHPSEASFPAHGFARTVEWQVVGSRKRNDARTEITLELLDNAQTRAQWPHPTRLTLTIVVGERLEMRLTTTNAGDAPIEVGEALHTYFQISDIGAVSVEGLEGGDYHDKVENFARKTQRGAVTFAGEVDRVYVDTPAECVIVDPGLARRIRIAKSGSHSTVVWSPWTAKAEQMGDLGQGKSGTGWREMVCVESGNAMDNVVTVAPGASHTLAVTYSVEAL

SEQ ID NO: 40763 - protein, 666 aa, Blastopirellula marina DSM 3645
MKLVKVAAAVVNQTPLDWQGNCDRILAAIEEANLNEASILCLPELCITGYGCEDAFLSADVQRTALAMLHMIAPRTRDMFVTLGLPMSYRGVLYNVVAVLADGEIVGFVPKQNLAGDGIHYEPRWFKPWPEGLRAEVELEGRTYPFGDLVFRIDDALIGLEICEDAWVADRPGSRQARIGVDIILNPSASHFAFGKHEIRQRFVLEGSRAFHTSYVYANLLGNEAGRAIYDGDAMIASGGRMLAIGSRLSFHAYLVTTAVIDLDLTRMYRARSDAFRPDYQGSLQPVVRVPFNLPEIEPEPVHFVRAAWETGSDTKKEEFTRAVALGLYDYLRKSHSRGYVVSLSGGADSAATALLCSLSLRMAAKELGFGALKESLQFIPAAKEAESIDALVTATLDCVYQATCNSGETTLQAAQQIAAAIHANFHHFQIDRLVELYTELGAQALGRPLSWATDDIALQNIQARTRSPSVWMLANLRGSLLLSTSNRSEAAVGYATMDGDTSGGLCPIAGIDKAFLRQWLNWMEITGPAGFGPTPELNAINVQAPTAELRPQESKQTDEDDLMPYELLDAIERAAIRDKQSPLETYRQMMALFPQYDEQQLAVWIERFFKLWSRNQWKRERYAPSFHLDDENLDPKTWCRFPILSGGFERELAEMWRAMRGEEEG

SEQ ID NO: 40764 - protein, 449 aa, Clostridium symbiosum
SKYVDRVIAEVEKKYADEPEFVQTVEEVLSSLGPVVDAHPEYEEVALLERMVIPERVIEFRVPWEDDNGKVHVNTGYRVQFNGAIGPYLGGLRFAPSVNLSIMKFLGFEQAFKDSLTTLPMGGAKGGSDFDPNGKSDREVMRFCQAFMTELYRHIGPDIDVPAGDLGVGARELGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVSGFEMSQNSERLSWTAEEVDSKLHQVMTDIHDGSAAAAERYGLGYNLVAGANIVGFQKIADAMMAQGIAW

SEQ ID NO: 40765 - protein, 135 aa, Glycine max
  misc_feature (128)..(128): Xaa can be any naturally occurring amino acid
  unsure (1)..(135): unsure at all Xaa locations
CTSENKEPEVKIVSLTIICPGRPDLILPIPFTSESKNSIFTLKEGSQYRLKFSFTVSNNIVSGLKYTNVVWKTGLRVDNTKKMLGTYSPSQEPYTYELEEETTPSGLFARGTYSARTKFVDDDHKCYXDTSYHFE

SEQ ID NO: 40766 - protein, 343 aa, Pyrobaculum aerophilum str. IM2
MLVLGVESTAHTFSLGLVLDGKILGQLGKTYLPPSGEGIHPREAADHHSKVAPVIFRQLLNAHGITASDIDVIAYAAGPGLGPALRIGAVFARALAIKLGVPLVPVHHGIAHIEVARYTTASCDPLVLLISGGHTLIAGFSEGRYRIFGETLDVAIGNAIDMFAREVGLGFPGVPAVEKCAESADRLVPFPMTIIGQDLSYAGLTTYALKLWKSGTPLPVVCKSLVEAAYYMLAEVTERALAFTKKRELVVAGGVARSKRLRGILEHVGREYGVAVKIVPDEYAGDNGAMIALTGYYAYRRGIRTTPEESFVKQRWRLDSVDIPWFYDLCEEVVLNTSTKRRP

SEQ ID NO: 40767 - protein, 215 aa, Ranunculus bulbosus
ALRHEMSVLCDAEVGLIIFSARGKLYEFASAGGMSRTLERYHKNSFSNQDSNLAIDRETQSWYQEVSKLKAKYESLQRSQRHLLGEDLGPLNVKELQNLEKQLEGALAQARSRKTQIMLEQMEALRRKERELGDMNKQLKNKYQLEAEGQGSLRAMQGSWESNALNNYSGHPSHSSSMDCEPTLQIGYHQYVSADGGPIQRNNAGENNFIQGWEL

SEQ ID NO: 40768 - protein, 365 aa, Gentiana triflora
MGSLLPSRVESLAISGIKTIPKEYIRPKEELASIGNIFEEAKNNNKTSQIVPTIDLKDMDSLDNNKDVQTQCHDELKNAAMEWGVMNLVNHGISQELINRVKSAGQAFFDLPIEEKEKYANDQASGNVQGYGSRLANNASGQLEWEDYFFHCIYPERKRDMSIWPKTPHDYIPATIEYAKQLRDLATKVLAVLSVGLGLEPDRLENEVGGMEEMILQKKINYYPKCPQPELALGVEAHTDVSALTFILHNMVPGLQLFYQGKWITAKCVPDSIIMHVGDTLEILSNGKYKSILHRGLVNKEKVRISWAVFCEPPKDKIILKPLPETVSEIEPARFPPRTFAEHIKHKIFRKTEEAIKDNNIANGN

SEQ ID NO: 40769 - protein, 232 aa, Syringa vulgaris
  misc_feature (231)..(231): Xaa can be any naturally occurring amino acid
  unsure (1)..(232): unsure at all Xaa locations
RMENKINRQVTFAKRRNGLLKKAYELSVLCDAEVALIIFSNRGKLYEFCSSSSMLRTLERYEKCNYGAPEPHVSSREALELSSQQEYLKLKARYEALQRSQRNLLGEDLGPLNSKELESLERQLDMSLKQIRSTRTQAMLDTLTDLQRKEHALNEANQSLKQRLMEGNHISLQWNQDPEEVGYGREPTQHQPHGFFHPLECEPTLQIGYQNDPMAAAGPSLNNFMSGWLPXI

SEQ ID NO: 40770 - protein, 1489 aa, Candida glabrata CBS 138
MSVLIPHQQQRLRASSAAKKAAWNAMNKTVNIVSPHNNVNYVKKPSPKTNSNHLDRVIKSVNDATKRLSEAESINSNNTKSSKRKSRDTVGPWKLGKTLGKGSSGRVRLAKNIENGTLAAIKIVPKRTYNRRMRDQKMKTAGGVSSGTDSKDSSNREDPIKNGTDSALNPYGIEREIVIMKLISHPNVMGLLEVWENKSELYLVLEYVDGGELFDYLVSKGKLSEPEAVHYFTQIIQGVSYCHSFNICHRDLKPENLLLDKKNKVIKIADFGMAALELPNKLLETSCGSPHYASPEIVMGKPYHGGPSDVWSCGIILFALLTGHLPFNDDNIKKLLLKVQAGRFQLPPYLTNDAKDLITRILVTNPEKRLTINEILNHPLIKKYRNPPAHIRKLNLLGRGKSNSDLHVLEYNTPATVCLNSEEDIDQSILKSLQILWHGTPRQRLVERLLVEGATEEKLFYSLLFQYKLKHSKPISATKLQKKIEDVVLENESTKTESKDSSNEPGIDNNNDTSDFTQDGNSSEMVNELHTSAPMLEQKSQFSQHSLKSKETVPISDLPPLPPVIPTFAASSSKAFRRSKSNLSSYLKRPKLENARSRTSLFNSSSNTSITSSSISELNTRPRGNIPLSPSNITLTSLVSSRSLHNSASKKSLKNLQKRTLQNSESKRSLYSQTSISKRSLNLNDYLIGGPSNSAELPPLPKLDSNNEFEMLCDKILNTSALDNILEEEEEDITPSKNTTQTNDVHNEDTIIRKEMHDFEINVNNHQPEFKRQPSDFSVNGPDTSIFSIEPMPEGLGISKKPVRVQPTFNFIIDEDKVDDSIKVKQVSGTGPSNNVLKDISNQINNGKGIENSKLHPTSNNNYKNIRNVTAPEGNFTSKTFSLDPRRNVSQPPKESLFHSLLNNKSSKNAEENTQFESKSKQYNFMNKTAHSEFEKERLNAHRDADRSNDQNVYNETSVLAQSSTIHESPLLSIPSTLLNTSMTFKNLVDMLQENKLDDINETVAKESSAPLRKKSTKLSLAPHSNLVSDLNKRTSGYNTLASVDRSSSDLSYAIDLPTNTNIAEIVYLSGNNKQSSEKNIFMLSNDNNETELFHTDENKTSIKSAVNIFEDPPSDSTSLQTSSSESDSIPKVQRKAVSIETLNASNIITPAADVRVSLYGNNVSNSNTMPRETTEELISRFKLTPEKPQHQVQKRFSSLTQTGRNTDSIALSQSMISMFKDAEENGNNKSVKVLDQVEEENASKLTPTSPKNRVTMLFDDYEAQQNITSDQSNKSSKVIEIPNDSPIKVKVQKASTIFEKEIISAAEADENDHLRIPYESKSKKEIAQVHQQEQKEQQVRKPTESQEKAVQKTTKPSWFSKLIHGFKTTGGSGHTKLIREHSTKMTFEEVHMITVKEFGNNGIDYQLRTLDKKGDREKVEYDCKFVKGNFEFKIKIFNSGFPHQNTIITVKKKGKINSKETTDLFQRFNANIENLIKSAERNIESNPK

SEQ ID NO: 40771 - protein, 207 aa, Syringa vulgaris
ALVQLRRMENKINRQVTFAKRRNGLLKKAYELSVLCDAEVALIIFSNRGKLYEFCSTSNMLKTLERYQKCSYGSLEVNNSTRDLEESSNREYLKLKSKYESLQRHQRHLLGDELGPLNINDLEHLEHQLETSLKHIRSTRTQVMVDQLSDLQAKEKMMVETNTALERKLEEIYAANQLQQSWAGGEQSCAYSQQHLNLRTFFNLWMQ

SEQ ID NO: 40772 - protein, 524 aa, Gentiana triflora
MEMNPSPFIVHTAVFGLFVVFIFIFLKLVSRKKGHGRSLPLPPGPRPWPILGNIPHLGSKPHQTLAEMAKTYGPLMHLKFGLKDAVVASSASVAEQFLKKHDVNFSNRPPNSGAKHIAYNYQDLVFAPYGPRWRLLRKICSVHLFSSKALDDFQHVRHEEICILIRAIASGGHAPVNLGKLLGVCTTNALARVMLGRRVFEGDGGENPHADEFKSMVVEIMVLAGAFNLGDFIPVLDWFDLQGIAGKMKKLHARFDKFLNGILEDRKSNGSNGAEQYVDLLSVLISLQDSNIDGGDEGTKLTDTEIKALLLNLFIAGTDTSSSTVEWAMAELIRNPKLLVQAQEELDRVVGPNRFVTESDLPQLTFLQAVIKETFRLHPSTPLSLPRMAAEDCEINGYYVSEGSTLLVNVWAIARDPNAWANPLDFNPTRFLAGGEKPNVDVKGNDFEVIPFGAGRRICAGMSLGIRMVQLVTASLVHSFDWALLDGLKPEKLDMEEGYGLTLQRASPLIVHPKPRLSAQVYCM

SEQ ID NO: 40773 - protein, 530 aa, Gentiana triflora
MMLLDFFYSASIFVLSILLFRAIYTTKNRRLRLPPSPFGLPIIGHLHLLGPKIHHSFHNLYKRYGPIFHLRLGSNRCIVVSTPELAKEFLKTHELDFAYRKNSSAISLLTYHVSFAFAPYGPYWKYIKKITTYQLLGNRNLTHFEPIRRLETNRVLYDLMVSSKHGKSVNLTEEMIKLTSNIISQMMLSIRCSDTESGATNVRNVIRDVTELFGEFDVSDIIWFCKNTDLQGIKKRANGIHERYDALLEKIISDRERTRIVEKKNSGAGGGSGDGERNDFLDILMDAMEDDTSEVKLSRNHIKAIILDFLTAATDTTAISLEWALSELINNPRVLKKAQEEINNVVGNQRLVKELDTPNFPYIKAIIKETFRLHPPIPMVIRKSANDIQVAGYDVPKNTMLFVNIWSIGRNPSYWEKASEFSPERFLADTDGGGLSHMDINGQYFELMPFGTGRRGCPGMPLAMQELPTVLSLMIQCFDYIPLDFKGEKAERVMDMSERPGLTAPRANELMCLLKPRIDLPNLLGNVKGE

SEQ ID NO: 40774 - protein, 132 aa, Zea mays
MRKHRIVSLVAALLVLLALAAVSSTRSAQKESVADNAGMLAGGIKDVPANENDLQLQELARFAVNEHNQKANALLGFEKLVKAKTQVVAGTMYYLTIEVKDGEVNKLYEAKVWEKPWENFKQLQEFKPRVFS

SEQ ID NO: 40775 - protein, 363 aa, Shewanella sp. MR-7
MNPVFTPNVAQKILFIDRDGTLIEEPITDKQVDSLAKLVFEPQVIPALLRLQKAGFRLVMVSNQDGLGTPSFPQEDFDAPHNMMMQILSSQGVRFEDVLICPHFNDENCSCRKPKLGLVKDFLTQGTIDFTQSAVIGDRHTDVELGNAMGIKSFQYQRGSLGWDAIADALLNKGRTATVVRTTKETDIRVTVDLDNASKGAINTGIGFFDHMLDQIATHGNFKMEVNVDGDLEIDDHHSVEDTALAIGDALRQALGDKRGIARFGFSLPMDEAKGECLLDLSGRPFIKFAAQFEREKVGEMATEMVPHFFRSFADGLRCTLHVAAEGDNDHHKVEALFKVLGRALRQAVKVEGDVLPSSKGVL

SEQ ID NO: 40776 - protein, 389 aa, Coprinopsis cinerea okayama7#130
MAPATQSTTAAVLRAGKPRELLIEHRPLFPPQPHQVTVDVVATGLCGSDLHYFEHGRNGDFRVRQDIVLGHEAGGIVTAVGSAVTNVVVGQRVAIEAGIYCRNCDFCHRGRYNLCKHMKFCSSASVFPHNDGTLQTKMNHPAFVVHPLPDACSFEDAALAEPLSVLIHATRRAQFEPGHTVLVYGVGTIGLLACALAKSKGASRVVAVDINESRLQFAKLNGFADDVYCSAGQPPDDSAQPQTLQEREQQQMQRAKTGAQKVLSIFDNPQGFDVVYECTGALPAIQQSIYTAVTGGKVMLIGMGSRNVTLPLSAAACREVDIHGSFRYCNTYPEALALLASGTLPNIDKLVTHRFPLEQAQRAFELMSAGQDEHGNMVIKVMVGSGVPS

SEQ ID NO: 40777 - protein, 168 aa, Oryza sativa (indica cultivar-group)
MAAANDGADAGDSKILLISSDGQHFQVTEAEASMSKLVSNMIEDDCTENGVPVPNVASNVLAKVLDYCKKHAAAAAAAAAEDVAVKDQELKSFDASFIDVDNTMLFGLILAANYLNVPSLLDLACQHTADLIKGKTVQDIRDTFGIVNDFTPEEEEEIRKENEWAFEN

SEQ ID NO: 40778 - protein, 265 aa, Pseudomonas aeruginosa UCBPP-PA14
MNEQIGNGVALITGASSGIGATYAEHLARRGHDLLLVARDRQRLEALADRLRQAHGVRVEILRADLSERDDRLRVERRLRDDASIALLVNNAGVAMNGPLADADMDRAERMIALNVVALTRLAAGAAEGFRRRGGGAIVNLGSVVALAPELFNAVYSATKAYVLSLSQSLQHELAGSGVYVQAVLPGVTRTEIWERSGTGIAGIPAEMVMEVEDLVEAALVGFDRREAVTIPSLPDAADWQALMTARARLAPNLSRQRPAERYLG

SEQ ID NO: 40779 - protein, 219 aa, Shewanella sp. MR-7
MTTGTTSSCCQGPVNTELVNSLDWEKQQGLIPAVIQNHLSGKVLMLGFMDKAALQHTLATGDVTFFSRSKQRLWTKGETSGHTLKLVAIDKDCDNDSLLVQVLPNGPTCHKGTESCWRDGNAHPFLNNLAELIASRKGQNPESSYTASLFARGTKRIAQKVGEEGLETALAAATHDKEELINEASDLVYHLLVLLEDQSLSLSDINANLLARHQKAQQK

SEQ ID NO: 40780 - protein, 229 aa, Coprinopsis cinerea okayama7#130
MASMDMDKSLDEIIASKPKGGRRGGAGGAARRRSTGRQQILGKAAPAPAQKTRAAAAAVQPGKVTAAQPALADKIIVSNLPIDVNEAQVKELFASTVGPLRDVTLHYDANGKSKGVAAVHFSRKGDANKAYTQYNNRLIDGKRPMKIEIVVDPIKAVPLSARVAPPAAAAPAATRGGPAARRRRGGRGGGAGAKRSERPQKTAADLDAEMEDYTAAASAPAAAPAAAAA

SEQ ID NO: 40781 - protein, 165 aa, Oryza sativa (indica cultivar-group)
MATVKEGADAGDSKILLISSDGQHFQVTEAEASMSKLVSNMIEDGCTENGVPLPNVASNVLAKVLEYCKKHAAAAAAEDVAVKDQELKSFDASFIDVDNTMLFNLILAANYLNVPSLLDLACQHTADLIKGKTVQEIRDMFGIVNDFTPEEEEEIRKENEWAFEN

SEQ ID NO: 40782 - protein, 164 aa, Oryza sativa (indica cultivar-group)
MAAADGTTGEEVKKTIDLVSKDGERFEVARDAALLCKTLRWMIKGGYGRIPLPNVASPILARVVDYLARHAAAAAAAAAAMDDDGLDRFDRDFLAGVDQDTLFDLLLAANYLQADGLLDLACKKVAAMMTGKSPEQMREIFHIVNDLTPEEEKEIREDIAWALN

SEQ ID NO: 40783 - protein, 509 aa, Oryza sativa (indica cultivar-group)
MDELFYQSLLLSVAAVTVLQLLKLLLVRHRRPRTPPGPWRLPVIGSMHHLVNVLPHRKLRELAAVHGPLMMLQLGETPLVVATSKETARAVLKTHDTNFATRPRLLAGEIVGYEWADILFSPSGDYWRKLRQLCAAEILSPKRVLSFRHIREDEVMMRVNEIRAAGPTTPVNLSVMFHSVTNSIVSRAAFGKKRKNAAEFLAAIKSGVGLASGFNIPDLFPTWTGILATVTGMKRSLRAIYTTVDGILEEIIAERKGIRDEKISGGAENVDENLVDVLIGLQGKGGFGFHLDNSKIKAIILDMFAGGTGTSASAMEWGMSELMRNPSVMKKLQAEIREVLRGKTTVTEADMQAGNLRYLKMVIREALRLHPPAPLLVPRESIDVCELDGYTIPAKSRVIINAWAIGRDPKYWDNPEEFRPERFEDGTLDFTGSNYEFIPFGSGRRMCPGFNYGLASMELMFTGLLYHFDWSLPEGVNEVDMAEAPGLGVRRRSPLMLCATPFVPVVSAN

SEQ ID NO: 40784 - protein, 567 aa, Dioscorea tokoro
  misc_feature (238)..(238): Xaa can be any naturally occurring amino acid
  misc_feature (303)..(303): Xaa can be any naturally occurring amino acid
  unsure (1)..(567): unsure at all Xaa locations
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPXAVSKHMVAVSTNLTLVEKFGIDPANAFAFWDWVGGRYSVCSAVGVLPLSLQYGFSVVHKFLNGAXSIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPBHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 40785 - protein, 328 aa, Hordeum vulgare
MCGGAILAQLIPPSAGRPSKQAAAGGRAPPTSSKKGGVSKSRHSSTPDADDDVFEAAFEDFDDHFDLRAEEDGGDDHVVFASKPAFSPRPAYDGGRAAHAASRKKRTGHLHGIRQRPWGKWAAEIRDPHKGTRVWLGTFDTADDAARAYDVAARRLRGSKAKVNFPDAARTGARPRRASRRTAQKPQCPPARTTAYSATAAARAQPEQDAMMVKPELMEFFNVDAIVHLTTAVAALPPVTASTFADTMPRVDEDSSVGSGGGAMLGFADELGFDPFMMFQLPCSDMYESADSIFAGDAVIPDALSVDSGMDAVSLWSFDEFPMDSAIF

SEQ ID NO: 40786 - protein, 492 aa, Aspergillus nidulans FGSC A4
MSLASLKRKDLFQQHGLIGDKWVSSSGGGTFTVTNPATLETLATLPEMNGADTESAITAAHTAFQSFRKTTARQRATWLRKWHALCVENIDDLALILTVENGKTLAEAKGEVLYAASFLEWFAGEAERVHGEVVPASNANQRILTVKQPLGVAACLAPWNFPIAMITRKVGAALAAGCTTVWKPAGETPLSALAQAVLAREAGFPSGTINVITTLNSVAEVGAALCNSKLVRKLSFTGSTRIGKLLASQCSQNLTKLSLELGGNSPFIVFDDAKVETAVEACILAKFRNSGQTCVTANRIFVQEGIYDRFSAALVEKVKALKVGNGVEEGVIIGPLTHERAVEKAVAHIKDAQEKGASLLLGGSPCQPNNLPGYFLEPTVLGKMSTEALTTREEVFAPVVALYPFKTEEEVLAKANDCDVGLGSYVITESMPRMWRVAESLEVGMVGINMGTLSAAESPFGGVKESGYGREGGRQGIEEYMTVKSILMNVAA

SEQ ID NO: 40787 - protein, 315 aa, Candida glabrata CBS 138
MPLVLMCGFPLSGKSTVARELAGYLREKGANVVVHSDETLGHKGRETREEDYNDTHAERKLRNEIMSAVRRDLSRSTIVIVDSLNYIKGFRYQLHCECKNSNTGFMLVHCMATYADILKRDENGEESPRWGKELLDQLIQRFEEPDASNRWDSPMATVVSPETLLPTHKQLVDQVLLGISDKSSSRNGSPSPGPMNRLSQNNPTLLKAATGADFVRLLDAKLTETVRIIVRECQAAQAIGGPQRIIVSEDVRDINDDRCLFLDIPADAPQLTLPRLNRLKRQFVQMNKNLRDVDLERAAPLFVAYIGQTLQSGLA

SEQ ID NO: 40788 - protein, 513 aa, Triticum aestivum
  misc_feature (391)..(391): Xaa can be any naturally occurring amino acid
  unsure (1)..(513): unsure at all Xaa locations
MCRTLVRRTPNCTKEAMVAMAVFAPWLSWLVVSLLSFYLLNLLAHARSGLPPGPRPLPLIGSLHLLGDKPHRSLAHLAKIHGPLMSIRLGAVTTVVVSSPAMAREFLQRHDSVLATRSVPDATGKHAAGVAWLPPGPRWRALRKIMATELFAPHRLDALHHLRSDKVWELTDHVARLAREGTAVNVGRVAFTTSLNLISRTIFSIDLTSLDDHGGSEDFQGVITAMMEGLGTPNVSDFFPVLAPADLQGMRRRLARIFARLHAVLDAEVDKRLRGRHAGQPRKNDYLDVLLDVAARDEGKDLLDRDTLRSQFTDLFAAGSDTSSSTVEWAMAELLRNPSSMVKVCDELAQVIGSRRNIEEADIVRLPYLQAVIKETFRLHPPAPLLLPRQXMTVKIAGYTIPKGSRVFINVWAIGRDKDVWAEPETFMPERFLGSAIDFRGVDFELLPFGAGRRICPGMTLAIRMVHVMLASLLNQFKWSLPIELERDGIDMEDHFGLTLVKNVPLCIIATPI

SEQ ID NO: 40789 - protein, 812 aa, Xanthobacter autotrophicus Py2
MTNSWTDIKNTDLVVIMGGNAAEAHPCGFKWVTEAKANRGAKLVVVDPRFTRSAAVADYYAPIRQGTDIAFLLGVINYCIKNDKIQWDYVKAFTNAGYIVKEGFGYQDGLFTGYDEMKRDYNRSSWDYEIGADGYAVVDDTLQNPRCVWNLLKQHVSVYTPEMVERITGTPKDKFLKVASMIAECSSPTKTMTSMYALGWTQHSKGSQNIRCMAMLQLILGNIGVRGGGMNALRGHSNIQGLTDIGLMSNLIPGYLTIPTEKEPDLNAYMSTRGFKPLRPGQMSYWQNYRKFFVSFQKSMWGQSATAENNWAFDYLPKLDVPSYDVLRAFELMKQGKMNVYFCQGFNPLQAFPNKAKLAEALAKLKLLVVMDPLETETARFWENHGVYNPADPSKISTEVIQLPTTCFAEDNGSLVNSGRWLQWHWAAGSPPGEAKTDIFIMAQLHLRLKEMYKKEGGAFPDPIVNLTWNYKDPHDPAPEELAKEMNGYVISDVLDPNDPTKKVLEAGKQLASFGLLRDDGSTAAGCWIYTGSYTEAGNMMARRDNSDPDDTGAYLKWAFAWPANRRIIYNRASCNIDGQPWDDTRKLIWWDGAKWTGYDVPDIAPTAKPQDVGPFIMNPEGVSRLFTRGMMRDGPFPVHYEPFESPVANLIAPKVRGNPVARVFKDDFAQFADTASKEFPYAATSYRLTEHFHYWTKNNHVNSVLQPEFFVEISEELAKEKNIANAGWVRVWSKRGSVFAKAYVTKRIRPLMVDGKPVHVVGIPIHWGFVGAAKKGFPANVLTPFVGDANIETPEFKAFLVNIEPSTGPVA

SEQ ID NO: 40790 - protein, 181 aa, Alteromonadales bacterium TW-7
MTQVTPAIIKNSIATIADYPKAGIMFRDVTTLMANPEAFKATIDAFITEYKDQGFTKIIGTESRGFIFGAPLSYALGIPFIPVRKPGKLPREVIRQDYLLEYGEDTLELHVDAIVPGDKVLLVDDLLATGGTIEATAKLVNKLGGEATDAAFVVSLPELGGEQRIEKMGIKILKLVEFEGE

SEQ ID NO: 40791 - protein, 199 aa, Xanthobacter autotrophicus Py2
MNMELSRRQFLKTAGAGVAATTLGAMGFGAIEEAYASTIKPFRLVNTTEVRNTCTYCSVACGILIFSKGNLAKGEKADITHIEGDSDHPTNRGTLCPKGAALLDIVKSATRLKEPMIRRAGSDKFEKISWNEALDKIARAMKTDRDANFIAKNQDGVTVNRWLTTGFLAASATTNETAFATYKVVRSTGILAFDNQARV

SEQ ID NO: 40792 - protein, 176 aa, Populus alba
MFPMVTGFMNYGQQTIRAARYIGQSFMTTLSHVNRLPVTIQYPYEKLITSERFRGRIHFEFDKCIACEVCVRVCPIDLPVVDWELETNIRKKRLLNYSIDFGICIFCGNCVEYCPTNCLSMTEEYELSTYNRHELNYNQIALGRLPMSVIDDYTIRTILNSPQSLIKMGKPPLIKD

SEQ ID NO: 40793 - protein, 393 aa, Populus alba
MNVPATRKDFMIVNMGPHHPSMHGVLRLILSLDGEDVIDCEPILGYLHRGMEKIAENRTIIQYLPYVTRWDYLATMFTEAITINGPEQLGNIQVPKRASYIRVIMLELSRIASHLLWLGPFMADIGGQTPFFYIFRERELIYDLFEAATGMRMMHNYFRIGGVAADLPHGWLDKCLDFCDYFLTGVAEYQKLITRNPIFLERVEGIGIVSAEEAINWGLSGPMLRASGVRWDLRKVDHYECYDEFDWGVQWQKEGDSLARYLVRIGEMTESVKIIQQALEGIPGGPYENLETRSFDRERNREWNDFEYRFISKKTSPAFELPKQELYVRVEAPKGELGIFLIGDQSSFPWRWKIRPPGFINLQILPQLIKRMKLADIMTILGSIDIIMGEVDR

SEQ ID NO: 40794 - protein, 537 aa, Chengiopanax sciadophylloides
MASTQLQFMASMGNGNTSSNAPLIENTDSNQIIVPDKTSWKNLSAYMGPGFLVSIAYIDPGNFETDLQSGAQYKYELLWIILVASCAALIIQSLAANLGVVSGKHLAEHCRTEYEKVPNFILWILAEISIVACDIPEVIGTAFALNMLFDIPEWIGVLLTGFSTLVLLALQQYGVRKLEFLIAFLVFTIAACFLVELGYAKPNASEVLYGLFVPQLQGSGSTLLAISLLGAMVMPHNLFLHSALVLSRKIPRSVNGIKEACRFYMVESGFALVLALLINVSVIAVSGSVCSSSNLNPDDQKSCQNLDLNKASFLLKNVLGSWSSKLFAIALLASGQSSTITGTYAGQYVMQGFLDLRLKPWIRNFLTRCLAIVPSLIVALIGGSAGAGKLIIIASMILSFELPFALIPLLKSTSSKTKMGAYANSTMISATTWTIGSLIMGINIYFLVDHLIELLIHSQLKLVDKVLCGILGFLGTLVYLAGIGYLVLRKNRESSHLLALTTPESRQSEAGNTSVYSLPREDIVSMQLPQRGRADVD

SEQ ID NO: 40795 - protein, 394 aa, Nostoc punctiforme PCC 73102
MTRLETRTEPMVLNMGPHHPSMHGVLRLIMTLDGEDVVDCEPVIGYLHRGMEKIAENRTNVMYVPYVSRWDYAAGMFNEAVTVNAPEKLAGVAVPKRASYIRVIMLELNRIANHLLWFGPFLADVGAQTPFFYQFREREMIYDLWEAATGYRMVNNNYFRVGGVAADLPYGWVDKCLEFCDYLLPKVDEYERLVTDNPIFRRRVEGIGTITREEAINWGLSGPMLRASGVQWDLRKVDHYECYDDFDWDVQWETAGDCFARYVVRMREMRESVKIIRQAIKGLPGGPYENLEAKRLAAGKKSEWDAFDYQFIGKKVSPTFKIPKGEIYARVESGKGELGIYLVGDDNVFPARWKIRAADFNNLQIVPHLLRGMKVADIVVILGSVDVIMGSVDR

SEQ ID NO: 40796 - protein, 547 aa, Erythrobacter sp. NAP1
MYKYDNYDQQMVDARVEEFRDQARRRLEGKLTEDQFKPLRLMNGLYLQLHAYMLRVAIPYGTLNSEQMIALGDIADKYDRGYGHFTTRQNLQYNWIKLEDAADILADLAKVEMHAIQTSGNCIRNISSDHFAGAAHDELVDPRPYAELLRQWSSFHPEFTYLPRKFKIAVIAAEKDRAAMRLHDIGIQIVKNDAKDGGSEIGARFFVGGGMGRTPMVAPMIRDFVPLDQLITYAEACLRVYNRYGRRDNKYKARIKILVHELGKDEYTRQVEEEFAHLLKQGVEPPREELERIKPYFSDPAFEDGPKSVDRSDPDFAVWVDRNTHRHKHDSYVSAVISLKPVGGIPGDATGEQMRLMARLAKQYSFDELRIMHTQNVVLPHVKIGDLHALWTELEAAGLGSPNMDTIEDMIACPGLDYCSLANARSIPLAQRISERFDASGKTSKLGELKLKISGCINACGHHHAGHIGILGVDRKGVENYQLSLGGSEAEDVSLAKITGPGFTEDGVIEAVDTVTNVYLANKQGEERFLDTYRRIGMEPFKEALYG

SEQ ID NO: 40797 - protein, 279 aa, Methanothermobacter thermautotrophicus
GSGSRMKTVDKSKTLTKFEEFFSLQDYKDRVFEAIEKYPNVRSIEVDYLDLEMFDPDLADLLIEKPDDVIRAAQQAIRNIDRLRKNVDLNIRFSGISNVIPLRELRSKFIGKFVAVDGIVRKTDEIRPRIVKAVFECRGCMRHHAVTQSTNMITEPSLCSECGGRSFRLLQDESEFLDTQTLKLQEPLENLSGGEQPRQITVVLEDDLVDTLTPGDIVRVTGTLRTVRDERTKRFKNFIYGNYTEFLEQEFEELQISEEDEEKIKELAGDPNIYEKIIR

SEQ ID NO: 40798 - protein, 221 aa, Yarrowia lipolytica CLIB122
MTRRIASIRRETKETKIQIAISIDGGALELPGPTMLPEGADVSHAYQKTDTQHISVWTGVAFFDHMLHALAKHSGWSLLVECIGDVHVDDHHTVEDTAIALGGCFKEALGHLRGIKRYGYAYAPLDEALSRCVVDLSNRAYCVTELGLKRERVGQLSCEMVPHIFESFAHSAAITIHVDVIRGANDHHRIESAFKATALALRMASSITFGDEVPSTKGVLR

SEQ ID NO: 40799 - protein, 377 aa, Streptomyces avermitilis MA-4680
MKAVVYKGAFDVAVEDVEKPSIQHPNDVIVRITSTAICGSDLHMYEGRTAAEPGIVFGHENMGIIEELGQGVTALKEGDRVVMPFNVACGFCTNCVDGFTGYCLTVNPGFAGGAYGYVAMGPWQGGQAEYIRVPYADFNCLKLPPGNEHESDFILLADIFPTGYHGCELAQVRPGESVAVYGGGPVGLMAAYSALLRGAKKVFVVDRVLERLQKAEEMGAVPINFAEGDPIAQIKEQTEGIGTDKGVDAVGYQAMAHGTDREEPATVLNSLVGTVRPTGALGVPGLYVPADPGGPDEQAKQGMLLVAIGKLFEKGLRVGTGQCNVKRYNRYLRGMITEGRAKPSFVVSHELPLDQAPSAYDKFDKRIEGYTKVVLHP

SEQ ID NO: 40800 - protein, 439 aa, Bacillus cereus G9241
MAVENITMPQLGESVTEGTISKWLVNVGDHVNKYDPLAEVMTDKVNAEVPSSFTGIVKELIAGEGDTLAVGEVVCVIQVEGADEVAATAVEEKTKEEPKAEVATPEKAPKAKQPTDGKPRFSPAVLKLAGEHNVDLDLVEGTGANGRITRKDILKLVESGNIPQAGAAKKEEAVAAVVEARPEAPKAAPVAQKVEAVKPVSVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEDELFVPVIKHADEKTIKGIAREITELAGKVRTKSLKADEMQGGTFTINNTGSFGSVQSMGIINYPQAAILQVESIVKRPVIMENGMFGARDMVNLCLSLDHRVLDGLICGKFLGRVKEILENTSENNTSVY

SEQ ID NO: 40801 - protein, 1422 aa, Magnaporthe grisea 70-15
MAPTSNKAIIFKKAPEGFPKPGEDLVIEDRPLELVAPEGGVVAQVLYASFDPYQRGRLRKPEVKSYFPAMTIGQPLENTSLLRVLESKSERFAKGDVLKHSLCPNQQYVVLSAEQAQQQSIFKVEESSEFELAHHLGVLGMPGLTAYASLFEIGKPKKGETILVSSAAGAVGQVVGQLAKREGLTVIGSVGSDDKVEYCKELGFDHVFNYKKESPDAALTRLAPNGIDIYYENVGGEHLEAALKHMNKYGRIPTCGMISEYNVKPEDQKGIKGLMNIVSKEITMRGFLYQSIAGPWAAKFKEDVTKGLKDGSIKAKLHVVEGIENGPEGFVGMLRAPWTGHRMEEENCGYRVENRDERIASGLGFAKQLARQAAARSVGSATVETASSHSTDAAKPVTAVHTLPPSPPCKPIKRRRGARASSPCSQAAEQLDLPSLDSSEFKVEDGADSTMLICDELSDPESSAQTVMHPPCNPKSNMAAARPIAVDLSLVPDSALFVIDKVGGSLKPVLDPAQSALVDRIVRGENVFFTGSAGSGKSTVLKAFVERLRRAGKRVDVVAPTGRAALEVEGSTVHSYAGWDATALSLEQATGRAHTRSVKKRLRRTDVLVIDEISMVSSFMFDLLSHVMQTARHGDERPFGGAQVVVSGDFFQLPPVKPFENCYFCGRELQIDGRSGNLRLCPGTQFETKRQVCRKPRFFDERDMWAFCSSAWRQCKFGCVELQTIHRQRDNTLIRILQKCRTGYHLDQSEIDLLSAPRPHIVDATQLLPKREDVLRENETRYNNLPKDSERQYQSVDSVEDCPDNLYKSFSSRLEHHKFLDCLKLRTGMVIILRSNISPKQGLVNGSQGIVIGFANIDPKRLPRVAEVDDNGAPISPQGQPILYSTYAMLQVAKICEFVDQADKKQWPVVRFHNGLTRLIMAECSVNKYYIPEQRLPVLVCRTQIPLMAGWAMTVHRSQGMTMDRVVVDLAKAFERGQAYVALSRTRTLEGLQLKGKTDALSRPFSADPQVRDFYQRHFGYVTRGLVKADEDDDGIERTYGLKEALTTEDASASQQSFGTPRPPPKRAAQQQTQHRLEEDLVLSAIKAITGGMSKLPTPPQPHNNETLISSRLYSSSPHFNIKMRFSNFLVGLAPLAAASPLVARQNNQAAAQVALIGGTVESIGVRSNGNLLVSRLDNGQIFSVDMSNRRPSLLVPSLGPNINQAGSMVEIGNDVWYVVGGRANVPGSYGIYKIDLGNTTAGQSVPASTVATIQGSRMLNGLTRGWNDDTLLVGDTLAGMVYRVTISSGEVSAVISNDQALAPGQTVGFGIDGMKYVNNTLFFTNIGKQTFNKISIDDQGKPGSVVQIFSGTPGDDFTFNEAGDAFMATNFQNSVIKVSPEGNITKLATVQGSTCTAFGKTDSTKNMLFVGSGAQVVSLTI

SEQ ID NO: 40802 - protein, 327 aa, Bacillus cereus G9241
MAVMSYIDAITLAMREEMERDEKVFVLGEDVGKKGGVFKATHGLYDQFGEERALDTPLAESAIAGVAIGAAMYGMRPIAEMQFADFIMPAVNQIVSEAAKIRYRSNNDWTCPITVRAPFGGGVHGALYHSQSVEAMFANQPGLKIVIPSTPYDAKGLLKAAIRDEDPVLFFEHKRAYRLIKGEVPEDDYVLPIGKADVKREGDDITVITYGLCVHFALQAAEKLAQDGISAHILDLRTVYPLDKEAIIEAASKTGKVLLVTEDNKEGSIMSEVAAIIAENCLFDLDAPIARLAGPDVPAMPYAPTMEKFFMVNPDKVEKAMRELAEF

SEQ ID NO: 40803 - protein, 441 aa, Oryza sativa (japonica cultivar-group)
MGYWADNILGFFLGREYFGLKGPIRSSFRPAFSPQLTLVSSHLSCPLTSLQNPTVAAAPAAMTSSPAARRRPPGPLALGLESSANKIGIGVVSLSGEILSNPRHTYVTPPGHGFLPRETAHHHLAHLLPLLRAALGEAGVTPADLACVCYTKGPGMGAPLQVAAAAARALSLLWGKPLVGVNHCVAHVEMGRAVTGAVDPVVLYVSGGNTQVIAYSEGRYRIFGETIDIAVGNCLDRFARVLELSNDPSPGYNIEQLAKKGEKFIDLPYVVKGMDVSFSGILSFIEATAIEKLKNNECTPADLCYSLQETLFAMLVEITERAMAHCDSKDVLIVGGVGCNERLQEMMRIMCSERGGRLFATDDRYCIDNGAMIAYTGLLAYAHGMTTPLEESTFTQRFRTDEVHAIWREKEMPVLTNIRAHAMAEVSKDEASVPTPIAVDS

SEQ ID NO: 40804 - protein, 336 aa, Vitis vinifera
MERSSQESHLRSENCVTYESPYPLYSMAISSSTQHHHPRIAIGSFIEELSNRVDIVSFDEDALAIRTHPSLSFDHPYPPTKLMFHPNSRTSPDHLASSGEYLRLWEVRDNSIQPLSVLNNSKTSEFCAPLTSFDWNEVEPRRIGTSSIDTTCTIWDVERGVVETQLIAHDKEVYDIAWGEAGVFASVSADGSVRIFDLRDKEHSTIIYESPQPDTPLLRLAWNKQDVRYMATILMDSNKIVILDIRSPTMPVAELERHRASVNAISWAPQSSRHICSGGDDSQALIWELPTLAGPNGIDPMSVYLASSEINQLQWSAAQPEWIAIAFSNKLQLLKV

SEQ ID NO: 40805 - protein, 344 aa, Vitis vinifera
MGASSDPTQDASDEQQKRSEIYTYEAPWHIYAMNWSVRRDKKYRLAIASLLEQYPNRVEIVQLDDSTGEIRSDPNLSFEHHYPPTKTIFIPDKDCQKPDLLATSSDFLRVWNISDDRVELKCLLNGNRNSEFCGPLTSFDWNEAEPKRIGTSSIDTTCTIWDIERETVDTQLIAHDKEVFDIAWGGVGVFASVSADGSVRVFDLRDKEHSTIIYESSEPDTPLVRLGWNKQDPRYMATIIMDSAKVVVLDIRFPTLPVVELQRHQASVNAIAWAPHSSCHICTAGDDSQALIWDLSSMGQPVEGGLDPILAYTAGAEIEQLQWSSSQPDWVAIAFSTKLQILRV

SEQ ID NO: 40806 - protein, 340 aa, Ginkgo biloba
MAPTRVQYVAESRPQTIPLEFVRPVEERPINTTFNDDIGLGRQIPVIDMCSLEAPELRVKTFKEIARASKEWGIFQVINHAISPLLFESLETVGKQFFQLPQEEKEAYACTGEDGSSTGYGTKLACTTDGRQGWSDFFFHMLWPPSLRDFSKWPQKPSSYIEVTEEYSKGILGVLNKLLSALSISLELQESALKDALGGENLEMELKINYYPTCPQPEVAFGVVPHTDMSALTILKPNDVPGLQVWKDEKWITAHYVPNALIIHIGDQIQILSNGKFKSVLHRSLVNKEKVRMSWPVFCSPPLDTVIGPLKELIDDSNPPLYNARTYREYKHRKINKLGQ

SEQ ID NO: 40807 - protein, 374 aa, Xanthobacter autotrophicus Py2
MTDTIERPGFVERNRPGRAKMKAAIFVEKNRIVLDEKPIPDVGPLDALIRITTTTICGTDVHILKGEYPVEKGLTIGHEPVGIIEKLGSAVEGFAEGQRVIAGAITPSGYSNACLCGCASQDGPRMKHGFKPMGGWRFGNTIDGAQAEYLVVPDAMTNLAPVPEALGDEQVLMCPDIMSTGFAGAESGKVRIGDTVAVFAQGPIGLCATAGARLMGATRIIAVDRVGERLNVARAMGADEVVDFSKVDPVEEILRLTDGRGVDVAIEALGRQETFEAALRVLRPGGTLSSLGVYSSDLKIPLDAFAAGLGDNKIVTSLCPGGKERMRRLMDVVASGRVDARALVTHRFKLDDIEKAYDLFSHQRDGVLKVAITP

SEQ ID NO: 40808 - protein, 399 aa, uncultured bacterium
MSEEFYRIKRLPPYVIAEVNDMRAAARQAGRDIIDLGMGNPDLPPPQHVIDKLCEVAMKPDAHGYSASKGIPGVRKAQANYYARRFGVELDPNTEVVMTMGSKEGLASMATAMTAPGDVVLAPNPSYPIHTFGFIIAGATIRAVPTTPDENYWRALERAMAFTVPRPSVLIVNYPSNPTAETVDLAFYERLIAWAKENQVWVLSDLAYSELYYDGNPTPSILQVPGAKDVAVEFTSMSKTFSMAGWRVGFAVGNRKLIAALTRVKSYLDYGAFTPIQAAACAALNGPQDIVEANRTLYQKRRDVLVEAFGRAGWDVPSPKASMFAWAPLPPALKDMGSLEFSKQLLTHAEVAVAPGVGYGEDGEGFVRIALVENEQRLRQAARNIKRYLTSMGVNSTAA

SEQ ID NO: 40809 - protein, 324 aa, Arabidopsis thaliana
MANTPLIVSFGEMLIDFVPDTSGVSLAESTGFLKAPGGAPANVACAITKLGGKSAFIGKFGDDEFGHMLVNILKKNGVNSEGVCFDTNARTALAFVTLKKDGEREFMFYRNPSADMLLKESELNKDLIKKAKIFHYGSISLISEPCRTAHMAAMKTAKDAGVLLSYDPNVRLPLWPSTEAAIEGIKSIWNEADIIKVSDDEVTFLTRGDAEKDDVVLSLMHDKLKLLIVTDGEKGCRYYTKKFKGRVPGYAVKAVDTTGAGDSFVGAFLVSLGKDGSILDDEGKLKEALAFANACGAVCTTQKGAIPALPTPADAQKLMKSKSK

SEQ ID NO: 40810 - protein, 112 aa, Alteromonadales bacterium TW-7
METIDKIKQQISENPIILFMKGSPKLPNCGFSSQASQALMSCGEPFAYVDILLNPDIRAELPAYANWPTFPQLWVEGELIGGCDIIIEMFQRGELQPLITETAAKYKEADAE

SEQ ID NO: 40811 - protein, 424 aa, Staphylococcus aureus subsp. aureus NCTC 8325
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASATVEQTSTAKQNQPRNNGRFSPVVFKLASEHDIDLSQVVGSGFEGRVTKKDIMSVIENGGTTAQSDKQVQTKSTSVDTSSNQSSEDNSENSTIPVNGVRKAIAQNMVNSVTEIPHAWMMIEVDATNLVNTRNHYKNSFKNKEGYNLTFFAFFVKAVADALKAYPLLNSSWQGNEIVLHKDINISIAVADENKLYVPVIKHADEKSIKGIAREINTLATKARNKQLTAEDMQGGTFTVNNTGTFGSVSSMGIINHPQAAILQVESIVKKPVVINDMIAIRNMVNLCISIDHRILDGLQTGKFMNHIKQRIEQYTLENTNIY

SEQ ID NO: 40812 - protein, 419 aa, Chromobacterium violaceum ATCC 12472
MHISHSQLKHLETVIGQMTRFDRPADAVLSAYFREHNKLGSADRHLIAETAFGALRRLIQLRALIAPEKATPRRLALVALMKFNKLNVKELSEATSAGEREWLGTVKGKALEDSLEIRAELPQWVIERLGEQEPAAVEALGQGLMSMAPLDLRVNTLKMKREELLDRLNADGIACEATPYSPLGIRLKDKPALSRHELFKSGAFEVQDEGSQLLGLITGARRGEMVVDFCAGAGGKTLLLGAQMASSGRLYAFDVSEKRLANFKPRQARSGLSNVHPQLLSHENDAKVKRLAGKADRVLVDAPCSGLGTLRRNPDLKFRQSPDSVAELNAKQASILASASRLVKNGGRLVYATCSLLPQENQAIVEAFLAEHADFRLVKMDEVLAEQKIPLQCGDYLELKPHLHNTDGFFAAVLERSQA

SEQ ID NO: 40813 - protein, 455 aa, Chromobacterium violaceum ATCC 12472
MQDHLPRRSRRQRMNRRLRHLYLSAAQLRRQVPVWIAAILIGLVAYVFALGSHWSHDLFFKAYDASPYWSLLITPAGLALAIWIMRRFFPSSAGGGIPQSIAALEPGMEKLREYCFTLKAAFGKVLLTLIGISSGATFGYEGPIVQVGAAIKYSLNRKAAQRHEGAARSFILAGGAAGVAAAFNAPLAGIVFAIEEMGRIFDMRASSTILLSVIVAGLTTFAINGNYSYFGIVHVAMDNQQAWLAIPACGVVGGLIGGLACRVLLALSSRLPGPLHGWRIRYPIRFAAGCGLALAVIGIVSHGSTFGTGYFRARDIIEGHGAALQDYGVLKLISMFVSHISAVPGGMFAPSLAVGAGFGLNMSQLLPFLPQSMVVLLGMVGFFAGMTRAPMTGFVIVMEMTDTSGMIIPLMATALIAASVSRLVSRRALYDGQVRLFLPQWRTQAGQIDQPAART

SEQ ID NO: 40814 - protein, 493 aa, Mycobacterium sp. JLS
MRGDELFIGGTWCAPSTDRRIEVISPHTETTVGHVAAAAPADVDRAVGAAREAFDTGGWPRTSPAGRIDAVRRLAANYERRRSEMAELITSEIGAPISFSQRAQVALPWSMINAFCDLAQTYPWREARPGRYGSDVQVLREPVGVVGAVVPWNMPQFLIVTKLIPALLAGCTVVVKPAPESPLNALLLAEVIAESGLPPGVVSVLPGDGSVGEYLVGHRGVDKVSFTGSTAAGRAVATACAADLRRVSLELGGKSAAIVLDDADPVVVAAGVRSASLSNSGQICNALTRVLVPRSRAGEFTDALAAEVSALVVGDPTDGATQVGPLVARRQQQRVTGYLEQGVRDGARVVTGGTGMPDGLDRGWYVKPTVFDRADNSMTIAREEIFGPVLTVIAYDNEDEAVAIANDSDYGLAGSVFTADTDRGLAVGAAIRTGTFGVNQGYTMDPFAPFGGVKSSGYGRELGREGIDGYVDTKSISVAPKQDPATAAAGKGA

SEQ ID NO: 40815 - protein, 103 aa, Chromobacterium violaceum ATCC 12472
MSIQQDIQQTVADNAVVLFMKGSAQFPQCGFSSRAVQILKACGVDNFLTVDVLRDPDIRQGIKDFSNWPTIPQLYVKGEFVGGSDIMYEMYQNGELQDLLKDL

SEQ ID NO: 40816 - protein, 174 aa, Hortaea werneckii
GACCENVIGYMPLPLGVAGPLTIDGRSYFLPMATTEGVLVASISRGCKAINAGGGAVTVLTGDGMTRGPCIGFQTLARAAEAKIWLDSPEGQKVMKDAFNSTSRFARLQQMKTSIAGTYVYVRFKTTTGDAMGMNMISKGVEHALGVMSKEAGFEDMAIISVSGNFCIDKKPAA

SEQ ID NO: 40817 - protein, 473 aa, Bacillus cereus G9241
MAKEYDLVIVGGGTGGYVAAIRASQLGLKTALVEKENLGGTCLHKGCIPSKALLRSAEVYATAKKSEEFGVIASNVELNFAKVQERKEKIVTQLHKGVQHLMKQGKIDVFEGIGRILGPSIFSPMPGTISVELASGEENEMLIPKNVLVATGSRPNSLPGLELDGEYVMSSDHALKMETLPSSIIIVGGGVIGIEWASMLADFGVEVTVLEYAKTILPLEDQDVSKEMQRLFKKKGIKVVTGAKVLPETLVKDNGVTIQAEHNGENKEFKAEKMLVSVGRQANTQNIGLENTDIVVEKGYIQTNEFYQTKESHIYAIGDVIGGLQLAHVASHEGIVAVEHIAGKEVTPIDYSMVSKCVYSSPEVASVGLTEQEAKEKGYKLKVGKFSFRAIGKALVYGESDGFVKLVVDEETNDILGVHMIGPHVTDMISEAGLARVLDATPWEVAHTIHPHPSLSEAIGEAALAVDGKALHA

SEQ ID NO: 40818 - protein, 287 aa, Oryza sativa (japonica cultivar-group)
MTGFGSPCGACKFLRRKCVRGCVFAPYFCHEQGAAHFAAIHKVFGASNVSKLLAHLPLADRPEAAVTISYEAQARLRDPIYGCVAHIFALQQQVRIVHSIDVSLVGVAGLLILVSRRVFEQVMTLQAQLASLKAAAAQGIHHQDVGATTKGGYMSAAATAADDQLGYGGYNQWCGSNGGGAPAASQPGAYSSNGGAGHGHDSITALLAAGSDYMQHSLYHAFEHSEGAGAVDDGHAAAAAFEAAAESSSCGMAASFAADESVWRSSSSGYQDCEDLQSVAYAYLNRS

SEQ ID NO: 40819 - protein, 893 aa, Yarrowia lipolytica CLIB122
MINSLYRLLQNIELSTSPPQHWDMQTSTPVTSIYQRQEVIGRGNFGVVYKGYHKKTKQLVAIKVLNLDTAEDDVKEVQHEIQLLSQLKLADAENITRYHGSYLHGSRLWIIMEYCAGGSVRTLMKAGRIEERHLSVITRELLIAIQYMHKAGIIHRDIKAANILITQQGRVQLCDFGVAAQLVSSKTKRSTIVGTPYWMAPEVITEGASYNVKADIWSLGITLYEIATGSPPLSDQEAMRAIFLIPRNKPARLEGSQYSAALKEIVALCLDELPDERPSAEELSKTKFVRGSKGIPTSTIKDLISRYMHWREHNKSRDSMAVYNRHSIGSEEDIVDHSDDFRWDFDTSTAPDDARVEVHNGQMDFRPEPTHAYRDIGEMGTQVLLQSTVSASEVLEQRYEQQQGLQQGQLHDLTTATNTMTVPQEEEEPHPLLELFVDENEPPAPPAPPAPPAHAPMPARPELSSSMSLPTVPTQKTQMASMAPTLNDLREEGEPPGVPPMAMSRRKTLGRGSKMGASPEKDHPQPPPLQHSHSFAQTQGQGQNLNQTTHSGQAIHPGLGGLPQVQQPPQLQQQLPPQIKQPPHQIQHPQPPLMPQLHQTMPPVPHTQPPPSQMPPLPQQQPPQQPLAPPPLMAQAPPPPTPMHHSSASLAAVAAAKSAINSANPSSGASLAAPHQVYPKRTPSPIRGSPPPVKRPSSPPPQFHRPSISSVSSISSAAASPSAASPVMSHKSSVSSEDGGHASPPLIPRSENPQLATRSASVPDVVMPRSDVNGKSPAFNTEKPAKLRNVNLQIKMPPAQAPPMPDAFMTPARKEDYTPSLNVPSQPSSRRPSRAAQTQPPVQSTLQFPPIPKIDLSVLLDPAPHADVTRELEKLLTSFGDALKVMEDGFSSL

SEQ ID NO: 40820 - protein, 124 aa, Vitis vinifera
MAYQQDPCANPTHQTGKTGGQTDQYGNPVHQTEALGAYGAGTGTGMHGGEHQQQPHQQSGSSSSEDDGQGGRRKKGMKEKIKERIPGMGRKDEQKQTSATSTPGQGQQQKGMMEKIKEKLPGGH

SEQ ID NO: 40821 - protein, 450 aa, Blastopirellula marina DSM 3645
MTGMISKADSSGAALSAKTLERGRKSIAGGDSSTMRVLPYHIPLVADRGEGSRLWDIDGNEYIDLNMAYGPLLLGHRPKQVIEAVYRQISERGSQLGFPTEVTIRVAEKLKQLFPCIELLRFANSGTEACASAIRLARTYTGKRKLIMFEGHYHGWSEAVFTKYHAPLEMLPECGYGPAIPGTTGMTDALDDVITCQWNDLDALQRCLEEHGDEAAAIIMEPISGNAGLLLPRDGYLATAREMIHDRGGLLIFDEVITGMRVAAGGAQEHYLVSPDITVVSKAMGGGYPVGSFGASAEIMSCITNGPLFHGGVFSGNAVVMSAAEAVLDTVLADKDNIYANLHALGNQLAGGIDDIYNRLGVPHHVHHLGPLLAGLITKTDVEGLYNYRDVRRHCDFERYIQFQHQMQRSGVYFHPNEFEPMFLSTAHTSADIDEVLERWEDGARQCLVR

SEQ ID NO: 40822 - protein, 650 aa, Mycobacterium avium 104
MRSRYAGEPFTTSTAEIAAALEDVSIPTLLLSLVHITGDPRFIRDFKQMGIFLNEVQGFMSEEDKARARAEALSVITDYRDRGCPEPEPLSPELIREMMDWAACEHVPDDYLPLICEELDLDGVDPRRPAALPAERAAGLPVLVVGCGESGILAGVRLKQANIPFTIVEKNAGPGGTWWENSYPGARVDVANHFYCYSFEPNNDWTHFFAEQYELQDYFTKVIHQHDLAGQVRWQTEVLAAEWDDGHGTWTVSLRSADGHTETMRARALITAVGQLNRPNIPAVDGAQTFRGPSFHSAVWDHSVELKGKRVALVGAGASGFQIAPAIAADVKRLTVFQRTAQWMFPNPMYHDEVGDGVRWAMRHLPFYGRWYRFLVLWPGSDKGLDAAEADPNYADQEHAVSDVNAAAHMMFSQWITSQVGEDSELLAKVMPDYPACGKRTLQDNGSWLRTLQRDNVELVRTPIDKITPHGIVTVDGTAYDADVIVYATGFRHTDVLWPLKVTGRNGVDLHQMWGSRPYAYLGITVPEFPNFFIIYGPGTHLAHGGSLIFQSELQMRYIDQCLARLCEPGVHSIEPKPDAAIDWHRRTQAQIKKMVWSHPAVKHSYFKNADGEIHKVSPWRLNEYWSAVREPDWSQFMVRTNDAVPQGNR

SEQ ID NO: 40823 - protein, 478 aa, Pyrobaculum aerophilum str. IM2
MIIVKNYINGEFIEVEERRPKHSPIDGSVIAETPVSKREDAKAAIDAAYDALKAWSQLPAIKRAEYLYKLYEIIKSREEELINILMVEGGGIYKKAWGEVVFTERLVRNAAELARHYGGKTLQSDAEGVVSMVFKRPKGVVGVITPWNYPLSISMKKIAHALATGNTIVYKPASETPVTGFKIAEMIHQAGFPKGVFNLVVGPGSTVGDEIVVNKKVSHVTFTGESATGREIASKAGGALKTVTLELGGSDPLIILDDADLNLAVRIAVFGAFFHQGQICTSSKRIIVHERVYDVFVKKFVERVSQLKVGDPRDRTVEQGPLISPRQADEMERFYQDAVSRGGRALTGGKRAGAYFWPTVFVDVDRNFRIMREEVFGPIRPVVPVKNDDEAVEVANDTEYGLSAAVVTTNINRAFKIAEAIESGMVHINDVTMLEESHVPFGGIKASGFGREGGEWSFHETTYDRWLTITLRERKYPI

SEQ ID NO: 40824 - protein, 368 aa, Blastopirellula marina DSM 3645
MTHPWIADRTAAFDSSGIRKVFDLAAKMTDPINLSIGQPDFDVPDAVKDTAIAAIRDGKNGYALTQGMPVLRDKLQASIDAELGHRDRTNFVCSGTSGGLVLSMLALVNPGDEVIIFDPYFVMYESLVKLVGGVPVIINTYPDFRIDLPKVEAAITPRTKLILLNSPANPTGVVATEAEVAGLAKLAGEKNIALISDEIYRMFTYGDFVSPAKYNDQTIVIDGFSKSYGMTGWRVGYVHGPSAVIETMVKLQQYTFVCAPQPAQWASAAALDVDMSQHVATYARKRDLMLEGIGDLYEVSQPDGAFYIFPKAPWGTGTEFVAKAIENNLLIIPGNIFSKQDTHFRISYAAPDETLKRGVDTLRKLAQG

SEQ ID NO: 40825 - protein, 906 aa, Mycobacterium tuberculosis H37Rv
MTELAELDRFTAELPFSLDDFQQRACSALERGHGVLVCAPTGAGKTVVGEFAVHLALAAGSKCFYTTPLKALSNQKHTDLTARYGRDQIGLLTGDLSVNGNAPVVVMTTEVLRNMLYADSPALQGLSYVVMDEVHFLADRMRGPVWEEVILQLPDDVRVVSLSATVSNAEEFGGWIQTVRGDTTVVVDEHRPVPLWQHVLVGKRMFDLFDYRIGEAEGQPQVNRELLRHIAHRREADRMADWQPRRRGSGRPGFYRPPGRPEVIAKLDAEGLLPAITFVFSRAGCDAAVTQCLRSPLRLTSEEERARIAEVIDHRCGDLADSDLAVLGYYEWREGLLRGLAAHHAGMLPAFRHTVEELFTAGLVKAVFATETLALGINMPARTVVLERLVKFNGEQHMPLTPGEYTQLTGRAGRRGIDVEGHAVVIWHPEIEPSEVAGLASTRTFPLRSSFAPSYNMTINLVHRMGPQQAHRLLEQSFAQYQADRSVVGLVRGIERGNRILGEIAAELGGSDAPILEYARLRARVSELERAQARASRLQRRQAATDALAALRRGDIITITHGRRGGLAVVLESARDRDDPRPLVLTEHRWAGRISSADYSGTTPVGSMTLPKRVEHRQPRVRRDLASALRSAAAGLVIPAARRVSEAGGFHDPELESSREQLRRHPVHTSPGLEDQIRQAERYLRIERDNAQLERKVAAATNSLARTFDRFVGLLTEREFIDGPATDPVVTDDGRLLARIYSESDLLVAECLRTGAWEGLKPAELAGVVSAVVYETRGGDGQGAPFGADVPTPRLRQALTQTSRLSTTLRADEQAHRITPSREPDDGFVRVIYRWSRTGDLAAALAAADVNGSGSPLLAGDFVRWCRQVLDLLDQVRNAAPNPELRATAKRAIGDIRRGVVAVDAG

SEQ ID NO: 40826 - protein, 132 aa, Brassica napus
KHDCKNPKLITYKIISLLLCGTIRLGFCRSEEKSLEKTMMMLGGVHDLRGNQNSVVIASLARFAIQEHSNRENKVLDFKKIVKAREQVVAGTMYHLTLEASEGGKSKNFEFKVWVKPWMNFKQLQEFKESSS

SEQ ID NO: 40827 - protein, 178 aa, Zea mays
MRGEAAGLCRLNAAGICEASPSCVRRRIRQPGTAMPVPLAPYPAPPAPFTPPNGAQSQLVCTGCRNLLMYPAGATSVCCAVCSTVTAVPAPGTEMAQLLVCGGCHTLLMYIRGATSVQCSCCHTVNLAMEANQVAHVNCGNCRMLLMYQYGARSVKCAVCSFVTSVGTSPGAEQKPSS

SEQ ID NO: 40828 - protein, 75 aa, Glycine max
  misc_feature (34)..(34): Xaa can be any naturally occurring amino acid
  misc_feature (47)..(47): Xaa can be any naturally occurring amino acid
  misc_feature (60)..(60): Xaa can be any naturally occurring amino acid
  unsure (1)..(75): unsure at all Xaa locations
SISWPGDTTVNRAGAGMDAPFTGLKSMAGLPTRXTYNDITSIGCNCXRVQCMQVWPPIGXKKYETLSYLPDLDDA

SEQ ID NO: 40829 - protein, 479 aa, Oryza sativa
MAEVKPEEISYPPMEQLQGFEYCIDSNPPWGEAIILGFQHYILALGTAVMIPAVLVPMMGGSDGDRVRVVQTLLFVTGINTLLQSLFGTRLPTVIGGSYAFVVPIMAIIQDSSLAAIPDDHERFLQTMRAIQGALIVSSSIQIILGYSQLWGIFSRFFSPLGMAPVVALLGFGLFERGFPVVGRCVEVGLPMLILFVVLSQYLKNVQIRDIPILERFSLFICIALVWAYAQILTAGGAYKHSPEVTQINCRTDRANLISSAPWFVSAYFPIEFVISLMCQGLAPGLRSLFHYNGAHQLSVPVNPLGIGILLDGLFGTGTGSTVSVENVGLLGSTRIGSRRVIQISAGFMIFFSMLAAVGLSFLQFTNMNSMRNLFIVGVSIFLGLSVPEYFFRYSMAAQRGPAHTKAGWFNDYINTIFSSPPTVGLIVAVFLDNTLEVKNAAKDRGMPWWVPFRSFKGDARSEEFYSLPFNLNRFFPPS

SEQ ID NO: 40830 - protein, 403 aa, Zea mays
MAAALYGNGSSTSGGGGARGRGKPITCKAAVAWGPGVPLSLEEVEVAPPGPMEVRVKVLFTSICHTDLSAWKGECEAQRKYPRILGHEAAGVVESVGEGVEGLAPGDHVVPIFTGECEKCVYCKSDKTNLCGTYRVDPLKSSMVYDDGTRFSVVDQASGQRRPVYHFLNTSTFTEYTVLDAACAVKINPEAPLQRMCLLSCGISTGVGAAWNTANVSARSTVAVFGLGAVGLAVAEGARLRGATRIIGVDVNPSKFTKGKEMGITDFIDPNDICDKPVHEVIREMTDGGVDYSFECTGINDVLREAFLSTHDGWGLTVVLGIHSTPKMVPLHPMELYGRRITGCVFGDFKGKSQLPDLVDKCVNGEVNINFDGFITHKMPFSDINKAFRLLEEGKSLRCLLSL

SEQ ID NO: 40831 - protein, 159 aa, Zea mays
TAEAYYCRYVRCRPPWTDHRSIAMRRATVFLMALALALALILIPPPTVATPPPGRLPLRRSRFLASSSVDFPSSFYDCSKKPPSICLSPGSPGATCCQGACVDTNHSFQHCGNCNKMCKFAQTCCEGKCANTFTDKRNCGGCGVKCRTKCTNGYCDYAA

SEQ ID NO: 40832 - protein, 135 aa, Arabidopsis thaliana
MGDLLDWIISFLFLATLIIIVIYQLTCLADLEFDRINPYDVSSRINRMVLPEFGLQGLLCLYYILTGHWFMAVLSLPHLFYNIRLYMKREHLADVTELYNTNKWEQKKRVYKIGHIALSIFITTYWLIHSALGDI

SEQ ID NO: 40833 - protein, 276 aa, Glycine max
MKFFNLLKSRHVRSCSSPSSWAWPSCHQPKTLSFRVTATNTNNNKNNDDDDNNMRDINLALVSQTPESFFTESPDSASFSTTSELSRGVDPIETVIRGLRSDRLFFDRDDASFMLEGKPTTTSHLEPFKNSVVLTMDSEDPHVDFRKSMEEMVETLGVEDWESLEDLLCWYLQANAKSNHEYIIGAFVDLLFYLAVPNSPCSQDFEHSHSRPSSPLSFYSSSSSSSPSSSCSTRCNIKGEVEEEEEEVGACSSSFSLAQGKEEITPEDEVASSSNN

SEQ ID NO: 40834 - protein, 482 aa, Clostridium acetobutylicum ATCC 824
MFENISSNGVYKNLFDGKWVESKTNKTIETHSPYDGSLIGKVQALSKEEVDEIFKSSRTAQKKWGETPINERARIMRKAADILDDNAEYIAKILSNEIAKDLKSSLSEVKRTADFIRFTANEGTHMEGEAINSDNFPGSKKDKLSLVERVPLGIVLAISPFNYPVNLSGSKVAPALIAGNSVVLKPSTTGAISALHLAEIFNAAGLPAGVLNTVTGKGSEIGDYLITHEEVNFINFTGSSAVGKHISKIAGMIPMVLELGGKDAAIVLEDANLETTAKSIVSGAYGYSGQRCTAVKRVLVMDKVADELVELVTKKVKELKVGNPFDDVTITPLIDNKAADYVQTLIDDAIEKGATLIVGNKRKENLMYPTLFDNVTADMRIAWEEPFGPVLPIIRVKSMDEAIELANRSEYGLQSAVFTENMHDAFYIANKLDVGTVQVNNKPERGPDHFPFLGTKSSGMGTQGIRYSIEAMTRHKSIVLNL

SEQ ID NO: 40835 - protein, 429 aa, Pseudomonas fluorescens PfO-1
MAKIVDIKGREVLDSRGNPTVEADVLLDNGIIGSACAPSGASTGSREALELRDGDKSRYLGKGVLKAVANINGPIRDLLLGTDPSDQKALDQAMIKLDGTENKATLGANAILAVSLAAAKAAAQDQDLPLYAHIANLNGTPGVYSMPVPMMNIINGGEHADNNVDIQEFMVQPVGAKSFSEGLRMGTEIFHHLKAVLKARGLSTAVGDEGGFAPNLASNEDALKVISEAVANAGYKLGTDVTLALDCAASEFFEDGKYNLSGEGQVFTAEGFADYLKGLTERYPIISIEDGLDESDWAGWKILTDKIGEKTQLVGDDLFVTNTKILKEGIDKKIANSILIKFNQIGTLTETLEAIQMAKAAGYTAVISHRSGETEDSTIADLAVGTSAGQIKTGSLCRSDRVSKYNQLLRIEEQLNGKAKYNGRSEFRG

SEQ ID NO: 40836 - protein, 429 aa, Bacteroides fragilis YCH46 [sequence omitted]

SEQ ID NO: 40837 - protein, 399 aa, Zea mays
  misc_feature (350)..(350): Xaa can be any naturally occurring amino acid
  unsure (1)..(399): unsure at all Xaa locations
RAGQGLLQRGGIVMAACGYALGRAELGAAKRQQPDKDPSAGTRSSNVAATGSLGNAARPDVSFRYRGAESCKKVAASLKSCEPWGNRAFWTNAAGPGWKLSFAVEPWTKGFSTSCAAPYSAGATEHQLSIDEKVDNSTVASDSDGKSPVSEKLKFLSGSCYLPHPDKEATGGEDAHFISIDEHVIGVADGVGGWADVGIDAGLYAKELMRNSMSAIKDEPEGTIDPTRVLEKAYMSTKARGSSTACIITLKDQGIHAVNLGDSGFVVVRDGRTVLRSPSQQHDFNFTYQLESGGGSDLPSSAQVFHFPVAPGDVIVAGTDGLFDNLYNNEISGVIVEALRVGLEPQVAAXKKIAALARQRATDKNRQSPFASAAQEAGYRYYGGKLDDITVVVSYVKTA

SEQ ID NO: 40838 - protein, 538 aa, Arabidopsis thaliana
MDPTQISHLALDIGGTLIKLVYFSANGDYSEESRNGCSVVKGRLCFAKFETRKIDDCLEFIRFNILHHSGVQQPNGEGHDKLYVKATGGGAFKFADLFKEKLGILFDKEDEMCSLVGGVNFLLKTVPREAFTYLDGQKKFVEIDHNDLYPYLLVNIGSGVSMIKVDGDGKYERISGTSLGGGTFLGLGKLLTKCKSFDELLELSHHGNNRVIDMLVGDIYGGTDYSKIGLSSTAIASSFGKAISDGKELEDYQPEDVARSLLRMISNNIGQIAYLNALRFGLKRIFFGGFFIRGLEYTMDTISVAVHFWSRGEAKAMFLRHEGFLGALGAFTSYNDQSHNDLKPHHHTVQRAILNCSGHNFRHIPVYHSSFVDEEGVTKACGCPLLPLKSHIKGPAPVSEQDKTDIVDEAITFFRANVFFTNFDIKSPADKLLIYLTFYINVALKRLEGCRTLAVGTKAIINLGLEDIPVPGETGFPFPGLFSLPQSQDEAELFRNYLKQVREETSGRLLSVAYRANGTPNKWWLAFAKRKFMNVVVL

SEQ ID NO: 40839 - protein, 240 aa, Prochlorococcus marinus str. MIT 9313
MGEYWWSARHACLQLVGLDFGPDPLPDAAPEAFRLLRPWIHQGWEMVLLAAELLRSDGPLLRHGAKAFSVDYHLRCQQALDAWGWQPGQLQEALEQVRRSALEADRLNWLARHRPFPGVIERLRGLHDEGFDLVVLTTKGAEFTAELLKCFQLAPHGLYGHESGSKTEVLLRLAAERPLRGFVEDRRVTLETVLATPGLSSLPCYLASWGYLKPEDSRALPMGIRLLEPEALAAPLASWP

SEQ ID NO: 40840 - protein, 545 aa, Prochlorococcus marinus str. MIT 9313
MKPKRITDDLDRLLDLLPLAVQQALATPNSREQLLEVVLDLGRVPEARYPGRALALGEQCLTRDDLQTTVDRLGQFGADNRAGIERTLHRISAIRNRQREVVGLTCRVGRAVFGTVAMVRDLLDSGQSLLLMGRPGVGKTTALREIARVLADDLQRRVVVIDTSNEIAGDGDIPHPAIGRARRMQVSLPEQQHQVMIEAVENHMPEVIVIDEIGTELEAQAARTIAERGVQLVATAHGNALANLIKNPTLSDLVGGIQAVTLGDEEARRRRTQKTVLERAAEPTFPVAVEMNTRNRWSIHADVAATVDQLLRGQLPRPQLRELGSDGSVRLVDAQPSRSSSPRPALAAVPLPDPQAPSPRAAPPAQDHAEAISAERADHRALQVLCCGITPQLVDEAIRRHGWPVRWVDDLHEADVVLSIRKGLGHQPTLRRQARESRVPVLVIKSDTLPQVERALERLLARRAGPQDQISHSESQDGDQEDALAALEECRLAVEKVVLPYGRPVELLPRSEQVRQMQVDLVTRYRLSSDVFGQAEQQRLRVYPP

SEQ ID NO: 40841 - protein, 376 aa, Pichia pastoris
MDGEDVAALVIDNGSGMCKAGYAGDDAPHTVFPSVVGRPRHQGVMVGMGQKDSFVGDEAQSKRGILTLRYPIEHGIVTNWDDMEKIWHHTFYNELRLAPEEHPVLLTEAPMNPKSNREKMTQIMFETFNVPAFYVSIQAVLSLYASGRTTGIVLDSGDGVTHVVPIYAGFSLPHAILRIDLAGRDLTDYLMKILSERGYTFSTSAEREIVRDIKEKLCYVALDFDQELQTSSQSSSIEKSYELPDGQVITIGNERFRAPEALFHPSVLGLEASGIDQTTYNSIMKCDVDVRKELYSNIVMSGGTTMFPGIAERMQKELTALAPSSMKVKISAPPERKYSVWIGGSILASLGTFQQMWISKQEYDESGPSIVHLKCF

SEQ ID NO: 40842 - protein, 642 aa, Coccidioides immitis RS
MEGIHSNSNMGFHGRMSFRKCSAPRRRKPTNGSGQDAEVSSLDSLAVACAAIESGDPIGSIPGVSLASSPASLPPDSNIAMPTKSLYPTVDIPNVDIWTLLFNRKDRQFPDNKIIYQDAETGRSYTYEQVRSTALEFGTGLKANWEWKKGDVLAVFSPNSIDIPPLTWGTHWAGGVVSPANPAYTADELAFQLKGTKARVLATQMSCLSTAIEAAKRVGIPDDRIILIGDERHPTSKYKHFTTIQNISRSIRYAKTKVDPAKDLAFLVYSSGTTGVPKGVMLSHKNIVTNIHQLKAGEEGNLTWNGGADGSGDRLLAFLPFYHIYGLTCLVHNALFSGLHLVVMAKFDIERWCSHVQNYRITFSYIVPPVVLLLTKHPVVDKYDLSSLRMMNSGAAPLTRELVESTYARIKCGIKQGYGLSETSPTTHTVPWSDWRRRAGSVGKLLPNMEAKYMTSPEDDSEPQEVPVGEVGELYIRGPNVFLGYLDNPAATAACVSPDGWFRTGDVGYQDSEGFFYITDRVKELIKYKGFQVAPAELEGLLTDHEAVSDAAVIGVESAEHGTEVPRAYIVPNPKIIPPGRRTAEEGERISQWLQTRVAPYKRLRGGVRFVDEIPKSASGKILRRLLKEEAKKEEAIVKAKL

SEQ ID NO: 40843 - protein, 180 aa, Zea mays
  misc_feature (20)..(20): Xaa can be any naturally occurring amino acid
  misc_feature (69)..(69): Xaa can be any naturally occurring amino acid
  unsure (1)..(180): unsure at all Xaa locations
KPFPAQGFVFFFGEGQVWFXNSQIWVPPNEIDKVDKGGWGKKTLFGGGPRFCLNPIKIFGGGFGGPPGXGNPYSFSPHQIRALGKGRRAGKFPKKGKAKGGGGMPGRGTPRGPGGFFGFWKGGEMVFVCPRQSWEAPATPSPSPKGGFFFPLGRGRLWGLGKFFFPKPTFFFLKWGFGGR

SEQ ID NO: 40844 - protein, 414 aa, Bifidobacterium longum DJO10A
MTKNPKILSIVLAGGEGTRLMPLTRDRAKPAVPFGGVYRLIDFPLSNLVNSGYRQVVVLTQYKSHSLDRHISQVWRFSPLLGSYVSPVPAQQRLGKHWYLGSADAIYQTINIIEDVQPDIVVIVGADHVYRMDFEQMVQQHIESGAEFTVAGIRQPIEESNQFGVIEVDPDHPNMIKNFQEKPPTTTGLPDNPNQILASMGNYVANTKALFEALALDEKAADTKHDMGGDIAPYFASRNEAGVYDFNSNEIPGSTATDHAYWRDVGTIKQFYDAHMDLIAYVPEFNLYNQDWPIYTMSGNLPPAKFVHAGRDRLGHATDSIVSPGVIVSGGEVHHSVLSPNVRIHSWAQIVDSVLFDGVVINRRARVYKAILDKNVVLTENSTVGIDTEHDLARGFTVTPDGITVVPKNTIVDD

SEQ ID NO: 40845 - protein, 415 aa, Mycobacterium avium 104
MSVAGDLTSRCSWAGAQAARLAAEARDVYQLGNLVLRGGPFALGCFAGWLFTEFPPHVLTGHALSRVSHPSIGRVGKTLAAQRADHTLTAALQESLGPDFRDQVCHPTSVASVCARRGGLLGRPGPHRRYAAQTSDISYGPGGRDNLLDIWRRDDLAPGCRAPVLIQVPGGAWALNGRRPQAYTLMSRMVQLGWICVSIDYSKSPRSTFPAHLIDVKRAIAWVRENIADYGGDPDFIAITGGSAGGHLASLAALTPNDPAFQPGFENADTAVQAVAPYYGVYDFTDFENMHPLMVPFLEQFVLKARYADAPQRFAAASPISYVHADAPPFFVLHGQKDELVPSGQARAFCAALRAAGARTVGHAELSNAHHAFDITPTVRSRLAADAVADFLGVVYGRRVSSLVDSLPLSATSAS

SEQ ID NO: 40846 - protein, 429 aa, Arabidopsis thaliana
MVNSCENKIFVKPTSTTILQDETRSRKFGQEMKREKRRVLRVINQNLAGARVYPCVVNKKGSLLSNKQEEEEGCQKKKFDSLRPSVTRSGVEEETNKKLKPSVPSANDFGDCIFIDEEEATLDLPMPMSLEKPYIEADPMEEVEMEDVTVEEPIVDIDVLDSKNSLAAVEYVQDLYAFYRTMERFSCVPVDYMMQQIDLNEKMRAILIDWLIEVHDKFDLMNETLFLTVNLIDRFLSKQNVMRKKLQLVGLVALLLACKYEEVSVPVVEDLVLISDKAYTRNDVLEMEKTMLSTLQFNISLPTQYPFLKRFLKAAQADKKCEVLASFLIELALVEYEMLRFPPSLLAATSVYTAQCTLDGSRKWNSTCEFHCHYSEDQLMECSRKLVSLHQRAATGNLTGVYRKYSTSKFGYIAKCEAAHFLVSESHHS

SEQ ID NO: 40847 - protein, 1072 aa, Alteromonadales bacterium TW-7
MPKRTDIKSILILGAGPIVIGQACEFDYSGAQACKALREEGYRVILVNSNPATIMTDPEMADATYIEPIHWEVVEKIIEKEKPDAVLPTMGGQTALNCALDLDKHGVLAKHGVELIGATADAIDKAENRERFDTAMKNIGLECPRAEIAHSMEEAKDTMSRIGLPCIIRPSFTMGGTGGGVAYNMEEFEEICERGLDLSPTNELLIDESLIGWKEYETEVVRDKKDNCIIVCTIENFDPMGVHTGDSITVAPAQTLTDKEYQIMRNASMAVLREIGVETGGSNVQFGINPKDGRMVIIEMNPRVSRSSALASKATGFPIAKIAAKLAVGYTLDELQNDITGGKTPASFEPSIDYVVTKIPRFNFEKFAGANDRLTTQMKSVGEVMAIGRNQQESLHKALRGLEVGATGFNPIVALDDPKAKEKIIRELREPGAERIWYIADAMRHGMSVEDVYELTKVNRWFLVQIEDILKDEARIAEGGMAGLNADFLRKLKRKGFADPRIAEIAGVSEAEIRKKRHQLNIVPVYKRVDTCAAEFSSDTAYMYSSYDEECEANPTDKDKIMVIGGGPNRIGQGIEFDYCCVHAALALRDDGYETIMVNCNPETVSTDYDTSDRLYFEPITLEDVLEIVRVEKPKGVIVQYGGQTPLKLARELEANGVPVIGTSPDAIDRAEDRERFQQLVERLDLLQPENATVTSTEEAILKSAEIGFPLVVRPSYVLGGRAMEIVYDEDDLRRYMTEAVQASNEAPVLLDHFLDNAIEVDVDAICDGEQVIIGGIMEHIEQAGVHSGDSACSLPAHSLSQEVQDVMRKQVTDMALELGVVGLMNTQFAVKDGKVYLIEVNPRAARTVPFVSKATGVALAKVAARCMAGQSLASQGITKEIIPPYYSVKEVVLPFAKFQGVDPIRGPEMRSTGEVMGVGDTFAEAFAKAQLGASNTLPRGGRALLSVRNSDKSRIVELAKIMTELGFELDATGGTAKALEEAGINVRRVNKVYEGRPHILDYIKNKEYSYIVNTTEGRQAIEDSKVLRRGALQNKTNYTTTLNAAFANCTANKADDRSKVASVQELHLRLN

SEQ ID NO: 40848 - protein, 370 aa, Pseudomonas fluorescens PfO-1
MIKSRAAVAFEAKKPLEIVEVDVAMPKAGEVLLRVVASGVCHTDAYTLSGADPEGIFPSILGHEGGAIVEAIGEGVTSVAVGDHVIPLYTPECGQCKFCKSGKTNLCQAIRATQGKGLMPDGTSRFSYKGQTIFHYMGTSTFSEYTVLPEISVAKISKDAPLEKVCLLGCGVTTGIGAVINTAKVKPGDTVAIFGLGGIGLSAVIGAVKAKASRIIAIDINPAKFEIAKQLGATDCVNPKDFDRPIQEVIVDMTDGGVDFSFECIGNVQLMRAALECCHKGWGESVIIGVAGAGQEISTRPFQLVTGRVWRGSAFGGVRGRTELPSYVDMAQSGEIPLDTFITHTMGLEDINKAFDLMHEGKSIRTVIHF

SEQ ID NO: 40849 - protein, 452 aa, Arabidopsis thaliana
MAKSFEKPKFSLRLLIDEEKNRVILAEAGKDFVDVLCSLLTLPMGTIVRLLEKHQNPQSSVVGCLHNLYKSVADMDVDNFESQACKHFLLHPRSAKGSHGRDLKLNIDDTEATKFFVCPNFVSTEACRKLFSNVSTMKCRCGSSMHREIPVEEQQADGVFPSCRTSFVITDDLKVALNSMGLVLNVLNDFGYSGFDKLQEMLIDVGFEEILTLLGCLFTSEAPLTDTFLRKHCMSRKRKMLTPLVQESSVAGAADNLLTLKVYVRKTDRAVLYAECREEFVDFLFTFLAIPIEFAWELSIDIGNMGCVGNLCRSVKDLSFEKQKAATESPEYECLVTHYGHNMLCKKINKAVLSNGEIIAKFTSASASIGLVKGETNFIVSDDLMNIGDIEEQVISIGKAEATSLLRASLITTSALTNGLSNFLSKMDPDEVTQSTPKIQKSDKPNEAWQLL

SEQ ID NO: 40850 - protein, 418 aa, Oryza sativa (japonica cultivar-group)
MTPLHAAPHHAAAAAAVVSSPSSAPLLLRAKPYHPKAAACSFTVTATTPSRKAFLSCPDHGQAAAGAAPPRSAPASSPALISSVQDLYDFICSGPLVDRIGYTKEKIAGSIDRWLRCGVQVARLFRLNELHLSEAEKARIYHFYIPVFLWCEDQVTEHRAKYKDGDEIPPLVIGVSAPQGSGKTTLVFALDYLFRVAGRNAATLSIDDFYLTAAEQGKLRERNPGNALLELRGNAGSHDLPFSVETLESLLKLTKEGLKMKLPRYDKSAFGGRGDRADPSTWPEVEGPLEVVLFEGWMLGFKPLPNEVVKAVDPQLEVVNKNLEAYYDAWDRFIGSWMVIKIKEPSCVYQWRLQAEIAMRADGKPGMSDEEVMDFVSRYLPAYHAYLPTLYKEGPNGSNPDHLLVVDIDEKRNPMWGR

SEQ ID NO: 40851 - protein, 375 aa, Coprinopsis cinerea
MEDEVAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNAPAFYVAIQAVLSLYASGRTTGIVLDSGDGVTHTVPIYEGFALPHAILRLDLAGRDLTDYLIKCLGERGYPFTTTAEREIVRDIKEKLCYVALDFEQEMQTAAQSSSLEKSYELPDGQVITIGNERFRAPEALFQPAFLGLEAAGIHETTYNSIFKCDLDIRRDLYGNVVLSGGTTMFSGIADRMQKELLALSPASMRVKIVAPLERKYSVWIGGSILASLSTFQNLWCSKQEYDESGPGIVHRKCF

SEQ ID NO: 40852 - protein, 376 aa, Candida dubliniensis
MDGEEVAALVIDNGSGMCKAGFAGDDAPRAVFPSLVGRPRHQGIMVGMGQKDSYVGDEAQSKRGILTLRYPIEHGIVSNWDDMEKIWHHTFYNELRVAPEEHPVLLTEAPMNPKSNREKMTQIMFETFNVPAFYVSIQAVLSLYSSGRTTGIVLDSGDGVTHVVPIYAGFSLPHGILRIDLAGRDLTNHLSKILSERGYSFTTSAEREIVRDIKERLCYVALDFEQEMQTSSQSSAIEKSYELPDGQVITIGNERFRAPEALFRPADLGLEAAGIDQTTFNSIMKCDMDVRKELYGNIVMSGGTTMFPGIAERMQKEITALAPSSMKVKIIAPPERKYSVWIGGSILASLSTFQQMWISKQEYDESGPSIVHHKCF

SEQ ID NO: 40853 - protein, 404 aa, Zea mays
  misc_feature (338)..(338): Xaa can be any naturally occurring amino acid
  misc_feature (365)..(365): Xaa can be any naturally occurring amino acid
  unsure (1)..(404): unsure at all Xaa locations
MGGGSRMQTVLLAPGVKDKKLLSYTRRNALKEKDAVTGLIRSIVGGATPSSPAQRTAFHVFHINTVVDLFSAWRRGLPDVRPYYAVKCNPEPALLGALAALGAGFDCASRAEIEAVLALGVPPGRIVYANPCKPEPHLEYAAGAGVNLTTYDTEEEVAKVRRCHPGCELLLRLKGPDGGDVRVDLGTKYGAHPDEVVPLLRAAQRAGVGVAGVSFHVGSPVSRVDVYRGAIQAARAAFDEAAALGMPPMRVLDIGGGFTAGASFDDAAAVINDALARSFGDLPCVEVIAEPGRYFCETAFTLAARVIGKRTRGEVREYWIDDGLYGSLNNILMDHYVXPRPRPLATPRPGDRTHTSTVFGPTCPXMSVGDWLVFDNMGAYSTGSGSKFNGFDTSEIKIYVAYSS

SEQ ID NO: 40854 - protein, 268 aa, Glycine max
HLDKGETHQGPAVLGIAMVAMAEELGLEMAIRSLEHLLQYGEQNIRRAVPLALGLLCISNPKVNVMDTLSRLSHDTDSEVAMAAVISLGLIGAGTNNARIAGMLRNLSSYYYKDTSLLFCVRIAQGLVHLGKGLLTLNPYHSDRFLLSPTALAGLITMLHACLDMKAIVLGKYHYVLYFLVLAMQPRMLLTVDENLKPLSVPVRVGQAVDVVGQAGRPKTITGFQTHSTPVLLAAGDRAELATEKYIPLSPILEGFVILKENPDYREE

SEQ ID NO: 40855 - protein, 521 aa, Arabidopsis thaliana
MSGIVHHDCPNSGNPYHECHDQCFKRISSGDVPKKEKKRFGFGKPACSKETPLTSPVRVIAGNRSPLPSYYGKRMDESDESPSFSSSDDSFNANLPTPRSTLHGNETAPGINWLPMSPSFAVYCKKDCFSSRIDHREGEAPILDEMPSKTRLKTPLSPDTRPRKSEHRTRNQGPRSKTPEPRGSYLEPPRSRIPQTQPVPHRSLESAGLKSPQKGETRPHIPQTQPTSFNIGGNYHYAAQASKYHANKADSVYTKDRDKCVILYPDILLSPQENLTSRSITMLPQKSRTPLDKQSKEPLQLPVECHSFTPSEIECMKALKIYETGEEMKSMISESYVSVGSYKVRASVSSTLQKILDKHGDIASGSKLQSLRTKSYSLETLAAVVLELQSTPLKKLKQARVLEMLSVVIDAESVKIRAGWLREILNEILEAAHHYDGHETTVVEKEGRERDMLLEREEMKKIQEEVRLKEKEAKDFRKGVMEMAGRLGELKMKRARLEKRLAFLSSKVEKFEGESLLENVF

SEQ ID NO: 40856 - protein, 327 aa, Candida glabrata CBS 138
MTWDPSELPYYNPQVDDRVAVVTGGNSGIGWFTVLHLYMHGFRVYVCGRNSHKVSRAMDDIIEEAVRRHNLYLKGLHDQKPTRYLGSLQYLHTDLTDLKCVDRAAAKILRMENHLDVLVNNAGVMAVPYEITKDGFEIQMQTNYIAHFLLTMRLLPLLRCSHGRVVTLSSLGHHIIFKYSKLDETWNYFPNFVFTWFRYAMTKVASIQYTKMLAIKNPDILFVSVHPGLVMNTNLFSFWTRLPLVGIFFWLLFQVVGFMFGVSNEQGAYSTLRCSLSQELTTTNDNGKYFTTGGKESRSSYVANNLDDAASTWIWTMKQLRNRGFDI

SEQ ID NO: 40857 - protein, 1019 aa, Adiantum capillus-veneris
MDPYQQDAASSSGTGYSLHRPPPPDASSSTSGVPTVPRDTHGSLEVFSPAGYIPSGPTSSMFARGSDKQFKPGVHIADRQPVIDFGKFPSPLRPYEEDVASEDFSIEPAEAEKAEESGKEDLHTDWPTEAEKASPAPAEKGDHKILSDDGVAERAAQWGLVVKGRAGVGARTSNEEKRTDSFQQQRGTSLSVRSSEDSEHGGLYIPRVSKDLKDALETFQQTFVVSDATRPDYPILYASAGFFKMTGYSSKEVIGRNCRFLQGADTDPDDVERIRESLAEGKNYCGRLLNYKKDGTAFWNLLTIAPIKDEEGNVLKFIGMQVEVSKHTEGHKVKALRPNGLPESLIKYDARQKDRAVMDVSELIQAVKHPHHNGHAPQHHPPSSVKSTIAEVPSVATVPPMTDRRSSLGPGKSDSMSDGIPKRHRSSGFRSLIGLDKFGKSAQQEPIEFIEPEILMTRDEETDSLDELDDKERLQEIRRGIDLATTLERIEKNFVITDPRLPDNPIIFASDSFLELTEYTREEIIGRNCRFLQGQDTDQKTVQKIRDAIREQREITVQLLNYTKTGKRFWNLFHLQPMRDQKGELQYFIGVQLDGSEQLEPIQKRLSEKTEKEGAKIVRATALNVEEAVGELPDANLTPDDLWANHSKSVSAKPHKVHSDLWKALQKIRERGEKIGLKHFRPVKPLGFGDTGSVHLVELRGSGELFAIKAMEKSVMLNRNKVHRACAEREILAVLDHPFLPALYASFQTQTHVCLVTDFCPGGELFLLLDRQPRKVFSEETARFYLAEIIIALEYLHCQGIIYRDLKPENVLLQRDGHVVLTDFDLSFITSCNPQLVRPPSPPGRRRKYKQMPPPFFMAEPVTTSNSFVGTEEYIAPEVITGAGHSSAVDWWAVGILLYEMIYGRTPFRGKNRQKTFANVLHKDLTFPSSIPASLAARQLINGLLHRDPANRLGSATGAYEIKNHAFFRGINWPLIRDMVPPPLEAPLELVGKDPDFDSREALEWDELEASSTFVSDVF

SEQ ID NO: 40858 - protein, 419 aa, Mycobacterium avium 104
MTATPREFDIVLYGATGFVGKLTAEYLAGAAPDKRIALAGRSTEKLHAVRDSLGDAAQSWPVLQADASSPATLNEMAARTQVVITTVGPYTRYGLPLVAACAAAGTDYADLTGEAMFVRDSIDSYHKQAADTGARIVHACGFDSVPSDLSVYALYRAARDDGAGELVDTDLVVRSFSGGVSGGTVASMLEVLDTASRDPEARRQLADPYTLSSDRGAEPDVGPQPDLPCRRGRQIAPELAGVWTAGFVMAPYNTRIVRRSNALLDWAYGRSLRYSESMSLGSSPLAPVASAVVGGTAAATFGLGSRYFRFLPRRLVERIVPKPGTGPSPSARERGYYRIETYTTTTSGARYVARMEQRGDPGYKATSVLLGESGLALAFDRDKLPQLYGVLTPAAAMGDALLDRFPGAGVSLQVDRLAG

SEQ ID NO: 40859 - protein, 137 aa, Arabidopsis thaliana
MGDIWTWLISFFFLIALVGIIVYQLVCLADLEFDYINPYDSASRINSVVLPEFIVQGVLCVFYLLTGHWFMTLLCLPYLYYNFHLYSKRQHLVDVTEIFNLLNWEKKKRLFKLAYIVLNLFLTIFWMIYSALDDYED

SEQ ID NO: 40860 - protein, 781 aa, Arabidopsis thaliana
MSLFLSFFISILLCFFNGATTTQFDFSTLAISNLKLLGDARLSNGIVGLTRDLSVPNSGAGKVLYSNPIRFRQPGTHFPTSFSSFFSFSITNVNPSSIGGGLAFVISPDANSIGIAGGSLGLTGPNGSGSKFVAVEFDTLMDVDFKDINSNHVGFDVNGVVSSVSGDLGTVNIDLKSGNTINSWIEYDGLTRVFNVSVSYSNLKPKVPILSFPLDLDRYVNDFMFVGFSGSTQGSTEIHSIEWWSFSSSFGSSLGSGSGSPPPRANLMNPKANSVKSPPPLASQPSSSAIPISSNTQLKTSSSSSCHSRFCKENPGTIAGVVTAGAFFLALFAGALFWVYSKKFKRVERSDSFASEIIKAPKEFSYKELKAGTKNFNESRIIGHGAFGVVYRGILPETGDIVAVKRCSHSSQDKKNEFLSELSIIGSLRHRNLVRLQGWCHEKGEILLVYDLMPNGSLDKALFESRFTLPWDHRKKILLGVASALAYLHRECENQVIHRDVKSSNIMLDESFNAKLGDFGLARQIEHDKSPEATVAAGTMGYLAPEYLLTGRASEKTDVFSYGAVVLEVVSGRRPIEKDLNVQRHNVGVNPNLVEWVWGLYKEGKVSAAADSRLEGKFDEGEMWRVLVVGLACSHPDPAFRPTMRSVVQMLIGEADVPVVPKSRPTMSFSTSHLLLSLQDTLSDCNTVALNSSRSSSWSVPEHNVIIRSDDDHLAAAEAKGLNPGLIVLLVVGGPLLVFLIANYVLYVYAQKNLPPRKKKPVSKKKLKREKLKQGVPVPGE

SEQ ID NO: 40861 - protein, 530 aa, Oryza sativa (japonica cultivar-group)
MAAQRRLLAEAPPHQPHPSRHQQGAPSSVWSAGYLNGWLSQRTAVFGLRLWVLIGIAVGAAIVLVLVLVFVCLSRRRRRRDDLASNLYPADTKILKQHLQQPTPPKDIQEIVRRQQRQQQTPTPTPPQPPPPAAQHGVQLAKAETPPPPQRTQPPVLPAGSTRSTAASGMSATTSGGSERDGATPRSTASGSAGPEVSHLGWGHWFTLRELEEATDGLAEENVIGEGGYGIVYKGTLQNSAMVAVKNLLNNRGQAEKEFKVEVEAIGRVRHKNLVRLLGYCVEGAYRMLVYEYVDNGNLDQWLHGDVGEVSPLTWEVRMNIILGTAKGLAYLHEGLEPKVVHRDIKSSNILLDQQWNAKVSDFGLAKLLCSERSYVTTRVMGTFGYVAPEYASTGMLNERSDVYSFGVLIMEIITGRSPVDYTRAPGEVNLVEWLKTMVAERKAEEVVDPKLPEKPSPKALKRALLVALRCVDPDGHKRPKMGHVIHMLEMDDLLCRDDKKPGRDAPQTSDRHSSRDGGNFSKRENQRYR

SEQ ID NO: 40862 - protein, 118 aa, Panax ginseng
LCSGGELFDRIIQRGHYSERKAAELTKIIVGVVESCHSLGVMHRDLKPENFLLVNKDDDFSLKAIDFGLSVFFKPGQVFTDVVGSPYYVAPEVLLKHYGPEADVWTAGVILYILLSGV

SEQ ID NO: 40863 - protein, 375 aa, Bifidobacterium longum DJO10A
MTENTHHDPAALDKLAEPFTVLPNDNPASDEKRQSLIDKPAFGQVFSDNMTHMTWTKGEGWSDRRVEPYAPLKMDPGASVLHYAQECFEGLKAYRHADGSTWLFRPDANAERFQNSAKRLYLPELPIDDFLGSVAALVKRDANWVPSRREYTLYMRPFMFASEPFLGVRAPQEVDYCVIASPSGPYFPGGVKPVSIWVEDKWFRTGPGGTGFAKCGGNYAASLLGEYKGVENGCEQVCFVDAATKTYLEELGGMNMMAVHKDGHVETPSLTGNILPGVTRRSLIQLLQDKGHDVVETMIALDQLLEDIKSGEVTEVFACGTAAIITPIGRFKSEKFDVTVADGGSGKLTCELRDELLGIQLGEVEDPHNWMWKVC

SEQ ID NO: 40864 - protein, 313 aa, Sinorhizobium meliloti 1021
MHKILTIGEILVEIIATEKGDGFRKATPLIGPFPSGAPAIFIDQAGKLGQPCAIISRVGGDDFGTVNLERLKRDGVDISGIEVDPLATTGSAFVRYRPDGSRAFVFNIRDSACGKITLDERMTRLVGECSHVHVMGSSLYAPSVVESILAAIGIVKAGGGTVSFDPNLRPEILKSPGMREALLTVLAETDLFLPSGDELFLFTEAKTESQAVAELLASGIKAVVVKRGAAGASYFDAGAALSLPGFPVEEIDPTGAGDCFGATFVSFWLNGASPREALEFAAASGARAVMHFGPMEGASTRAELERFISEQQA

SEQ ID NO: 40865 - protein, 375 aa, Penicillium chrysogenum
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPILLTEAPINPKFNREKMTQIVFETFNAPAFYVSIQAVLSLYASGRTTGIVLDSGDGVTHVVPIYEGFSLPHAISRVDMAGRDLTDYLMKILAERGYTFSTTAEREIVRDIKEKLCYVALDFEQEIQTASQSSSLEKSYELPDGQVITIGNERFRAPEALFQPNVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIVHRKCF

SEQ ID NO: 40866 - protein, 911 aa, Candida glabrata CBS 138
MKSDFKFSNLLGTVYRQGNVQFSHDGNMLLSPVGNRISVFDLVNNKSFTFAYEHRKNIATFDVNKQGTLLLSVDTDGRAILVNFKTRNVLHHFNFKDKCYSVKFSPDGRYFALAVGRFLQIWKTPDVSQDRQFAPFVRYRVHAGHFQDITSFTWSHDSRFLLTTSKDLTSRVWSINSEDKELVATTLAGHRDYVLGAYFNSTQEKIYTISKDGAVFTWEYISKAQKEGLDEEDLEDEDLSKLSWRITKKNFFYANQAKVKCCTFHINSNLLIVGFSNGEFRLYEMPEFVMVQQLSMGQNPVNTVSVNNSGEWLAFGSSKLGQLLVYEWQSESYILKQQGHFDATNSLTYSPDGSRVVTAAEDGKIKVWDVASGFCLATFEEHTSAVTAVQFAKKGQVLFSASLDGTVRAWDLIRYRNFRVFTATERVQFTCLAVEPSGEVVSAGSTDSFDVFVWSVQTGQLLDTLSGHEGPVSCLAFSMENAVLASASWDKTIRIWSIFGRSQQVEPLEVFADILAITITPDGKHVAVSTLKGQLTIFDIASGKQIGNIDCRKDIISGRFLQDRFTSKNSERSKYFTTINYSFDGKSIIAGGNNNSICLYDVPNEVLLKRFIVSRNMNLNGTLEFLNSSRMTEAGSLDLIDSSGEYSDLEDRIDGSLPGSHRGGDMSTRSSRPEIRVTSVQFSPTANAFAAASTEGLLIYSIDETLIFDPFDLDIDITPQATLEVLAEKDYLTALVMAFRLNEEYLINKVYENVPVTQINSVCNQLPVVYVSRLLTFIGNFATTSQHIEFNLLWLKALLIAHGSFMKQHEHMFSSATRAVRRFIGRIAEDVTFLSATNKYAYRFLTSTSGKGADSSEEEIQNISDSSSSDEDDVVMQSDDDEDGEWIGFQEKKQQLALSEDDSESEDELLQ

SEQ ID NO: 40867 - protein, 375 aa, Acremonium chrysogenum
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAIARVDMAGRDLTDYLMKILAERGYTFSTTAEREIVRDIKEKLCYVALDFEQEIQTAAQSSSLEKSYELPDGQVITIGNERFRAPEALFQPSVLGLESGGIHVTTFNSIMKCDVDVRKDLYGNIVMSGGTTMYPGLSDRMQKEITALAPSSMKVKIIAPPERKYSVWIGGSILASLSTFQQMWISKQEYDESGPSIVHRKCF

SEQ ID NO: 40868 - protein, 324 aa, Pachysandra terminalis
  misc_feature (319)..(319): Xaa can be any naturally occurring amino acid
  unsure (1)..(324): unsure at all Xaa locations
MLTASINGWCFTSLSPAAKSPLKKTTLSPSIFARLNSASPPPPLPSLIRKEPVFAAPAPYITPNLREDMGKDSYEEAIAGLKKLLSEKGDLDAVAAAKIEQITAELQTTESKAFDPIERMKTGFIHFKKEKYETNPALFGELAKGQSPKFMVFACSDSRVCPSHVLDFQPGEAFMVRNIANMVPAYDQIRYSGVGAAIEYAVLHLKVGNIVVIGHSCCGGIKGLMSLADDGTTSTDFIEDWVKICLPAKSKVKAEFGSLPLPEQCTYCEKESVNVSLGNLLTYPFVREGLVKKTLALKGGYYDFVNGSFELWGLDFGLXPSLSV

SEQ ID NO: 40869 - protein, 466 aa, Flavobacteria bacterium BBFL7
MTDMSKYDVIVLGSGPGGYVTAIRASQLGLKTAIVEKESLGGVCLNWGCIPTKALIKSADVFNYLNHAEDYGLKVTGVDKDFNAVVKRSRNVADGMSKGVQFLLKKNKVDVIMGYGTVKKGKKIEVKAEDGSTSTVEGKHIIIATGAKSRVLPNLPQDGKKVIGYREAMTLEKQPKKMIVVGSGAIGVEFAYFYNSMGTEVTIVEYVDRIVPVEDIDVSKQMERSFKKAGIKIMTSSEVTGVDTSGNGVKATVKTKKGEEVLEADIVLSAVGIETNLSNIGLEEIGISTDRGKVLVNDWYQTNIPGYYAIGDITAGPALAHVASAEGILCVEKIADMHVEPLDYGNIPGCTYSTPEIASVGMTEAQAKEAGYELKVGKFPFSASGKASASGAKDGFVKVIFDAKYGEWLGCHMIGAGVTDMIAEAVLGRKLETTGHEVLKAVHPHPTMSEAVMEAVADAYGEVIHL

SEQ ID NO: 40870 - protein, 467 aa, Roseovarius nubinhibens ISM
MAKRFAKRFGRNNKGPLMLSFDTLKDQVADGSVDTVLACLVDMQGRLMGKRFHAGHFIASAWEETHCCNYLLATDLEMATPEGFASTSWEQGYGDYVMKPDLTTLRPVPWLEGTVMVLCDVLDHHTHEPVPHSPRAMLKKQLARLDAMGFDAMMATELEFFLFEKSFEELRKDGYRDLQPYSGYNEDYNIFQTTKEEHVMRPIRNHLWNAGIPIENSKGEAEAGQEELNIKYAAALDTADYHTIAKHAVKEISWQQGHAASFLPKWHHDKVGSSSHVHQSLWKEGKPAFYDANDPLGMSELMKHYMAGLLKYAPDMTYFFAPYINSYKRFVKGTFAPTRIIWSVDNRTAGYRLCGEGTKAVRVECRVGGSDINPYLAMAALLAAGIAGIEEKLSLPAPFKGDAYGEDTGLIPGNLRDAREALLGSSMLRKALGEEVVTHYARAAEVELEDFDRIVTDYELKRGFERV

SEQ ID NO: 40871 - protein, 88 aa, Glycine max
MEFSFDEKDFVSCCGSTKFAKEMASASPFRSFQDAVSVAKGVWFNSVDVNGWLQAFSAHPQIGQTHAPSVASEASAQGIRKWILCNKM

SEQ ID NO: 40872 - protein, 175 aa, Triticum aestivum
  misc_feature (66)..(66): Xaa can be any naturally occurring amino acid
  unsure (1)..(175): unsure at all Xaa locations
MATAPNIEMIASSLRSCSLNGGGRRPGRRHRHGHARGAEGSNDSEGVTVELNSDVALPYHWQQCLXDIRTGQVYYINWEDGTRTTIDPRTPSLCSALSTPRSTCFTSHRAAFTSSSSSGYTSAASSVTGGYGYGYDDSDGYSEGYGDDEESSSSSSRSSGVSSVLSSFFPSNEPS

SEQ ID NO: 40873 - protein, 442 aa, Oryza sativa (japonica cultivar-group)
RVADSCGLLCGRRSRPFRAMASRRQWGAGAGAVDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVAA

SEQ ID NO: 40874 - protein, 255 aa, Triticum aestivum
  misc_feature (104)..(104): Xaa can be any naturally occurring amino acid
  misc_feature (118)..(118): Xaa can be any naturally occurring amino acid
  misc_feature (121)..(121): Xaa can be any naturally occurring amino acid
  misc_feature (144)..(144): Xaa can be any naturally occurring amino acid
  misc_feature (176)..(176): Xaa can be any naturally occurring amino acid
  misc_feature (199)..(199): Xaa can be any naturally occurring amino acid
  misc_feature (205)..(205): Xaa can be any naturally occurring amino acid
  unsure (1)..(255): unsure at all Xaa locations
MVKLAFGSCGDSFSATSIRAYVAEFIATLLFVFAGVGSAIAYGKITDDGALDPVGLVAIAIAHAFALFVGVAIAANISGGHLNPAVTFGLAVGGHITILTGIFXWVAQLLGSTAALLXRCXLLKFVTHGKAIPTHGVTAGMNEXEGVVLEPVITFALVYTVYATAADPKKGSLGTXIAPIAIGFIVGANILAAGPFSGXGSMNPXRSFGPAVAAGNFAGNWVYWVGPLIGGGLAGFVYGDVFIASYQPVADQDYA

SEQ ID NO: 40875 - protein, 559 aa, Zea mays
MELAVGGGMRRSASHTSLSESDDFELTRLLSKPRINVERQRSFDDHSLSDVSHSGGYGRGGFDGMYSPGGGLRSLVGTPASSALHSFEPHPIVGDAWEALRRSLVFFRGQPLGTVAAVDHASEEVLNYDQVFVRDFVPSALAFLMNGEPDIVKNFLLKTLLLQGWEKKVDRFKLGEGAMPASFKVMHDAKKGVETLHADFGESAIGRVAPVDSGFWWIILLRAYTKTTGDLTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFVGNVSPARMDFRWFALGNMIAILSSLATPEQSNAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSITGYLVAKMLLEDPSHLGMIALEEDKAMLKPVLKRSASWTN

SEQ ID NO: 40876 - protein, 504 aa, Aspergillus nidulans FGSC A4
MAQPVQLTAPNGVSYSQPTGLFINNEFVPAASGKTLTTVNPYDESIIATVSSAGPKDVDRAVAAARQAFASEWRGLTPSERGLLLLRLADLCDRDKEILATIDAWDNGKPYEQALGEDIAEVIAVFRYYGGWADKIHGSTIDTGDAKFAYTRHEPLGVCGQIIPWNYPVMMAAWKLGPALACGNTVVLKAAEQTPLSVLYLATLIKEAGFPAGVVNLLNGEGASAGAAIAGHPGVDKIAFTGSTNTGRVIMKAAAGNLKAITLETGGKSPLLVFDDANIDQAVKWSHVGIMSNMGQICTATSRIYVQETIYDTFVEKFKQYTIENSKVGSQFDPSVTHGPQISKAQRDRILSYVQSAKSEGAQLVLGDEPVSEKGYFVPPTIFKNTTREMSAVREEIFGPFVVIQSFSTQQDAINKANDTEYGLGAAVFTENITRAHRVAAAIQAGMVWINSSQDSHFAIPFGGYKQSGIGRELGEYALAAYTQVKAVHGKFSLPLEFNLGTWL

SEQ ID NO: 40877 - protein, 687 aa, Zea mays
DELRNLRGDDQQGPYQEHDRVYRYDVYNDLGEPDGGNPRPILGGSAEHPYPRRCRTGRKPTKTDPNSESRLSLVEQIYVPRDERFGHLKMSDFLGYSIKAITQGIIPAVRTYVDTTPGEFDSFQDIINLYEGGIKLPKIQALEDMRKLFPLQLVKDLLPAGGDYLLKLPIPQIIQEDKNAWRTDEEFAREVLAGVNPHGRSHASRSSRPRARWTPASTATTPAPSRRRHREDLEGLTVQQALDGNRLYILDHHDRFMPFLIDVNNLEGNFIYATRTLFFLRGDGRLAPLAIELSEPYIDGDLTVAKSKVYTRRPAAVEAWVWQLAKAYVAVNDSGWHQLVSHLAEKHAVMEYVVIATNRQLSVTHPVHKLLSSHFRDTMTINRLARQSLINGGGIFEMTVFPGKYALGMSSVVYKSWNFTEQGLPADLVKRGVAVADPSSPYKVRLLIEDYPYASDGLAIWHAIEQWVGEYLAIYYPDDGALRGDEELQAWWKEVREVGHGDHKDAPWWPKMQAVSELASACTTIIWIASALHAAVNFGQYPYAGYLPNRPTVSRRRMPEPGSKEYEELERDPERAFIHTITSQIQTIIGISLIEILSKHSSDEVYLGQRDTPEWTSDARALAAFKRFSDALVKIEGKVVGENRDPQLRNRNGPAEFPYMLLYPNTSDHSGAAAGLTAKGIPNSISI

SEQ ID NO: 40878 - protein, 576 aa, Coprinopsis cinerea okayama7#130
MIAMAAANGSLAVQTLSVQYLYYDTQVDLLAASLFIFSTTCFGCALAGLFRHFTVKPKGLIYPSVVPPLSLLRVFHAEPDSDRQWLSKGFSFTFWTTFIYEIFPAYIFPLLNGINIFCLASQTSTSQILQDAFTSLFGGASGNEGLGLFSVSFDWQFIGSSFQVNAWIGYALCYCATMGIYYSNIWNAFNLPILATTIFSPNGTVYDHTAIMDENFNIIPEAIREQGAPGLTGSFLWANIASNLGVGSLIAHALWFIGPRLLFPFMYRGSKEGKAPRFTVVLRHPYISQMPYMLALIAGTIAFPLANSLNAYLGHWMLPMHVAKMVGSLVLPGNPLGILYFSTWSESAVSNGMYFTSQLKLGQYLKIPSRVILFTQIWGLLTGALVNYATMARVIEHQQEAFTSPIGTNIWNGQVPQILNSEVVTWALAKELYSFDGPYFIVPLSLLLGASLTTIQALLHRIWPNLWFLDGSTLMLPVVFMYSSIMTFGITSSIISSILVGIICQLWIRNRWPVWFNDHSLIFGSALDGGAQCMLLLLSFTVLGGIEGSHKPFWQWVGNPVVGNVDYCNGNGALDR

SEQ ID NO: 40879 - protein, 375 aa, Suillus bovinus
MEEEVAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNAPAFYVAIQAVLSLYASGRTTGIVMDSGDGVTHTVPIYEGFALPHAILRLDLAGRDLTDHLIKNLIERGYSFTTTAEREIVRDIKEKLWYVALDFEQEIKTAGQSSALEKSCELPDGQVITIGNERFRAPEALFQPAFLGLEAAGIHETTYNSIFKCDLDIRRDLYANVVLSGGTTMFPGIADRMQKELTSLSPSSMKVKIVAPPERKYSVWIGGSILASLSTFQNLWCSKQEYDESGPGIVHRKCF

SEQ ID NO: 40880 - protein, 582 aa, Oryza sativa
  misc_feature (161)..(161): Xaa can be any naturally occurring amino acid
  misc_feature (190)..(190): Xaa can be any naturally occurring amino acid
  misc_feature (195)..(195): Xaa can be any naturally occurring amino acid
  misc_feature (207)..(207): Xaa can be any naturally occurring amino acid
  unsure (1)..(582): unsure at all Xaa locations
EEERSPAGGAAVAVYGESLRRPEEEGGRRKKGGWITFPFMAVSLLAFGLSSAGAMGNLVVYLVKEYHVPSVDAAQISTIVSGCISVAPVAGAIVPDAFFGCFPVVAVAMVFSVLALVVFTLTASVRGLTPAACVPGATACEAATAGQMAVLYAGVFLLCVXSAGARFNQATMGADQFEAAAERDVFFNWXFIFFXASAWLGFNVLVXVQDAVSWELGFGLAATIAAAGLAALLLGARYYRRPAARGSPFTGIARVVVAAARKRKIDVAAAAAASGDLKFYYGPRSGGLQEFGTRPSDDNNFAPSDSFSFLNRAAVITDGDVDAADAAAPLRPWRVCTVRQVEDLKAVLRILPLWSSSIFLSISIGVQLNFTVLQALAMDRAIGRFHVPAASMVVSSFVAVVVSLGLIDRALLPLWRALTGGRRAPTPLQRIGVGHVLTVLSMAASAAVERRRLATVRAHGEAARDDPAWVSPLPAAWLVLPFALSGAGEAFHFPAQVTLYYQEFPPSLKNTASGMVAMIVALGFYLSTALVDAVRRATAWLPDNMNASRLENLYWLLAVLVAINFGYYLACAKLYKYQNFGK

SEQ ID NO: 40881 - protein, 375 aa, Suillus bovinus
MEEEVAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNAPAFYVSIQAVLSLYASGRTTGIVMDSGDGVTHTVPIYEGFSLPHAILRLDLAGRDLTDCLIKNLTERGYSFTTTAEREIVRDIKEKLCYVALDFEQEMQTAAQSSALEKSYELPDGQVITIGNERFRAPEALFQPAFLGLESAGIHETTYNSIYKCDLDIRRDLYGNVVLSGGTTMFPGIADRMQKELTSLSPSSMKVKIVAPPERKYSVWIGGSILASLSTFQNLWCSKQEYDESGPGIVHRKCF

SEQ ID NO: 40882 - protein, 501 aa, Nicotiana tabacum
MAMAGLYRRVLPSPPAVDFASTEGKQLFLEAIQNGTMEGFFKLISYFQTQSEPAYCGLASLSMVLNALAIDPGRKWKGPWRWFDESMLDCCEPLEKVKAKGISFGKVVCLAHCAGAKVEAFRSNHSTIDDFRKQVMACTTSDNCHLISSYHRGLFKQTGSGHFSPIGGYHVGKDMALILDVARFKYPPHWVPLPLLWEAMNTIDEATGLHRGFMLITKLHRAPALLYTLSCKHESWVTISKHLMDDLPVLLSSENVKGIKDVLSTVLSNLPSNFVEFIKWIAEVRRQEENGQNLSDEEKGRLAIKEEVLKQVQDTPLYKHVTSILFSKNSICQSKAASDSSLANVAANICCQGAGLFAGRSGSSDRFCCLQTCVRCYRATGGNSATVVSGTVVNGNGEQGVDVLVPTSLAKTSCCPSGQAGCSPMHPASNDVLTALLLALPPHTWSRIKDTKVLQEIENLVSAENLPPLLQEEILHLRGQFLLLKKCKDNKVEEDLAAPPF

SEQ ID NO: 40883 - protein, 330 aa, Bacillus subtilis
  misc_feature (4)..(4): Xaa can be any naturally occurring amino acid
  misc_feature (63)..(63): Xaa can be any naturally occurring amino acid
  misc_feature (75)..(75): Xaa can be any naturally occurring amino acid
  misc_feature (77)..(77): Xaa can be any naturally occurring amino acid
  misc_feature (89)..(89): Xaa can be any naturally occurring amino acid
  misc_feature (127)..(127): Xaa can be any naturally occurring amino acid
  misc_feature (155)..(155): Xaa can be any naturally occurring amino acid
  misc_feature (210)..(210): Xaa can be any naturally occurring amino acid
  misc_feature (250)..(250): Xaa can be any naturally occurring amino acid
  misc_feature (255)..(255): Xaa can be any naturally occurring amino acid
  misc_feature (279)..(279): Xaa can be any naturally occurring amino acid
  misc_feature (316)..(316): Xaa can be any naturally occurring amino acid
  misc_feature (321)..(321): Xaa can be any naturally occurring amino acid
  unsure (1)..(330): unsure at all Xaa locations
SNAXKELIKEHQKDINPALQLHDWVEYYRPFAANGQSANYIPALGKVNDSQLGICVLEPDGTXIHAGDWNVSFTXQXISKVISFIAACXSRGIPYVLDRVDVEPTGDAFNSIIRLEINKPGKPFNPXINAGALTIASILPGESAYEKLEFLYSVXETLIGKRPRIHEEVFRSEWETAHRNRALAYYLKETNFLEAEVEETLEVYLKQCAXESTTEDIALIGLILAHDGYHPIRHEQVIPKDVAKLAKALXLTCGXYNASGKYAAFVGVPAKSGVSGGIXALVPPSARREQPFQSGCGIGIYGPAIDEYGNSLTGGXLLKHXAQEWELSIF

SEQ ID NO: 40884 - protein, 347 aa, Arabidopsis halleri subsp. gemmifera
CDNGTGMVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMW

SEQ ID NO: 40885 - protein, 221 aa, Candida glabrata CBS 138
MNSSEDYGYDYDYLFKIVLIGDSGVGKSNLLSRFTTNEFNLESKSTIGVEFATRTIKVEDKKIKAQIWDTAGQERYRAITSAYYRGAVGALIVYDISKSGTYENCNHWLTELKENADDNVAIGLIGNKSDLEHLRAVPTEEARGFASENQLFFTETSALNSENVDLAFRELIEQIYKMVNKHQVDLGENAKGSSGAPKGPTISLAPVPGEKKKKSKSNSCC

SEQ ID NO: 40886 - protein, 334 aa, Oryza sativa (japonica cultivar-group)
MATTRGQLPVEDVLRVNGSRRFAAALAAASPFASLADALLAARRIWLNEVDVNGWLEAFAAHPAIGTTSSSAPKWCKEEQSAALATATDSTAQELADWNARYREKFGFVFMICASGRTAPEVLAELKRRYENRPIVELEIAAQEELKITELRLAKLFASEPVAPPSSTVGGPTSQSDKAADRMRIIGAHLGSHTQHSANKAPEITGSSNRTRPPITTHVLDVARGSPASGIEVHLEMWKDASTPPSFNNKDFNGWATLGSSVTNNDGRSGQLMDIVNNVAPGFYRISFNTSKYAPSGFFPYVSIIFEIKKNQTTEHFHVPLLHSPFSFTTYRGS

SEQ ID NO: 40887 - protein, 765 aa, Xanthobacter autotrophicus Py2
MTEQRESAGADRPASRHVDFLLVGGGLASAVAAQTLRAEGATGSIVILSAEDVPPYHHPPLSKHLLTGTEGEARIFVHPESFYGEHRIELALGARVVGVDTAKQTVTTARGEEIGYGQLLIATGAAPKPLTVPGASLPGVFSLRRKTDADAIRAAITQAKHAVVLGGSFLGMEIAMSLLDAGLKVTIIEQGPVLLRHLEAPDLSSYFERYAEGRGATVILNDTAAVLRGRERVQEVETAAGRHVACDLVVVSIGVAPATEFLAGSAIALEGGYVVVDALLRTSAPNVFAAGDVTTFYDPVFARRRHIEHWDNAVKQGRLAARNMMGRRLRYDEVSYFFCEVGDIGFNVLGATEEADARVARGALDQGSFALFYLKGDVPRALFSVGRPADETRVAEGLIRYRVGLGDVKERLHEDAFVLDRIPTQTALILQGGGALGAFECGVVKALEEEGIFPDIVAGVSIGALNGAVIAGNPRHAAQALEAFWADLAVTTPNVPFPELRRAAAATRILTLGVPNFFTPRWGLPPYGPADWAANWTSCYDTTPMKALLAKYVDFAALKDSPVRLLVSAVNVMTATLDVFDSYVDDLTPDHVLASGSLPPGFPWTMVDGKAYWDGGIISNSPLDLVIDRCGPDGKRVFVVDLFSGERALPTNMLEVLARRDEIVYAERVHSDLRHRETVEAYRRLIDHILARLEPEESGRIKRIPAYIQLMGDGAATTITRFVRAGQAGEHSSRDYDFSDLAIKANQAEGYAVARKTLGRASPQG

SEQ ID NO: 40888 - protein, 268 aa, Oryza sativa (japonica cultivar-group)
MVGGMKEEGSMAQAAATAAAAAYSFYGSHLAGDHQHEIQAAAAGGGASNKSQLSQMLMASSPRSCITTSLGSNMLDFSNTAAPPELRSHHHNSDNSSECNSTATGSALKKARVQASSSAQSTLKVRKERLGDRITALHQIVSPFGKTDTASVLQETIGYIRFLLSQIEALSYPYMGDANGTGPMQNGPVGERNPGLFPEYPGQLLNHNGNTGAQQPAAQPEQQGANDDGKKDLRSRGLCLVPVSCTSHFGGDNAADYWAPAPLGGILR

SEQ ID NO: 40889 - protein, 374 aa, Acidobacteria bacterium Ellin345
MSTATQIGNEKDEAIPASMKAAVYHGLNDVRLETVPVPEIGRGEVLIRVASCGICGTDLKKISTGSHSAPRIFGHETAGVIAAAGDGVTKFQVGDRVLAFHHIPCQECYYCRHKVFAQCPTYKKVGVTAGYEPSGGGFSEYVRVMDWIVDRGGVVKLPDHVSYDLATFVEPVNTCQKAIETMALKSGETVLVIGQGAIGMILAFLAQRAGATVITSDLFPQRLTIGESLGLKNGIDANQTDVVAHMRDLTEGRGADASILAVPVNGLIRTAMDAVRPGGRVMLFAHTQRTEAKFDPSAVCMDEKTLLGSYSASVDLQKDSVDFVFSREMDLEKLISHRFPLEQAVEALQLAARPQPDSLKIMIEPRMAWEGQAK

SEQ ID NO: 40890 - protein, 345 aa, Acidobacteria bacterium Ellin345
MTAAVLYGKEDVRIEKVPVPKVGEGEILVKVQVALTCGTDVKVYRRGYHARMIVPPALFGHELAGIVEEVGPGVKRLKKGMRVVALNSAPCGVCFYCSKHQENLCEDLLFNNGAYAEYILIPKRIVEKNLLVIPDGVSFDEAAVIEPLACVLRGLHETGMEVGDTITVIGAGPIGLMFVKAASISGCKVISVVKHDEQVEAAKKMGAHKVVQITKVDDPVKAVIELTPEHRGSDIVIEAVGRPDAWEWTIDMVRKGGTVNFFGGCAKGTKVNLNTERLHYSEITLKATFHHTPETVRKAFALIAERKIKGSDYITGEAPLSRLTQVFKMMIERGGEIKTAIIPGH

SEQ ID NO: 40891 - protein, 475 aa, Azoarcus sp. EbN1
MTLVRDKLFIDGRWVAAQGGGFIDVIDPSDASVYARIPEGVPADAEAAIAAARGAFDSWSRTSPAERAQYLERIAAGFQARSDELADAIAHEVGMPLKMASRIQVGGPLWSWQHYAKLAREFEWEARVGNSLVVREPVGVVGAITPWNFPLNQITLKVAPALAAGCTVVLKPSEVAPINAFILAEIIEAAGLPAGVFNLVTGYGPVVGEVLASDPRVDMVSFTGSTHAGRRVAELAAATVKKVALELGGKSAAIVLDDADLAAAVKGTVSNCLLNSGQTCSAHTRMIVPRAKVDEAATLAAAAASSFKVGPALAEGSRLGPLVSQAQRDRVVGYIRRGLDEGARLACGGVDAAPAGAGFFVAPTVLVVEDPKATVAQEEIFGPVLVIVPHDGDEDAILLANDSIYGLAGSVWAGTDEHALAVARRIRTGQVDVNGAPWNPLAPFGGYRQSGLGRENGVYGLEEFLEYKAIQLRPR

SEQ ID NO: 40892 - protein, 537 aa, Pinus taeda
MANGIKKVEHLYRSKLPDIEISDHLPLHSYCFERVAEFADRPCLIDGATDRTYCFSEVELISRKVAAGLAKLGLQQGQVVMLLLPNCIEFAFVFMGASVRGAIVTTANPFYKPGEIAKQAKAAGARIIVTLAAYVEKLADLQSHDVLVITIDDAPKEGCQHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQGYGMTEAGPVLAMNLAFAKNPFPVKSGSCGTVVRNAQIKILDTETGESLPHNQAGEICIRGPEIMKGYINDPESTAATIDEEGWLHTGDVGYIDDDEEIFIVDRVKEIIKYKGFQVAPAELEALLVAHPSIADAAVVPQKHEEAGEVPVAFVVKSSEISEQEIKEFVAKQVIFYKKIHRVYFVDAIPKSPSGKILRKDLRSRLAAK

SEQ ID NO: 40893 - protein, 93 aa, Zea mays
MSGRARGGKGLVKGGTKRHRKVLRNSIQGITKPAIRRLARRGGVKRIYGLIYEETRGVLTISLQNVIRDAATYNEHSRLMNGTAMDVDYALKH

SEQ ID NO: 40894 - protein, 763 aa, Oryza sativa (japonica cultivar-group)
MASSHQEDREEEEEHSHGDDEITAPFLRPSTSRGSPELEEEENSPIEQVALTVPVSDEPETPVLTFRMWVLGTASCAVLSFLNQFFWYRKEPLTITAISAQIAVVPLGRLMAAALPERAFFRGRPWEFTLNPGPFNVKEHVLITIFANSGAGTVYAIHVITAVRVFYGKHISFFVSLLVVLTTQVVDDQVLGFGWAGIFRRYLVEPAAMWWPSNLVQVSLFRALHEKEARSKGGLTRNQFFLVAFICSFAYYIFPGYLFQMLTSLSWICWVFPHSVLAQQLGSGLSGLGIGAIGLDWSTVSSYLGSPLASPWFATANVAAGFFFIMYIITPIAYWFNFYKAQNFPIFSDGLFTSTGQKYNISSIVDSHFHFDTKAYEKNGPLYLSTFFAVTYGVGFASLTATIVHVLLFHGSEIWQLSKSAFQEKRMDIHTKLMRRYKQVPEWWFVCILIANIAVTIFACEYYIEQLQLPWWGVLLACAIAFFFTLPIGIITATTNQTPGLNIITEYIMGYLYPGRPVANMCFKVYGYISMSQALTFLQDFKLGHYMKIPPRTMFMAQVVGTLIAAFVYIGTAWWLMETIPNICNTELLPSDSPWTCPGDHVFYDASVIWGLISPRRIFGDLGTYSAVNWFFLGGAIAPVLVWFAHKAFPNQNWILLINMPVLIGATGQMPPATAVNYTTWILVGFLSGYVVYRYRRDWWERHNYLLSGALDAGLAFMAVLIYLCLGLENISLNWWGNDLDGCPLASCPTAKGVVVDGCPVYT

SEQ ID NO: 40895 - protein, 310 aa, Streptococcus thermophilus
MLITEDKYFIFDKPRNENFVYKTKYCITVMQCIGYKVLKTIFRKKASDDKKYYVSICGIFKDEAFYLKEWIEYHKKAGVDHIYLYNNNSTDNYLTVIKPYLEEGYIDLINWPKSQAQMEAYHDCFNRFRNETSWLGFIDIDEFIVPIENKSVKEYFKEHAYEQSILIYWKMFGSNGLIHRDIKRPVTKDFTSCWYKYDDIGKCFINTEFEISDKQPILHHMLWTKRGVFNMPPVNCCGKICPRDWYNPADRDVFPIQINHYVLKSYDEYMSKVNKSDVMFTQNPKGEEHFRRHDRPSTSTDFTISKFLEK

SEQ ID NO: 40896 - protein, 467 aa, Acidobacteria bacterium Ellin345
MATQIKFGTSGWRAIVAEDFTFANVRRAVTGIAKFVARRDQHPSLIVGRDPRFLGEAFVAEAAAILASHGVKPFVINDAAPTPGIAWEIMTRKTGGAINFTASHNPPEYNGIKYSTPDGAPALPETTQGIEAEIAKLDAVDPVKPNSSDPEAETIDIKANYLSRLKEVVDLAAIKKSGLKVVYDPLWGAARGYPDSLLRDAGVSTATVHDVRDVLFGGHAPEPDDHLLNDLRAKMKETGAGIGIATDGDADRFGIVDADGTFIQPNYIIALLFDYLVETRGWKNGVAKSVATTNLVNALAEHHKVELHETPVGFKYIGELIKQDKIAIGGEESAGLSIRHHVPEKDGVLACLLCCEMVAKRGKPMGAQLHELFGKVGSFYPERQNFHLTPEQKETFTKKLKSEPKDFHGKRVVEINRKDGLKLVLDDGSWVCYRVSGTEPVVRAYTEARSEQGLKDLSAAAKQFVFG

SEQ ID NO: 40897 - protein, 217 aa, Zea mays
MFFLKDPPPTMSPPQPPHPVPRETVASAVASLTTWMKKRAAEARPNLLADERDDIVVLQLSLRRIPASRSTKPRLLPMPHPVVGHDGASVCVISDDRTKSRSPSASDLLHASKSLHRLPVSDVIPLSTLRTDYRPYESRRRLAASHDLFIADRAIVPLLPRVLGKAFYATKKAPIGVDFSRVGWPEQVRKVLGSAFLYLRSGTCSGIKVGRLDMEEE

SEQ ID NO: 40898 - protein, 140 aa, Methanocaldococcus jannaschii DSM 2661
MKERTFVALKPDAVKRKLIGKIIERFENKGFEIVAMKMIKLDREMAEKYYEEHKGKEFYERLINFMTSGRMIVMVVEGENAISVVRKMIGKTNPAEAEPGTIRGDFALTTPDNIIHASDSKESAEREIKLFFKEDEIFDK

SEQ ID NO: 40899 - protein, 485 aa, Arabidopsis halleri
MAMASLYRRSLPSPPAIDFSSAEGKLIFNEALQKGTMEGFFRLISYFQTQSEPAYCGLASLSVVLNALSIDPGRKWKGPWRWFDESMLDCCEPLEVVKEKGISFGKVVCLAHCSGAKVEAFRTTQSTIEDFRKFVLKCTSSENCHMISSYHKGVFMQTGTGHFSPIGGYNAERDMALILDVARFKYPPHWVPLKLLWEAMDSIDESTGKRRGFMLISRPHREPGLLYTLSCKDESWIDIAKYLKEDVPRLVSSQHVDSVDKIISVVFKSLPSNFNQFIRWVAEIRITEDSNQILSAEEKSRLKLKQLVLKEVQETELFKHINKFLSSVGYEDSLTYAAAKACCEGAEILSGSPSKEFCCRETCVKCIKGPDDSEGTVVTGVVVRDGSEQKIDLLVPSTQTECVSGPEANYPAGNDVFTALLLALPPQTWSGIKDQALMHEMKQLISMASLPTLLQEEVLHLRRQLQLLKRCQENKEEEDLAAPAY

SEQ ID NO: 40900 - protein, 171 aa, Prochlorococcus marinus str. MIT 9312
MKFLKLISIFLIFFGNFSYKNLVHAEIKNAKDYKVLSKLSNQLSISNVDYYLKQGDKSIKNGDFDKAKDFYLDARNLAKQLASFYSDLNTSFKGIDARIPNEMQRKGKQTLQILAESNERLASLYIKTEKPDVAVPLLVETIRIMSPNSQEGKEAYERLIQLGFVETKYKG

SEQ ID NO: 40901 - protein, 242 aa, Oryza sativa (japonica cultivar-group)
MVPRSTSGASACPLFWAESENTIFTAILRKLRPFAGDGEKAPRKMRTKSNQPHKHHGAVELQAKVNSKCFFDVEVGGEPAGRIVIGLFGEVVPKTVDNFRALCTGDKGYGYKGCSFHRIIKDFMIQGGDFQNNNVRVAHPNADAGTGGRSIYGECFDDENFTLKHTGPGVLSMANAGPDTNGSQFFICTVKTPWLDNRHVVFGHVLEGMDVVKNLESQETSRSDIPKQPCRIVNCGELPVDG

SEQ ID NO: 40902 - protein, 506 aa, Saccharomyces cerevisiae
MPTLYTDIEIPQLKISLKQPLGCFINNEFCPSSDGKTIETVNPATGEPITSFQAANEKDVDKAVKAARAAFDNVWSKTSSEQRGIYLSNLLKLIEEEQDTLAALETLDAGKPYHSNAKGDLAQILQLTRYFAGSADKFDKGATIPLTFNKFAYTLKVPFGVVAQIVPWNYPLAMACWKLQGALAAGNTVIIKPAENTSLSLLYFATLIKKAGFPPGVVNIVPGYGSLVGQALASHMDIDKISFTGSTKVGGFVLEASGQSNLKDVTLECGGKSPALVFEDADLDKAIDWIAAGIFYNSGQNCTANSRVYVQSSIYDKFVEKFKETAKKEWDVAGKFDPFDEKCIVGPVISSTQYDRIKSYIERGKREEKLDMFQTSEFPIGGAKGYFIPPTIFTDVPQTSKLLQDEIFGPVVVVSKFTNYDDALKLANDTCYGLASAVFTKDVKKAHMFARDIKAGTVWINQSNDEDVTVPFGGFKMSGIGRELGDNVVDTYLQTKSVHMDLSLDN

SEQ ID NO: 40903 - protein, 493 aa, Bacillus cereus ATCC 14579
MEKGDRVAIMLPNCPQAVIGYYGTLLAGGIVVQTNPLYTERELEYQLHDSGAKVILCLDLVFPRVTNVQSATKIEHIIVTRIADFLPFPKNLLYPFVQKKQSNLVVKVSESETIHLWNSVEKEVNTNVEVPCDPENDLALLQYTGGTTGFPKGVMLTHKNLVSNTLMGVQWLYNCKEGEEVVLGVLPFFHVYGMTAVMNLSIMQGYKMVLIPKFDMKMVFEAIKKHKVTLFPGAPTIYIALLNSPLLKEYDISSIRACISGSAPLPVEVQEKFEKVTGGKLVEGYGLTESSPVTHSNFLWEKRVPGSIGVPWPDTEAIIMSLETGEALPPGEIGEIVVKGPQIMKGYWNKPEETAAVLQDGWLHTGDVGYMDEDGFFYVKDRKKDMIVASGFNVYPREVEEVLYEHEKVQEVVTIGVPDPYRGETVKAFVVLKEGTECSEEELNQFARKYLAAYKVPKVYEFRDELPKTTVGKILRRVLIDEEKRKNEDEQTG

SEQ ID NO: 40904 - protein, 443 aa, Triticum aestivum
  misc_feature (158)..(158): Xaa can be any naturally occurring amino acid
  unsure (1)..(443): unsure at all Xaa locations
LFGWASSPLSPVEYYSLGLFESYRGTLFSSGATVAIKRFGRSAWPDARQFVEEARAVGLLRSGRLSNLIGCCCEGGERLLVAEFMPHDTLAKHLFHWETKPLSWAMRVRAALYVAQALEYCTLKGRALYHDLHAYRVLFDVDGNPRLSCFGLMKNSRXGKSYSTNLAFTPPEYLKTGRVIPESVVYSFGTILLDLLSGKHIPPSHALDLIRGRNITVLMDSCLDGHVSSSDGTEMVRLASRCLQYEARDRPNLKAVVSALASLQKDASAPSHTLLGISQDAVKENAEQVSFSATEKAYATADLEQVHELLENEGYDEDETASFNVSLSSWPGQPSESIQVKKNGDDAFQSKDFTTVLECYSRFIDTGAMESPTMLVRRGFANVVLGRMEDALEDARRAEGISPEWPTAHYLQGMALIGLGMELDGHEKLRIAASLEAQRTGRN

SEQ ID NO: 40905 - protein, 121 aa, Porphyromonas gingivalis W83
MDFIKIVNEEFKSGKEHPKFNSGDTITVEYRIKEGNKERIQKYRGVVIRISGHGDKKRFTVRKISDGIGVERIFPIESPFIENITVEKYGKVRRAKLYYLRGLTGKKARIKERRVALSSKD

SEQ ID NO: 40906 - protein, 148 aa, Rhizobium leguminosarum bv. trifolii
FYTNSGSESVETALKVALAYHRVKGNGSRFRLIGRERGYHGVNFGGISVGGIVTNRKMFGTLLTGVDHMPHTHQPGKNNFTRGEPEHGGDIATELERIVTLHDASTVAAVIVEPVAGSTGVLIPPKGYLQKLREICTKHGILLIFDEE

SEQ ID NO: 40907 - protein, 158 aa, Triticum aestivum
VSLSVARRGEADRYIQMEGLQRSSSTFRRSGSSGLVWDERFLTEGAEAKAAGEGGTDEAQPEMRRSRSTGGVGMMLRRGGDDKKQQQQKKKEQQGQKKDEERDPQVFRTKEVAPDVDPPSPRVSGCILCAIFGGSGSGPGPAARRGRAKPKRRQRSAA

SEQ ID NO: 40908 - protein, 219 aa, Trichodesmium erythraeum IMS101
MKTTSDQKQPSSSREDQPLILVETAFLASTASLIWFINYYFPVGPLLKIFFPIPTALLYLRWGSRASWMGAIVSGLLLSILMGPTRSILFVIPFALMGVMLGALWRRGKSWFVSITYGSLLGSIGFFFRFWLLSILLGQDLWIYLITQATELVEWVFVKLGLLNQPNLLLVQLIALILIFINNVIYLSVVHLVALLLLDRIGNSIPRPPKWIKKLLDYD

SEQ ID NO: 40909 - protein, 257 aa, Methanocaldococcus jannaschii DSM 2661
MLILAGLGLYDENDMTLKTLKFAKKAEKIYAEFYTAVLTGTTTEKIEEVLGKKIHVLSRKDVEYNGYKLIEEAKDKDIMFLTAGDPMVATTHVDLAIEAKKKGIEVLIINAPSIYSAVGITGLQLYKFGKTTSIVFPEENYFPETPYNVIKENLERGLHTLCLLDIRIDENEKRFMTANEGLKVLLELENRKKEGIINEDTKAVVVARAGSLKPKLVYGKIKDLINYDFGEPLHCIIIPGKLHFMEEDALKYLCENI

SEQ ID NO: 40910 - protein, 338 aa, Oryza sativa (japonica cultivar-group)
MADAKQQQQQQTAATATGVWKTLKPFVNGRGLRDARHLRHPAHRHGQGSEVGDGIGVLGWVGLLARGGGLGSVVMEGDLVKIQLGEGSAAQVTKNMLANEGIGSFYKGLSAGLLRQATYTTARLGSFRVLTNKAIEKNDGKPLPLVQKAFIGLTAGAIGACVGSPADLALIRMQADSTLPIAQRRNYKNAFHALYRIIADEGVLALWKGAGPTVVRAMALNMGMLASYDQSVELFRDKLGAGEVSTVLGASAVSGFFASACSLPFDYVKTQIQKMQPDASGKYPYTGSLDCAMKTFKSGGPFKFYTGFPVYCVRIAPHVMMTWIFLNQIQKFEKQIGI

SEQ ID NO: 40911 - protein, 149 aa, Oryza sativa (japonica cultivar-group)
VEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 40912 - protein, 444 aa, Glycine max
MATIVSIKARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVSLAVCKAGASVLKIPLYKHIANIAGNKKLVLPVPAFNVINGGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 40913 - protein, 258 aa, Gloeobacter violaceus PCC 7421
MRHSALVLGLVAISAVSLTGCGSDRAPGASSTEFGYAIECKKPTGDRAPLELRAGEVRQAYDLCLQPKKIAYEGRPAKIIWGQTAPLGPVIAELHQNAQGKPAMEVTGGRNTYQMTLQVGSERIAFNFSASGLDAVSATPRNVVDTSTDFTGELVVPSLRGLGYTDSRGRGTDYGYENSQSTYANSGAAYDEATKESRARETGEGRMVLSIESVNSQTGEIAGSFKSKQSSGLAVLPGEVDVEGRFIGTFKPKKESAS

SEQ ID NO: 40914 - protein, 527 aa, Hordeum lechleri
MAHVHVDEMLHGAAAAPRSLLIATAVLFSLVVLPLLLRIITKQGAASDAKLLSLLPSPPSKLPIIGHLHLMGDLPYVSLAGLAAKYGPELMLVRLGAVPTAVVSSPRTAEAVLRTHDHVFASRPRSMVFDIIMYGQTDSCFAPYGDHFRKARKLVTVHMLNARKIRSQRPAREEEVRLVIGKIAKAAAAREAVDMSELLHSYVNDLVCRAVSGKFSQEEGRNKLFRELTDINAALLGGFNILDYFPSLGRFELVCKVACAKARRVRKRWDLLLDKLIDDHAARMVSREDEAQGEQEEDKDFIDVSLSLQQEYGLTRDHIKAILIDMFEAGTDTSYMTLEFAMAELIRKPHLLNKLQEEVRRNVPNGQEMVAEDDLPNMTYLKAVIKETLRLHPPVPLMIPHFSLDACTVDGYTIPANTRVVINAWALGRHSSYWENENEFQPERFMNGAGVDLKPNEFHYLPFGFGRRMCPGVHSASATVETMLANLMYRFDWKLPPGLKEEDIDMTEVFGITVSRKEKLILVPVTV

SEQ ID NO: 40915 - protein, 881 aa, Streptococcus agalactiae A909
METKFVYHFDEGCKEMKELLGGKGANLAEMTSIGLPVPQGFTITTQACNDYYDNACHIRESILSQIDQAMAQLEVEQNKQLGSVDDPLLVSVRSGSVFSMPGMMDTVLNLGLNDRSVQGLVKKTEDERFAYDSYRRFIQMFADVVTGIPKYKFDTILDRLKTDKCYQDDTELTGSDLKRLVEFYKELYQKEAGEKFPQDPKRQLLLAIEAVFKSWNNPRAKIYRKLNDIPETLGTAVNIQAMVFGNMGNNSGTGVAFTRNPSTGAANLFGEYLINAQGEDVVAGIRTPQSISKLAEQMPIIYQEFVSVTQKLEAHYRDMQDMEFTIENGNLYMLQTRSGKRTAKAAIKIAVDQVNEGLISKEEAILRIEPKQLDQLLHPSFDLKSLKKAIILTTGLPASPGAAYGKVYFHAEDVVKEMKKGNPVLLVRQETSPEDIEGMVSANGIITARGGMTSHAAVVARGMGKPCVAGCSQLLVDEVRREISIGHQTIKEGEMLSIDGATGNVYIGQVPMAETSVDRDFEIFMKWVDENRDMMVCSNADNPRDAQKALDFGAEGIGLCRTEHMFFDDERIPVVREMILADEILSRRKALERLLSFQRDDFYQIFKVLKGKACTIRLLDPPLHEFLPHDKESIESMARQMGISTLAIEKRIQTLEEFNPMLGHRGCRLAITYPEIYQMQVRALVQGAILAMKEGYEAKPEIMIPLVTAHEEISIIRDLIEETIVEESKSKKINLSFPIGTMIETPRACMIADDIAKFADFFSFGTNDLTQMSFGFSRDDAGKFLGEYVDKGLLKKDPFQVLDQKGIGRFIEQAVRLGKEVKPNLKIGICGEHGGEPSSIEFCYQLGLHYVSCSPFRIPIAKLAAAQAKIKQSRNDITIDK

SEQ ID NO: 40916 - protein, 209 aa, Glycine max
MALSVSSPSCVRVPSCFWKPNGKSCKERTKVSCAAHNDNKNPLVGIGIGVVTSCVMGLTALDADATRIEYYATVAEPLCEYNYVKSGLGYCDIAEGFGDEAPLGELINVHYTARFADGIVFDSSYKRARPLTMRIGVGKVIKGLDQGILGGEGVPPMRIGGKRKLQIPPHLAYGPEPAGCFSGDCNIPANATLLYDINFVEVYSGNRSK

SEQ ID NO: 40917 - protein, 355 aa, Zea mays
MATSSVLPLHLLSCARRASTSTSTAARASAAPAVAATTAQSLEESFGRKGLRFVADPAGGPLAAELSVRNGSSLHLRLGDGLVTSYRPKVYWKDDGCREVLHTVAGKGGVGLVLNDATSSSAQPSLVDGAEWAVRDADSDSYDAVQVELGCTIGKLDISYVVTLYSLSMATAVIVRNTGSKPVALTGAVLSHIKFDKRGGTAVEGLRGCPYCSYPPPAAAFSLLSPAEAMKREDPGWFGGAEELRQGVWTVEEDLYTTLKKKVSRVYAAPPEERKKRVYSTAPSKFTTIDQYSGLGFRLVRMGFDDMYLCSPGGMYDKFGKDYFLCTGMASMLVPVVVNPGEEWKAAQVIEHDNL

SEQ ID NO: 40918 - protein, 155 aa, Nicotiana tabacum
MSSSKMIVLKSSDGETFEVEEAVALESQTIKHMIEDDCADTSIPLPNVTSKILAKVIEYCKRHVDATKTEDKASEDELKGFDSDFVKVDQATLFDLILAANYLNIKSLLDLTCQTVADMIKGKTPEEIRKTFNIKNDFTPEEEEEVRRENAWAFE

SEQ ID NO: 40919 - protein, 170 aa, Prochlorococcus marinus str. MIT 9312
MEKLEKLISTYENYPKAGVSFKDVIEIVQHPSIFRQLILEMAKSKIIKEAEALISIDARGFIFGSAISIQAAKPMIVARKPGKLPGELVTKKYSLEYGENSLSIQKKALKKYNSFAIIDDLLATGGTVNCVSELINNNNKKVVGLLVVAELSKFDGRSRFNFPVESSILF

SEQ ID NO: 40920 - protein, 459 aa, Oryza sativa (indica cultivar-group)
MTTGDRLCNIDECKEPNKCYGKCRNKEGGFDCTCPFGTRGNAYTGPCDGGLAIGICASLLVTLTILLGIEWFRYKQRIIRKDLMRQREEHMRQREEYFHLRGGQLLRNMMSRDNNIPFMLYDRDQIESATNGFDNMLVIGQGGQGTVYRGCINLHPDNPVAIKKCKGFDEDSWAEFTDELLILSRVNHENIVKLLGCCLQFDVPILVYEFVQNKTLYNLIHIQNDPSIRTLEIRLKVAAESAEALAYLHSSVDHPIILHGDVKSTNILLNKNFIAKVSDFGCSKIRTADENYDVVKGTMGYLDPEYLRNFQLTDKSDVYSFGVVLLELLTRRMPLSVDKVSLASIFQEAMREGHFLELIDAEILHEDNMGLISDLATLANRCLIMTSESRPTMSTVADELRRRMAGQVQQDQGVLTGTSSSLALTASSGANTSEYLTGERSTDYYDLERVASMNIEFAR

SEQ ID NO: 40921 - protein, 392 aa, Roseovarius nubinhibens ISM
MIPSILPTYNRAPLSFVKGEGSWLIEADGRRFLDLGAGIAVNALGHAHPKLVAALTEQAGKLWHTSNLYHIPAQQALADKLVEHSFADTVFFTNSGTESCELAVKMARKYWYEKNAPERVEIIAFHGSFHGRSSAGIAAAGSEKMTKGFGPLLPGFKHLDWGDLEGLKGAIDSRTAAVLLEPVQGEGGIRPMADHDLRALRQICDEAGILLIFDEVQCGMGRTGRLFAHEWAGVTPDIMMVAKGIGGGFPLGAVLATEAAAVAMTAGSHGSTYGGNPLACAVGCAVMDEVTAPGFLETVNTRASQLQQKLGGLVEAYPEVFAELRGSGLMLGLKCVAPNTDVLQACYEAGLITVPAGDNVIRLLPPLTLSEDEVTEAVSRLDHAARAIKDRL

SEQ ID NO: 40922 - protein, 491 aa, Zea mays
MGARCSKLSVCWWPPHFKSPMLENGAAGDDGSGVPVFAEYSFDDLRVATDGFAPDRIVSEHGEKAPNVVYRGTLFSSGRTVAIKRFGRSAWPDSRQFLEEARAVGQLRSGRLANLIGCCCESGERLLVAEFMPHETLAKHLFHWETNPLSWAMRMRAALYVAQALDYCSSKGRALYHDLHAYRVVFDVDGNPRLSCFGLMKNSRDGKSYSTNLAFTPPEYLKTGRVSPESVVYSFGTVLLDLLSGKHIPPSHALDLIRGKNFLVLMDSCLEGHVSNSDGTDLMRLASRCLQYEARDRPNLKTVVSGLTSLQKDAYTPSHTLLGIQHDKNNSGQVSLSAIGKAFARADLNEVHEILLHDGYNEDDEANAELSLQSWNGDISESFVVKRRADNAFRSKEYTTAIECYSRFLDSGAVVAPTMLGRRCFAHVVAGNPQEGLEDAKRAEIIASDWPMGHYLQALALHKLGREAESQEALKNGTALEAARNSRARTV

SEQ ID NO: 40923 - protein, 473 aa, Mycobacterium sp. JLS
MSDGRHVTDAAALAFGEREYSLNELDALASGMATSLEQRGVRAGDRVAMMSSNRPEFVAALRGIWNLGAAAVLISPAWKHAEVAHALELTRPSHAVGDHPVLAEHMPMLHLDEPVTPGRREFDAVDPGADALFVFSSGTTGMPKAVRHTHGAFAAAVRHWRDALELSSADRMQIMTPPSHILGLLNIVMALETGTWLRLHPRFDIDTMLHHVESDRITIEMAVAPIALALAAHPKLESYDLSSLRYIMWCATPVTKSVADDVTRRTGVEWVAAYGTTELPVIAANPVTGARLDTVGKPVPGVRVRIVSLDDGTPLGPGEVGEIQVRSDSVMAGYLPREATSAAFADGWYRTGDVGRLDAEGWLRITDRSKEMIKVRGFQVAPAEVEAVLHGHPAVEDCAVFGEPHPTDGEAVVAAVTTNSDVPADELTELVAGTLASYKRPSRVVFVPAIPRLPSGKVLRRVLKEQHGCTSDS

SEQ ID NO: 40924 - protein, 317 aa, Ulmus pumila
MRFWALTTLSLLLSIIQVAWADQCGSQAGGAVCPGGLCCSKFGWCGNTNEYCGDGCQSQCGSGTGGDIGGLISSSAFNDMLKHRNDGGCPAKGFYTYDAFIAAAKAFPAFGTTGDDATRKREIAAFLGQTSHETTGGWASAPDGPYSWGYCFNREQNPSSDYCSSSPTWPCASGKRYFGRGPIQLSWNYNYGQCGRAIGADLLNNPDLVATDPVISFKTALWFWMTPQSPKPSCHDVITGRWSPSGTDQSAGRVAGYGMITNIINGGIECGKGQVPQVEDRIGFYKRYCDILKGGYGNNLDCYNQRPFGNGLLLDTM

SEQ ID NO: 40925 - protein, 95 aa, Synechococcus sp. WH 7805
MAADPLTPEVSDRICRHMNDDHSDAVLRYAHHYGGVPSATAATMKEVTANAMTLDVDDQAVRIPFDHVLTDSEDAHRTLVAMLRAMPAPVTGGES

SEQ ID NO: 40926 - protein, 135 aa, Klebsiella pneumoniae
MPMFLLLEKAHAGAVFQLEDILPSIPWDSHGLIAAIAQQYDTGEVLMLAWMNQQALDETLLTGRACYWSRSRSCLWRKGETSGCVQQVHDIRLDCDGDAVLLLVDQKGGACHTGRRSCFYNAIKGDELTVLNDPG

SEQ ID NO: 40927 - protein, 396 aa, Arabidopsis thaliana
MMNGIKSSPCNMPYLPDDLLLNILGRVSRLYYPILSLVSKRFRSLVGSLELYKIRTLLGRRTENCLYLSLRFSYGSNPRWFTLCRRPTRTPSPEPNLKSRWFTSCFRPILTNLTRATSKEEKKLSENLMVSIPTSNDCPLSGLTCNTIGSYIYMIGGYINGVLSSRVFFLDCRSHTWHEAPSMQVARKSPLVNVLDGKIYVVEGWRGSDYSNLIEIFDPKTQKWEHVPSPSAEMRGRYISKGLVYEEKLYLFGDKNVVYKPKESRWDALGFDMNLWLVSYGSSCVIDNVCYMVFYKRLIWYDSEVRYWRVLKGLEKLPKLRHRRSCIRMVDYGGKIAILWEKKVRVVGSDKKMIWCTEIALERRSAHKIYGKIEWCDVVLTVPKSCSLLEFIAVTI

SEQ ID NO: 40928 - protein, 214 aa, Oryza sativa (japonica cultivar-group)
MEYYEQEEYATVTSAPPKRPAGRTKFRETRHPVYRGVRRRGPAGRWVCEVREPNKKSRIWLGTFATAEAAARAHDVAALALRGRGACLNFADSARLLRVDPATLATPDDIRRAAIELAESCPHDAAAAAASSSAAAVEASAAAAPAMMMQYQDDMAATPSSYDYAYYGNMDFDQPSYYYDGMGGGGEYQSWQMDGDDDGGAGGYGGGDVTLWSY

SEQ ID NO: 40929 - protein, 293 aa, Kineococcus radiotolerans SRS30216
MAPDQHTPTDPTTQYPDSTPGQTIPHPGVTSDMGPTPDHGEDSYVGTGRLQGRRAIITGGDSGIGRAVAIAYAREGADVLIVHLPEEQEDADTTVALVRAAGRKGISAPGDLRDEEFCRSVVERAVTELGGLDVLVNNAAYQMSIDSIEDLSTEQLLRTFTTNVFATVWLSKAAVPHFAPGSSIINTVSVQADSPSPALLDYAMTKAALVNFTLNLAQEVGEKGIRVNAVAPGPVWTPLIPATMPAEQVEDFGTQTPLGRAGQPAELAPAYVFLASQESSYSTGTVIRVAGGK

SEQ ID NO: 40930 - protein, 527 aa, Hordeum lechleri
MALEAAYHYLQIAVGHGTSTPAALLTVLLLLIIRLAWVRTTTASTRLSKQQQLPPSPPGKLPIIGHLHLLGSQTHISIRDLDAKHGRNGLLLLRIGAVPTLFVSSPSAAEAVLRTHDQIFASRPPSMAAAIIRYGLTDIAFAPYGEYWRQARKLLTTHMLSAKVVHSFRHGRQEEVRLVINKTREAATRGTAVDMSELLSGYTNDVVCRAVLGESHRKEGRNRLFSELTEINVSLLGGFSLENYIPPNMIMADVLLRLVSVKAQRLNKRWDDLFNEIIEEHLHPSKPSSGEQQAADFIDLLLSLKEEYGLTTDNIKAILVDMFEAGIETSYLTLEYGMAELMNNRHILTKLQEEVRSQGKKLDMITEEDVSSMAYLRATIKETSRLHPPAPFLLPHFSTADCNIDGYVVPSNTRVLVNAWALGRDLSSWERPDDFLPERFLQDQAGDVDTQMRGKDLRFLPFGFGRRICPGMNFGFATMEIMLANLMYHFDWDVPNMMGTGAGVDMAESFGLTLRRKEKLQLVPQIP

SEQ ID NO: 40931 - protein, 303 aa, Triticum aestivum
  misc_feature (110)..(110): Xaa can be any naturally occurring amino acid
  misc_feature (235)..(235): Xaa can be any naturally occurring amino acid
  misc_feature (269)..(269): Xaa can be any naturally occurring amino acid
  misc_feature (285)..(285): Xaa can be any naturally occurring amino acid
  misc_feature (289)..(289): Xaa can be any naturally occurring amino acid
  unsure (1)..(303): unsure at all Xaa locations
MGHASAALPVIDLASPDIGAATKSIRQALVDYGFFYVINHGIDDALMKSVYAESASFFQQPMEEKMALHKNSSHRGYIPPDFEGFEADAGGKGDLLECFHIGSGVDGDSXNPVNQWPPAERFPYWKETMKSYYQCAMGTSKRILSLIALSLDLDAEFFKPDGSETILRPIHYSGRAIESKHGSDHGANAHTDYGMVTLLSTDGTPGLQICRDKDGRPQLWEDVHHIDGALVVNIXGDLLERWTNNVYRSTLHRVLMVGKERYSVAFFVXPSPDMMVTCIECCCSXANPXRYPPIRSDEYLEQR

SEQ ID NO: 40932 - protein, 528 aa, Hordeum lechleri
MALEAAYHYLQRAVGHGTTTEALLLTVLLLLIIRLAWVRAFTSTTTSTKFKQQLPPTPPGKLPIIGHLHLIGSHPHVTFRDLAAKHGRDGLMLVHVGAVPTVVVSTPQAAEAVLRTHDHVFASRPRNPVADIIRYGSTDIAFAPYGDYWRRARKVVNTHLLSVKMVYSKRHDREEEVRLVVAKIHELAMAAPGKALDMTELLGGYASDFVCRAVLGESHRKHGRNELFRELTEISASLLGGFNLEDYFPRLANLDVFLRVVCSKAMGVSKRWDNLFNELIAEYEGGKEDNAEDFVHLLLSLKKEYNLSTDNVKAILVNMFEAAIETSFLVLEYSMAELINNRHVMTKVQKEVRESTPEGGKLDLIMEEDLSRMPYLKATIKEAMRVHPPAPFLLPHFSTNDCEVNGYTIPAGTRVIVNAWALARDPSHWERAEEFYPERFLQEGRDAEVDMYGKDIRFVPFGAGRRICAGATFAIATVEVMLANLIYHFDWELPSEMEAVGAKVDMSDQFGMTLRRTQRLHLVPKIYK

SEQ ID NO: 40933 - protein, 408 aa, Arabidopsis thaliana
MKQRKKSYLSIFVIFFSLFFFGIFMYNDNLKSSIADFTSSNPFSSSFVELPPDECDLFTGQWVFDNKTYPLYKEEECEFLTEQVTCLRNGRKDSLFQNWRWQPRDCSLPKFNARVLLEKLRNKRLMFVGDSLNRNQWESMVCLVQSVIPPGRKSLNQTGSLTVFKIQDYNATVEFYWAPFLVESNSDDPEKHSIIDRIIMPESIEKHGVNWIGVDFLVFNSYIWWMNTVSIKVLRGSFDDGDTEYDEIKRPIAYERVLRTLGDWVDHNIDPLSTTVFFMSMSPLHIKSSDWANPEGIRCALETTPILNMSFNVAYGQFSAVGTDYRLFPVAENVTQSLKVPIHFLNITALSEYRKDAHTSVYTIKQGKLLTREQQNDPANFADCIHWCLPGLPDTWNEFLYTHIISRR

SEQ ID NO: 40934 - protein, 526 aa, Hordeum lechleri
MALEAAHHYLRHAVGHGTSAPAALLLVCVPLLLLLLLFASLRTSASTRKLRLPPSPPGSLPIIGHLHHIGAQTHISLQHLVDKYGHNGLLFLRAGAVPTVIVSSPSAAEAVMRTHDHILASRPWSMASHILRYNTTDVAFSPLGEYWQHTRKLVNTHLLSAKKVHSFRHGRQEEVSLVVDKIREAATNAPSTVVDMSEFLAAYTNDVVSRSVLGATHRKKGRNTLFREMTETNVDLLVGFNLENFIPRWPLTEVLFRLVCWKVQRHLNKWDALLEEVIKEHINLKQDNSADFIHVFLSLQQEYGLTDDNVKSLLMNIFEAAIETSYLVLEYAMAELINNRHVMKKLQTEVRTFASSKGKKLDMITEEDLSSLPYLKATMKEALRLHPPGPLLLPHYSTADCNIDGYDIPAKTRILVNGWAIGRDPTAWERQEDFMPERFLQEGQEKSSNLGQDFKYLPFGSGRRICPGANFALATMEIMLVNLMYHFDWEVPNEKEGTGGKVSMAETFGLMLRRNEKLYLVPRIVE

SEQ ID NO: 40935 - protein, 396 aa, Pichia stipitis
MLRTAAVRPLKGGVVIARRAMASSSDLVSIELPESSFEGYNLEIPELTFETEKETLLKMYKGMIIIGGMEMASDALYKAKKIRGFCHLSVGQEAIAVGIENAITPEDTVITSYRCHGFAFMRGASVKEVLGELMGKRSGVSYGKGGSMHMFAPGFYGGNGIVGAQVPLGAGLAFSHKYRGQKAAAFTLYGDGASNQGQVFEAYNMAKLWNLPCIFACENNKYGMGTAAARSSAITEYYKRGQYIPGLKINGMDVLATYQASKFAKDWAAQGNGPLVLEYETYRYGGHSMSDPGTTYRTREEVQHMRSRNDPIAGLKATLLDKGIATEEEIKSYDKAARKYVDEQVAAAEADAPPEAKMDLLFEDVYVPGSEIPVLRGRISDDSWDFKNKTFLNKVY

SEQ ID NO: 40936 - protein, 105 aa, Zea mays
TEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILT

SEQ ID NO: 40937 - protein, 411 aa, Solanum lycopersicum
MNALAATNRNFKLAARLLGLDSKLELSLLIPFREIKVECTIPKDDGTLASFVGFRVQHDNARGPMKGGIRYHREVDPDEVNALAQLMTWKTAVANIPYGGAKGGIGCSPSDLSISELERLTRVFTQKIHDLIGIHTDVPAPDMGTNPQTMAWILDEYSKFHGYSPAVVTGKPVDLGGSLGRDAATGRGALFATEALLNEHGKSVAGQRFVIQGFGNVGSWAAKLIHEQGGKVVAVSDITGAIKNEKGIDIESLFKHVKETRGVKGFHDAQPIDANSILVEDCDVLMPAALGGVINKDNANEIKAKYIIEAANHPTDPEADEILSKKGVTILPDIYANSGGVTVSYFEWVQNIQGFMWDEKKVNDELKTYMTRGFKDVKDMCKTHNCDLRMGAFTLGVNRVARATVLRGWEA

SEQ ID NO: 40938 - protein, 248 aa, Brassica napus
MPIDKIFKDDASEEKGERARMASFIGAMAVADLVKSTLGPKGMDKILQSTGRGHSVTVTNDGATILKSLHIDNPAAKVLVDISKVQDDEVGDGTTSVVVLAGELLREAEKLVTSKIHPMTIIAGYRMAAECARDALLKRVIDNKENAEKFRSDLMKIAMTTLCSKILSQDKEHFAEMAVDAVFRLKGSTNLEAIQIIKKPGGSLRDSFLDEGFILDTKIGIGQPKPIEKAKILVANTAMDTDKVKIYG

SEQ ID NO: 40939 - protein, 359 aa, Ashbya gossypii ATCC 10895
MGKKIVFNISSEFQLKALLGEGAYGIVCSAVHKPSGEVVAIKKIEPFERTLFSLRTLREIKILKHFQHENIISIYDIQKPASFDTFNEVYIIQELMQTDLHRVIATQPLSDDHIQYFIYQTLRGLKALHGSGIIHRDLKPSNLLLNANCDLKICDFGLARIEHGGAADLEHPQAGMTEYVATRWYRAPEVMLTAAQYTKAIDIWSSGCILAELFMKRPLFAGKDYKHQLMLIFELLGTPQGDDLAAVKSRRAREYIATLPRYRRASLRAVIPHANPLGLDLLQRMLVFDPRRRITAADALRHPYLATYHDPRDEPDGTPIPASFFDFDHHKDKLTTRDLKRMLWDEVFRDTHAPVRPDA

SEQ ID NO: 40940 - protein, 339 aa, Gibberella zeae PH-1
MPLIIVSGLPTSGKSTRAKQLHDYLSKRIADTKYRLHLISDESLSISRTVYDLSPDKVRAHTRSANASEKDARASIYGAVKRVLSDKDIVILDGLNYIKGWRYQLHCESKAVRTPSCILQIGCSVDKAREVNKTRIQKKEADSSNTAGSEEAAPAAADSDDAPVDSTEPYEPDNWDNLVFRYEEPNPMTRWDSPLFTLIWEDDEAQTTKVFSDLWDTIAGEARKVVRPNQATIQRGREESGDYLYILDRETSDVVKRIVEAQREGDDVDEVRIPSGSNEIMIYLPAGKKVGLPQLQRLRRAFMGLNRGGIGLEAVGDMKSSRLRDMFVTYLNDAFEKDE

SEQ ID NO: 40941 - protein, 420 aa, Flavobacteria bacterium BBFL7
MNDKVLSIILGGGQGSRLYPLTESRSKPAVPIAGKYRLVDIPISNCINSGLKRMFVLTQFNSASLNRHIKNTYHFSFFSSAFVDVLAAEQTPDNKGWFQGTADAVRQSMHHALRHDFEYVLILSGDQLYQMDFNEMIQAHIDANAKISIATIPVTEKDATSFGILKTDDKNIITSFIEKPDASLLPDWTSPVSDEMKNQNKNHLASMGIYIFNRDLLVELMGDESTIDFGKEIIPQSIDKHKTLSYQFEGYWTDIGNIDSFFEANLGLTDDIPEFNLYDYKQRVYTNARLLPTSKISGTHLDKAVIAEGCIIHAAKIERSVIGIRSRIGKETTVINTYMMGNDDYESLNQIADSKIEILTGIGDRCFIKNTILDKNVRIGDDVRINGGPHLENQETDQYVVKDGIVVIKKHAVIPKGFSL

SEQ ID NO: 40942 - protein, 327 aa, Gloeobacter violaceus PCC 7421
MKAFVLAAGKGTRLRPFTDALPKPLMPVMNKPVMAHILGLCRKHGLDQVVANLHYKGEKISEYFGNGSQYQVSLGYSREEQLLGTAGGVRRQADFLAGGPFLVISGDVMTDLDLTALLQFHKQSGAVATMAVKEVGDPSRFGVVVSDSHGKVESFQEKPIRGTERSRWANTGIYVLEPEVFNYIPEATFFDFGNDLFPMLVAEGAPVFAMRTGAYWSDVGTLAQYLYTHWELLTHPEIVQRIGEGTVVEPGAVISDQALIGRHCTIEKGARVLGYSCVSDGCVIRAGSVVVDSVMWTSEQLGERLSGDLVRSIWGDGKHVCLGIPNL

SEQ ID NO: 40943 - protein, 314 aa, Cryptococcus neoformans var. neoformans JEC21
MSSGAFGSAAPPLVVAGHDDGYPSDILSCIHPSLTFIRSRPIAPDLSLFILSKSISILHSASTMNILDTLFGRSMTPAERLRQHQRSLQKAQRELEREKGKLEAQEKKTMADIKRNAKAGNMNACKILAKDLVRTRRYIQKFTQMRVQLQAVSLRMQTLRSNEQMATAMKGATRAMGQMNRSLNLPQIQKIMNDFERESSTMDMKEEMMSDAVDDAMEDEEEGEGEEVESDKILKEVLDEIGMNMNESLISAPTASPLVPEPLQASRVAVAEGLPSSAAAGGPTNVGNGGVGAGSGMSSEEADLQRRLDALRRD

SEQ ID NO: 40944 - protein, 234 aa, Synechococcus sp. WH 7805
MLSSKEISTSRMGKEAVIETTMNEALIRLIRSLSASFSNQEQAFENPPLYGNILVRLRPLPQLDPGSLLLEQAYAIASNEPYRVRVLQPTVCPTRGLLILNYAIRDDQRFWGSVEDPQRRSQLTAADLTLLEGCSYQVRETDEGFRGEVEPGCRCLVTRRGKTSYLVSSFELTDDGMSTIDRGYDPATHEHLWGSIAGPFQFKRTDDHSAEIPHHWVTDLKNTGGTVLGNGEDR

SEQ ID NO: 40945 - protein, 148 aa, Zea mays
  misc_feature (75)..(75): Xaa can be any naturally occurring amino acid
  misc_feature (138)..(138): Xaa can be any naturally occurring amino acid
  unsure (1)..(148): unsure at all Xaa locations
MNALAATSRNFKQAAKLLGLDSKLEKSLLIPFREIKVECTIPKDDGTLASYVGFRVQHDNARGPMKGGIRYHHEXVANIPYGGAKGGIGCSPGDLSISELERLTRVFTQKIHDLIGIHTDVPAPDMGTNSQTMAWILXEYSKFHGYSP

SEQ ID NO: 40946 - protein, 417 aa, Triticum aestivum
MTPLHAAPPPLSASAAVSSSAPPPLLAKAYHPKAAALCSLTVTAATPSRKAFLACPDHSPAAGRSLTPARGAPASSPALISAVQDLYEFICSGPLVERIGYTRERIAESIDRWLWCGSQVSRLFRIDELRLTDAEKSRIYHFYIPVFLWCEDQVADHRSKYNDGDEIPPLVIGVSAPQGSGKTTLVFALDYLFRVSGRNSATLSIDDFYLTAAEQGKLRETHAGNALLEFRGNAGSHDLQFSIDTLESLIKLTKEGTKMKLPRYDKSAFGGRGDRADPSTWPEVEGPTEVVLFEGWMLGFKPLPNEVVTAVDPQLEVINKNLEAYYDAWDRFIESWIVIKIKEPNCVFQWRLQAEVAMRADGKAGMSDEEVMDFVSRYLPAYHAYLPTLYKEGPNGAKKDHLLVIDIDEERTPISGS

SEQ ID NO: 40947 - protein, 587 aa, Bifidobacterium longum DJO10A
MEYTEDADRRELLLHSAYDSDTVRAMERPLLDKGVPLMRMAAQAAAHMAAGMLDDEDLALEDTSIVLLAGAGDNGGDGLFAAAALAQEGANVTAIAVGRSLHEAGFASFVRAGGKVLVLDPAADIPGCASGFSAGEAGERLQTAIAVARKSHLIIDAMTGIGIQGSLRGIPAALASALGLDGEAPDEPALPNRESSGDFPLVLAVDTPSGVGVNDGSLPGPYIPATVTVTFGAMKPCAVLPPATFACGRIELLDFGFDIDDKDPDVEVVDNSFASDAVRLPRFEDSKYSRGVVGLVTGSQRYPGAAVLTASAAARANTGMVRYLGPERAQNMVLAALPEAVIGKGHVQSWVVGSGVPEASVEGTDGDMQRDTIAALLKHYALGSEDENKDAYDMPPIVVDAGALDLLPERVPGQVVITPHAGEMAKLLNRFETAASTAEHADSHEPYTADDVRLNPLASAKRAHELTGATVLLKGAVTIVVDEDHVYASGSAPAWLGTAGAGDVLAGLTGALLAQQDDVATTGETVASAAYLHGLAAAIASESEQQGWQEPELIGREHRQRFMTLGHPIVAGDVAHAIPEAIADVIA

SEQ ID NO: 40948 - protein, 760 aa, Oryza sativa (japonica cultivar-group)
MASSHHQEVQEQGHGDGEEEEQDNSQITSPLLRSSMRLGSPEENSPVEQVALTVPVGDDPATPVLTFRIWVLGTASCVVLSFLNTFFWYRKEPLTVTAISAQIAVVPLGRLMAAALPERVFFRGRPWEFTLNPGPFNVKEHVLITIFANAGAGSVFAINVITAVRVFYGKRISFFVSLLVVLTSQVLGFGWAGIFRRYLVEPAAMWWPSNLVQVSLFRALHEKERRSKGGMTRTQFFLVAFVCSFAYYIFPGYLFQMLTSLSWICWIFPKSVLAQQLGSGLHGLGIGAIGLDWSSISSYLGSPLASPWFATANIAAGFFIYIYVITPIAYWINLYKAQNFPIFSDGLFTVTGQKYNISTIIDSQFHFDTKAYEKNGPLYISTFFSISYGLGFACLTATVVHVLLFHGSEIWQLSRSAFQDKKMDIHTKLMKRYKQVPEWWFISILIASVAITMFTCEYYIEQLQLPWWGVLLACALAIFFTLPIGIVTATTNQTPGLNIITEYIMGYLYPGRPVANMCFKVYGYIGPQQALAFLQDFKLGHYMKIPPRTMFMAQVVGTLIAAFVYLGTAWWLMDTIPNICNTELLPPGSPWTCPYDHLFYDASVIWGLIGPRRIFGDLGTYSAVNWFFLGGAIAPLLVWFAHKAFPGQKWILLVNMPVLIAGISQMPPATSVNYTAWIFVAFLSGYVVYKYRRDWWERHNYLLSGALDAGLAFMAVLLYLCLGLEKISLNWWGNDLDGCPLASCPIAEGITVQGCPVASA

SEQ ID NO: 40949 - protein, 159 aa, Triticum aestivum
PAAQRRNYKNAFHALYRITADEGVLALWKGAGPTVVRAMALNMGMLASYDQSVELFRDKLGAGEISTVVGASAISGFFASACSLPFDYVKTQIQKMQPDANGKYPYTGSLDCAMKTFKSGGPFKFYTGFPVYCVRIAPHVMMTWIFLNQIQKLEKKIGI

SEQ ID NO: 40950 - protein, 205 aa, Triticum aestivum
  misc_feature (34)..(34): Xaa can be any naturally occurring amino acid
  misc_feature (59)..(59): Xaa can be any naturally occurring amino acid
  misc_feature (71)..(71): Xaa can be any naturally occurring amino acid
  unsure (1)..(205): unsure at all Xaa locations
MDAAVERLKTGFEKFKTEVYDKKPDFFEPLKAGXQAPKYMVFACADSRVCPSVTLGLEXPGEAFTIRNIAXNMVPSYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVSNGTLKLVGGHYDFVSGKFETWEQ

SEQ ID NO: 40951 - protein, 204 aa, Pseudomonas fluorescens Pf-5
MNAQPLRVGIGGPVGSGKTALTLALCLALRERYNLAVVTNDIYTREDADFLVRNEALAPERIIGVETGGCPHTAIREDASINLEAVDQLNRRFPGLDLILVESGGDNLSATFSPELSDLTIYVIDVSAGDKLPRKGGPGICKSDLLVINKIDLAPLVGASLEMMNSDTQRMRGGKPFVFSNQKTGQGLADIIAFIERQGLLTAA

SEQ ID NO: 40952 - protein, 237 aa, Prochlorococcus marinus str. MIT 9211
MEDLQTQMKEAVAKAAIEQIHDGMVLGLGSGSTAALMIKALGAKISSGHLKDIVGVTTSFQGEVLATELGIPLQGLSAVSQIDLAIDGADEVDSNFQLIKGGGACHVQEKLVASLAERFVVVVDSSKIVKTLNLTFKLPVEVLPSAWQLVKNKIHEIGGVSQLRMAQKKAGPIVTDQGNLVLDVTFAGGINDPQTLEKQINNIPGVLENGLFVNLADEVLVGEIVSGTPGVKSLQKI

SEQ ID NO: 40953 - protein, 140 aa, Fulvimarina pelagi HTCC2506
MAIERTFSMIKPDATRRNLTGAIVKMLEDGGLTVIASKRVWMSRREAEGFYAVHKERPFFGELVEFMSSGPTVVQVLQGENAIARNREIMGATNPADAAEGTIRKEFAQSIGENSVHGSDAPDTASEEIAYWFSETEIVG

SEQ ID NO: 40954 - protein, 519 aa, Oryza sativa (indica cultivar-group)
MEEERMEPPPPPPPYIHIETNDFLHRRHKRQKEEDIAVCECQYNLLDPDSACGDRCLNVLTSTECTPGYCLCGVYCKNQRFQKSQYAATRLVKTEGRGWGLLADENIMAGQFVMEYCGEVISWKEAKRRSQAYENQGLTDAYIIYLNADESIDATKKGSLARFINHSCQPNCETRKWNVLGEVRVGIFAKQDIPIGTELSYDYNFEWFGGAMVRCLCGAGSCSGFLGAKSRGFQEATYLWEDDDDRFSVENVPLYDSADDEPTSIPKDILIKDEPNTQDGNNNTIQNTGIPIIASSSEFTPMNVEPSIASSNEFTPMNVEPLNVSSNELTPMTIEPLNAIPMGVDFTQNGSIEYGAQCAEDALQNSTRGVANLQNQSVPRDNNHTELVAVKRRPTLRGGKAKRAMRKQLNVVGICDRLASEVAREEILYCEEMKNQAAAEIDSLYDEIRPAIEEHERDSQDSVATSLAEKWIEASCCKYKADFDLYASIIKNLASTPLRSKEDAAPKEQNGLMYLENGP

SEQ ID NO: 40955 - protein, 334 aa, Flavobacteria bacterium BBFL7
MIVKLILYCKFHCIKQTIMSKNQFGKNGWTPDIIGSLKGKTYVITGTTSGTGLEAAKILLAKDAKVVMLNRNNTKAQDTIAKFKSELGNHIEVSNIQMDLAQLASVRKAAKQVLSTIPHIDALICNAAIAQVPKQVLTVDGFESQLGVNHYGNFLLQGLLFPLIDKSNGRIVTVGSEGYKMGIKTIKFDDMNWDNDYNPNTVYSQSKLAQIMSVYELQDRLKNAGKSNVKVYACHPGASRTSLIKTSGSLMTRFIWQMMKLSPFVQSAEKGSYPALMCATEPELDQKRYYGPTSGNYWKGPVGECNLEPHAKDKATMVKLWEVSEDATGFQWNL

SEQ ID NO: 40956 - protein, 211 aa, Actinobacillus pleuropneumoniae
MRKYIKIGVAGPVGAGKTALIERLTREIASKYSVAVITNDIYTQEDAEFLTKNSLLPPERIMGVETGGCPHTAIREDASMNLEAVDEMVARFPEVELIFIESGGDNLSATFSPDLADVTIFVIDVAQGEKIPRKGGPGISRSDLLVINKTDLAPFVGADLSVMERDARRMRNGQPFIFTNLMKNENLDGVIGWIEKYALLKNIEDPASLVR

SEQ ID NO: 40957 - protein, 549 aa, Salmonella enterica subsp. enterica serovar Typhi str. CT18
MKNINPTQTSAWQALQKHYDEMKDVTIAELFANDSDRFAKFSATFDDLMLVDFSKNRITEETLAKLQDLAKETDLAGAIKSMFSGEKINRTEDRAVLHVALRNRSNTPIIVDGKDVMPEVNAVLEKMKTFSQAIISGQWKGYTGKAITDVVNIGIGGSDLGPFMVTEALRPYKNHLTMHFVSNVDGTHIAEVLKKVNPETTLFLVASKTFTTQETMTNAHSARDWFLKSAGDEKHVAKHFAALSTNAKAVGEFGIDTANMFEFWDWVGGRYSLWSAIGLSIILSVGFDNFVELLSGAHAMDKHFSTTPAEKNLPILLALIGIWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHQKLLSNFFAQTEALAFGKSREVVEQEYRDQGKDPAQLEHVVPFKVFEGNRPTNSILLREITPFSLGALIALYEHKIFTQGVILNIFTFDQWGVELGKQLANRILPELGDDKAISSHDSSTNGLINRYKAWRA

SEQ ID NO: 40958 - protein, 319 aa, Glycine max
MSNTKSHAGIPILDLSQPLQPCSLSSLYNASKDWGLFHIINHGISKDLCSQIQTLSKHLFNLPSNTKLRLGPLSSLNSYTPLFIASPFFESLRVNGPNFYVSADNSAEILFDKKYSKFSVIIQEYCSKMEDLSKKILKLVLMSIGDGIEKKFYDSEFKKCHGYLRVNNYSAPEVIEDQVEGLGMHTDMSCITILYQDEIGGLQVRSNEGEWIDINPSEGTLVVNIGDMLQAWSNDKLRSSEHRVVLKHHENRFSLSFFWCFEDDKVILAPDEVVGEGNKRKYKPFVCLDYLKFRESNERGRFDKVGFTVRDFASIKAQL

SEQ ID NO: 40959 - protein, 444 aa, Oryza sativa (japonica cultivar-group)
MATHAALAASRIPATARLHSKAASKQRVDFADFSGLRPGSCSISHAAREASFSDVLGSQLVARATGENAVRAPAEAKLKVAINGFGRIGRNFLRCWHERENSPLEVVVVNDSGGVRNASHLLKYDSMLGTFKADVKIVDDQTISVDGKLIKVVSNRDPLKLPWAELGIDIVIEGTGVFVDGPGAGKHIQAGAKKVIITAPAKGADIPTYVLGVNEGDYSHEVANIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLSGILDVCDVPLVSVDFRCSDVSSTIDASLTMVMGDDMVKVVAWYDNEWGYSQRVVDLAHLVASKWPGAAVQGSGDPLEDFCKDNPETDECKVYEN

SEQ ID NO: 40960 - protein, 203 aa, Synechococcus sp. WH 7805
MHPSLLFARTLCGHYSNREQAQNDPSKFAHINIFFMPLPWDVLKGPGFYSEQSYDHDPWRPYRQGVHRLREGDNGVHVVENFGMAQPERVAGAPQHPALLAAIQPDTLQARCGCAMHFQSCGANAYEGRVEPGKGCLVPRDGRLTYLVSEVQVDAHSWSSRDRGFDPDSDDLVWGSEHGMLQFQRVASLADDLNEDWLKGLND

SEQ ID NO: 40961 - protein, 504 aa, Porphyromonas gingivalis W83
MIGIFTGARIKELDRYTIEHEPVSSIDLVERAAATWVYEFERLYTQQRRIVVFAGPGNNGADALCAARILGENGYSVDAFLFNVSGSLSPECNECRVRLLETSGIRLTEVVDNFIPPELSSQTIVVDGLFGVGLNRPLQGGFAKVVEFLNQSGAEIVSIDIPSGLFEEDNFGNNPNAIIRATHTLTFEYPKLSFLFSENADYVGKWKVLNIGLSVEGKQTIKTEYFLNTDFDISGIIRQRPRFAHKGTFGHALLIAGSRGKMGAACLAAKACLRSGIGLLTTHIPACGEAVMQTAVPEAMVHADEKTDIVCDYSSPLVFQAVGIGPGIGRAEGTVLLVEKILSTPNGPLVLDADALNIIAENRSWLDRLPINSILTPHSRELERLTTHCNTDYERLRQARFLACHHHVYVVLKGAFSATCMPGGMVVFNNTGNPGMATGGSGDVLMGIITGLLGSGYLPASACVLGNYIHGLAGDIYAGRYSQESLIASDIIDNLGTAFRQVRD

SEQ ID NO: 40962 - protein, 951 aa, Photobacterium profundum SS9
MKLTKRSDNVSKDENQLGISRRSFIRNTSLAAAGGVAGASMFAPGMMKKAEAKIVDPTSPIEIKRTICSHCSVGCGIYAEVQEGVWTGQEPAFDHPFNAGGHCAKGAALREHGHGAKRIKYPMKLVDGKWIKLSWEQALDEISKQVLKIREESGPDSVYWLGSAKHNNEQAYLFRKMVSMWGTNNVDHQARICHSTTVAGVANTWGYGAMTNSLNDMHNCKSILFIGSNPAEAHPVAMQHILIAKEKNSCKIIVADPRRTRTAAKSDHFVSLRPGSDVAFVWGVLYHIFKNGWEDKEFIRQRVYGMEDVRKEVAKWAPTEVERVSGVPEADVYETAKLLSENRPGCVVWCMGGTQHTTGNNNTRAYCILELALGNMGKSGGGANIFRGHDNVQGATDFGVLSDNLPGYYGLSEGAWKHWAGVWDVDYEWLKGRFDQADYRGKKPMNHAGIPVSRWIDGVLENKDNIEQNDNIRAMFYWGHAVNSQTRGPEMRTAMGKLDMMVIVDPYPGVAAVMNGRTDNVYLLPATTQFETTGSVTATNRSIQWRDQVIEPLFESKPDHEIMFRLSQKLGLSDQLFKNIKVENNIPVIEDITREYNKGMWTIGYTGQSPERLKAHQKNWHTFHKTTLEAEGGVADGETYGLPWPCWGTPEMKHPGTHILYDTSKTVAQGGGNFRARFGVEREGESLLAVDSYSLGCELEGGFPEFTDKLLKQLGWWDDLTDAEKVKADGKNWKTDLSGGIQRVAIKHGCIPFGNAKARAVVWTFPDAVPLHREPLYTPRRDLVADYPTWNDSEAMFRLPTFYKSIQDKDVSGEYPMILTSGRLVEYEGGGDETRSNPWLAELQQEMFVEVNPKDANDLGFRDGDMVWVEGAEKGRIHVKAMVTRRVKPGLAFLPFHFGGYFEGEDLRGNYPEGSAPYVSGESANIATTYGYDPVTQMQETKVTLCKISKA

SEQ ID NO: 40963 - protein, 462 aa, Streptomyces avermitilis MA-4680
MANDASTVFDLVILGGGSGGYAAALRGAQLGLDVALIEKDKVGGTCLHRGCIPTKALLHAGEIADQARESEQFGVKATFEGIDVPAVHKYKDGVISGLYKGLQGLIASRKVTYIEGEGRLSSPTSVDVNGQRVQGRHVLLATGSVPKSLPGLAIDGNRIISSDHALVLDRVPESAIVLGGGVIGVEFASAWKSFGADVTVIEGLKHLVPVEDENSSKLLERAFRKRGIKFNLGTFFSKAEYTQNGVKVTLADGKEFEAEVLLVAVGRGPVSQGLGYEEQGVAMDRGYVLVDEYMRTNVPTISAVGDLVPTLQLAHVGFAEGILVAERLAGLKTVPIDYDGVPRVTYCHPEVASVGITEAKAKEIYGADKVVALKYNLAGNGKSKILNTAGEIKLVQVKDGAVVGVHMVGDRMGEQVGEAQLIYNWEALPAEVAQLIHAHPTQNEAMGEAHLALAGKPLHSHD

SEQ ID NO: 40964 - protein, 433 aa, Rickettsiella grylli
MISSHELFNKAKQRIPGGVNSPVRSFHAVGGEPLFFSQGKGAYLFDVQDKPYIDYVGSWGALILGHAPEKIVAAVDEAVKCGLSFGTATPGEIYFAEKISNLMPHLEKIRLMNSGTEATMTAIRLARGFTGRDKILKFNGCYHGHVDSLLVKAGSGVAHFSIPDCIGIPKEVVSQTLSVEFNNLEQVAQMFMHHGKEIAAIIIEPIAANMNCILPLPGFLEGLRELCDYYGSLLIFDEVISGFRVALGGAQEIYHVKPDLTTLGKIIGGGLPVGALGGRAEIMDCLAPEGKVYQAGTLSGNPLTVAAGLATLEVVSQPGFYSALNAINEKLVAGLRARANDANICFQAHAIGGLFGFVFTQTEIYNYQHVKLAYQPLFKEFFHRMLAEGIYFSPSPFESGFLSSAHGEYEIDATLVAAEKVFSKLKEKNLMLS

SEQ ID NO: 40965 - protein, 154 aa, Oryza sativa
RAAGSWLFDVCVKAKGDTHIDDHHSNEDIALAIGTALLEALGDRKGINRFGHFTAPLDEAAVEVILDLSGRPHLSCGLSIPTERVGTYDTQLVEHFFQSLVNTSGMTLHIRHLPFLALMKLAGKNSHHIIEATFKAFARALRQATEYDLRRRGT

SEQ ID NO: 40966 - protein, 173 aa, Hordeum vulgare subsp. vulgare
MAETEYRCFVGGLAWATDDHNLQAAFSQYGEILDAKIINDRETGRSRGFGFVTFGSEESMRQAIEEMNGKELDGRQVTVNEAQSRRSAGGGGGGYGGQRGGGGGYGGGGGYGGQGGGYGGQGGGGYGGQGGGGYGGQRGGGGGYGGGGGGYGGGGGGYGGQRGGGDSGGQWRS

SEQ ID NO: 40967 - protein, 464 aa, Methanocaldococcus jannaschii DSM 2661
MNKMNIDKNLLEKWDKEYIWHPYTQMKEYRESKNLIIERGEGNYLIDIYGNKYLDAVSSIWCNLFGHSRKEIIEAIKNQADKICHSTLLGCGNVPSILLAKKLVDITPKHLTKVFYSEDGAEAVEIAIKMAYQYYVLRGDKGRTKFISVKEGYHGDTVGAMSVGGSELFHGVFKPLLFKGYHANPPYCYRCKYHNFKDTDERNEKGCEMECLNEMISLIEKHAEEVFCVILEGGIMGSAGMIPYPDGYIEGVAKACKENDVIFILDEVATGFGRTGKMFFCDNEELKKLEKPDILCLGKGLTGGYLPLAATLTTDEIYNQFLGEFGESKQLYHGHTYTGNQLLCSAALATLEIFEKENVIENIQPKIKLFHKELRKLKELEHVGDVRGRGFMVGIELVKDKETKEPYPYGYKAGYRVAEKLLEKGIYMRPIGNVIILVPPLSITEKEIIYLCDALYEAIKEADL

SEQ ID NO: 40968 - protein, 424 aa, Staphylococcus aureus subsp. aureus Mu50
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASATVEQTFTAKQNQPRNNGRFSPVVFKLASEHDIDLSQVVGSGFEGRVTKKDIMSVIENGGTTAQSDKQVQTKSTSVDTSSNQSSEDNSENSTIPVNGVRKAIAQNMVNSVTEIPHAWMMIEVDATNLVNTRNHYKNSFKNKEGYNLTFFAFFVKAVADALKAYPLLNSSWQGNEIVLHKDINISIAVADENKLYVPVIKHADEKSIKGIAREINTLATKARNKQLTTEDMQGGTFTVNNTGTFGSVSSMGIINHPQAAILQVESIVKKPVVINDMIAIRSMVNLCISIDHRILDGLQTGKFMNHIKQRIEQYTLENTNIY

SEQ ID NO: 40969 - protein, 1089 aa, Campylobacter coli RM2228
MPKRTDIKNILLIGSGPIVIGQACEFDYSGTQAAKTLKEQGYRVVLINSNPATIMTDPEFADATYIEPVTKESILSIIKKEKIDAILPTMGGQVALNVAMEVYESGLLGDVKFLGANPEAIKKGEDRQVFKECMKKIGMDLSKSMYAYNYDEALKAVDEIGFPLMIRASYTLGGTGSGVVYNMDEFKELANTALALSPIHEILIEESLLGWKEYEMEVIRDKNDNCIIVCSIENLDPMGVHTGDSITVAPALTLTDKEYQVMRNASFAILREIGVDTGGSNVQFAVNPTNGRMIVIEMNPRVSRSSALASKATGYPIAKVATLLAIGFSLDEIKNDITGTPASFEPVIDYIVTKIPRFTFEKFPGANTTLGTAMKSVGEVMAIGRTFKESIQKALCSLERNLSGFDRVKFEDKNDLIFKIRNANEKRLLYVAQAFREGFDVKELYELCKIDPWFLSQIKEIVDFEEQIDMDILHNKTLLRKAKTMGFSDKMIALLVNLKDNLELSQNDIYYARMKQKIIAEFSEVDTCAGEFEALTPYLYSSINVSELTQSKNEARDKKEKKVMIIGGGPNRIGQGIEFDYACVHASFALKDLGVKTIMYNCNPETVSTDYDTSDILYFEPIDFEHLRGVIEREKPDGVIVHFGGQTPLKFAKRLSAFGAKIIGTSARVIDMAEDRKKFAEFITKLGINQPKNSTATSVEEAVLKASEIGYPVLVRPSYVLGGRAMRVVTDESELRLYMQEAVDVSDKSPVLIDQYLDNATEIDVDAISDGKDVYVAGIMEHIEEAGIHSGDSACSLPPCNIDEKMQEQIVQKTADIALNLGVVGLLNIQFAIYNNELYMIEVNPRASRTVPFVSKATGIPLAKVATRVMWQGNLKEALKFYDAFGVVNFDNAILRPKPSKYISVKEAVFPFAKLSGSDLELGPEMRSTGEVMGISKDFANSYAKSQISSFNHLPESGVVFISLKEKDKKYAKKLASEYSKLGFKLMATSGTCKEIVETGFECELVHKISEGRPNVEDKLKNGEIQLVINTSDSHTFAGDTKKIRENIIRFKIPYFTNLRSALAGAKSIKAIQNQSYLEVKSLQEYLKA

SEQ ID NO: 40970 - protein, 327 aa, Staphylococcus aureus subsp. aureus Mu50
MAKLSYLEAIRQAQDLALQQNKDVFILGEDVGKKGGVFGTTQGLQQQYGEDRVIDTPLAESNIVGTAIGAAMVGKRPIAEIQFADFILPATNQIISEAAKMRYRSNNDWQCPLTIRAPFGGGVHGGLYHSQSIESIFASSPGLTIVIPSTPYDAKGLLLSSIESNDPVLYFEHKKAYRFLKEEVPEEYYTVPLGKADVKREGEDLTVFCYGLMVNYCLQAADILAADGINVEVVDLRTVYPLDKETIIDRAKNTGKVLLVTEDNLEGSIMSEVSAIIAEHCLFDLDAPIMRLAAPDVPSMPFSPVLENEIMMNPEKILNKMRELAEF

SEQ ID NO: 40971 - protein, 356 aa, Prochlorococcus marinus str. MIT 9211
MNISLLEGKKVVLLGQNVAKLEKLAQEYGEPAFRGRQIHEWLYQKGVRKLEEISVLPKLWRTTLSDQGVCTGRLEEVKRLVANDGTIKLLLETSDRESIEAVGIPTNSRLTTCVSSQVGCSMGCRFCATGKGGFQRSLEVHEIVDQVLSIREAFDRRPSHIVFMGMGEPLLNIESVLESISCLNNDLGIGQRRITVSTVGVVNTLPQLAELALAKLGRVQFTLALSLHAPNQHLREMLVPSAKVYPIQDLLSDCRHYLDITGRRISFEYILLATVNDKVEHAEELADLISGFQSHVNLIAYNPIDEEDYQRPSLARINRFMTVLQSRGVAVSLRASRGLDQDAACGQLRHQHTRLD

SEQ ID NO: 40972 - protein, 473 aa, Staphylococcus aureus subsp. aureus Mu50
MSEKQYDLVVLGGGTAGYVAAIRASQLGKKVAIVERQLLGGTCLHKGCIPTKSLLKSAEVFQTVKQAAMFGVDVKDANVNFENMLARKEDIINQMYQGVKHLMQHNHIDIYNGTGRILGTSIFSPQSGTISVEYEDGESDLLPNQFVLIATGSSPAELPFLSFDHDKILSSDDILSLKTLPSSIGIIGGGVIGMEFASLMIDLGVDVTVIEAGERILPTESKQASQLLKKSLSARGVKFYEGIKLSENDINVNEDGVTFEISSDIIKVDKVLLSIGRKPNTSDIGLNNTKIKLSTSGHILTNEFQQTEDKHIYAAGDCIGKLQLAHVGSKEGVVAVDHMFEGNPIPVNYNMMPKCIYSQPEIASIGLNIEQAKAEGMKVKSFKVPFKAIGKAVIDSHDANEGYSEMVIDQSTEEIVGINMIGPHVTELINEASLLQFMNGSALELGLTTHAHPSISEVLMELGLKAESRAIHV

SEQ ID NO: 40973 - protein, 660 aa, Arabidopsis thaliana
MGCVSSKQTVSVTPAIDHSGVFKDNENECSGSGRIVVEDPPRPTLKKLVSWRSRSGKRRSQKSGSELGSESGRASDSLSFRLGNVSRYLEAEQVAAGWPAWLSNVAGEAIHGWVPLRSDAFEKLEKIGQGTYSNVFRAVETETGRIVALKKVRFDNFEPESVKFMAREILILRRLNHPNIIKLEGLITSKLSCNIQLVFEYMEHDLTGLLSSPDIKFTTPQIKCYMKQLLSGLDHCHSRGVMHRDIKGSNLLLSNEGILKVADFGLANFSNSSGHKKKPLTSRVVTLWYRPPELLLGATDYGASVDLWSVGCVFAELLLGKPILRGRTEVEQLHKIFKLCGSPPEDYWKKSKLPHAMLFKPQQTYDSCLRETLKDLSETEINLIETLLSIDPHKRGTASSALVSQYFTTKPFACDPSSLPIYPPSKEIDTKHRDEAARKKISGNGRRGIDPRKPSRKAHSFNRLAPVELLPTYSLFYMLSDVRHQTETFQKRIGHLVHSSIESDARLCGKLQNPLDHKKDEASHVKHASQGDVPFSGPLQVSKSNSFAWAKREKDDVCVRVHNRSLSRGYIPSLSGHSPAFNGKSDVESKINKDEKEDKTDSRGEESYEMVKRSMLKQWRQLERPDSFGASDEYHSQELSLGLYQRDEMAKKMGNNLVRP

SEQ ID NO: 40974 - protein, 451 aa, Oryza sativa (indica cultivar-group)
MIHLRRSFLSRLLHPPCPTPANPLPLHRLLSSAAAAAPIPPEPFAVEDYLVDSCGLTRARAKKASGKLSHLRSPSNPDAVLAFLSGLGLSRPDIAAVVVNDPLFICARVDKTLATRVAELTDLGLSRSQIARLIPVVRSLFRCKSLAPRLAFLLTVFGSFDRCLEVIKTNYGVLSSNVEAVIKPNLAVLKECGISIADRPSYAFASRVISRPTKHLEEAVVLANEFGAKQGTRVFTNAVMIFGILGQEKLAKKLEFFKKLGWSQDDLSLAVRSMPHILAMKEERMRRGMKFLTEDVGLEIPYIARRPALTMYSIERRLLPRHCLINVLKGNGLLKANYDFYNISVISNDDFMEKFVQPYVESVPGLGDAYASSCTGCGVHQLKLLSKLCCNFVRNFQFPSRITLNLSLKEGCLQFPLGYLMTNECAVLLIFIVAKWLAEIAVDKSNIDSSD

SEQ ID NO: 40975 - protein, 683 aa, Oryza sativa (japonica cultivar-group)
MIIAFCSAGNLGNLLLIVVPAVCDEDGNPFGKDSSRCRSLGLSYSSLSMALGGLYIWTHTYSLMKKKRDQMYHQPNSTQCLDDSDEEHHSKKFKANGEAAYADEEATLPVSAKLAQHNEENQMEAPLLSCESKVAKKCSWTTTNLKDTIHHVVEELMAPPTLSAILGFVFGLVPWLKSLVIGDGAPLRVIQDSIQLMGVALLLLVLQKWHDSLRHPHPWWKSDKRAKEVGAQAYGDHRDRLHPLRDPSSSGDCSSSWCILGRILATRPAVPLRADDAVRAATCNDYCSQSKHATVLREMVAAAEAKAAIGVATPTPTAAPCGSTTTPRDADVDDKMTIVGHPAASLPLETRWPPFPLRRLGGFWMPESLLPAVAALHTSFAPAPDGVLLASFPKSGTSWLKALAFAAANRAAHPPSDADHPLRRRNPHDCVEFFEMRPDEHTGATSDGIAVDAASPPPPPRVLATHLPYSLLPKRITAGDGCRIIYICRDPKDTLVSFWHFSKKMAATMAVDAGAFTFDEAFELFCDGNCTGGPQWRHVLEYWEASRRCPGKVLFLRYEDMLRRPASGLRKMAEFMGCPFAAAEEAAGVADAIVELCSLDELRSLEVNRNGTDVLGLKNESYFRKGVAGDWRNHMTPAMAARLDKIVDDATRGSGLSLANATPSPPMHENEIKGNLTIYHSYI

SEQ ID NO: 40976 - protein, 694 aa, Oryza sativa (indica cultivar-group)
MIQFRRRILTLLLQPASPRPIAGIFLPPCSLRRLLSTTAPVSPKPFAVEDYLVAGCGLTRAEAAKASAKISHLSSPSNPDAVIAFLSDLGLPRPQIAAAIAADPRLLCADVEKNLAKRVGELGDLGFSRSQIARLLPLAGWCFRSSSLATNLAFWLPVFGSFDKILKALRMNKNLLSPGVQKSAKPILAFLEQCGINASDVARSSTMYSSRLLTANPEYLRDAVARVEELGLDRSSRRFHRGLVAVALVSKETAARKIRLMEELGFSQDDLLVIMRKLPNFLALSEKKIRRAVEFLKRDVGLEGRYIVQRPVLLSYSLERRLLPRHCLLKVLRTKGLLNSELDYYSTAALSEKKFVNKFVHPYEDHIAGLADAYASGCSEEGNGVASLLSLQTEMDAWEIENGEDFLVRKKEGIVDYCQMILIDYAGANNAGEIARLVPLAKIPFRSSSLGDNLAFWLPVFGSLDSILRALRKNSSLLSANLDKVVKPNLAFLKQCGIDARDVASNPNLYSSRLFTSNPMKLRDAVARVEELGMVRGSRVFHRGLVAVAFLSKEAVAAKTRLLVELGFSQDDVSVIFRKMPSFLTASEKRIRRAVGFLKGDVGLEERYIARRPVLLLYSLERRLLPRYYLLKVLRTKGLLDCKLCYYSIAALGEKKFIERFVHPYEDHIAGLADAYGSICSGKVANGVAPLLGL

SEQ ID NO: 40977 - protein, 395 aa, Triticum aestivum
  misc_feature (194)..(194): Xaa can be any naturally occurring amino acid
  unsure (1)..(395): unsure at all Xaa locations
VLTLLHIPRLPINPPSSPPPRRRRCPPPMAAFASAPQQSKPLVLGCGAVSVDYLATVASFPNPDDKIRSLALKVEGGGNAGNALTGAARLGLSPRIISKASNDALGKSILKELQDDGVDTSYMTIADGGNSPFTYIIVDSQTKTRTCIHTPGYPPMKPEELTKENLFAALHGVEMVYFDVRLHETALLVAEECXASQRKIPILVDAEKKREGLDDLLNFASYVVCSANFPQAWTGASSTPVALVHMLLRLPNLKFVIVTRGEKGCLMLERSMTDASETEETDVEDLLESLEQKVDLSSSMAKCVASKSNLRISADGVGSMSGRLIMGTAEDIPSEELIDTTGAGDAFIGAVLYGLCTGMPVEKMLPFAAQVAACGCRALGARTGLPHLTDPRLSL

SEQ ID NO: 40978 - protein, 267 aa, Zea mays
  misc_feature (250)..(250): Xaa can be any naturally occurring amino acid
  unsure (1)..(267): unsure at all Xaa locations
DIGLKDTPRRCSDKNCGARLKDTVLDWDDALPPEEMNLATEHCRSADLVLCLGTSLQITPACNMPLMSIKNGGRVAIVNLQATPKDKKASLVIHGLVDKVIAGVMSKLSLRIPPYIQKCVRWTLRVTSIHGLRAPLPFLQSVKVSFPERPDLKSVVLKEQPFSLQRETSMNKPFFMLLTLNFSDGCSCLSSSIGWPVDFQKRKDSFVRDRALVLRELYSAAQRESCIGQQEILERENLPRAETSIHGIVXNIVRYDTEDEKLAPPKK

SEQ ID NO: 40979 - protein, 322 aa, Euglena gracilis
MLTSKDQELAVLLSALSLACKATARACNKAGIALLFGLAGETNATGDDQKKLDVLSNDIFINTLTNSGTCAVLVSEENEEPIIIDPAHAGRFCVAFDPLDGSSNIDCNVSTGTIFGVYERISTGFATVDDIFRTGNDLIVAGYCMYGAATELVITFKNQGVHRFTLDPSLGEFIHTHSNVTFPEDGGKKIYSCNEGNSSNWDPAIKASVEYFKAGSKPYAARYVGSMVSDVHRTILYGGIYLYPADAKSKNGKLRVLYEGFPMAMIVEQAGGVASCGLFKGTIQRLLDLVPTSIHEKCPVILGGERDVKLVLSKYKELGLAA

SEQ ID NO: 40980 - protein, 284 aa, Candidatus Desulfococcus oleovorans Hxd3
MQSYQHSMGVLLNRNNIRIFYRSWTVDEPVGLVFLCHGLGEHSGRYSHLIQALRGRGISFYALDHKGHGKSGGKRGHTDSFTDYCDDIHQYITDLIRPDLPDLPMIMLGHSMGGLIAALHALTYPGDMDALVLSSPAFEPTVPVPAVQRLAAALAVRLMPRLSQNNKLDPEHLSSNRETVEAYKSDPLVHTMVTVKWFVEFTAATRRCMEQAGRVTAPLLVFHGGNDAIVSPDGSKAFYEKAGSTDKTLKIFSGLRHETMNETPEKREPVLEMVSDWILDHVKK

SEQ ID NO: 40981 - protein, 216 aa, Pisum sativum
MAEENQNKYEETTSATNSETEIKDRGVFDFLGGKKKDEEHKPAQDEAIAHEFGHKVTLYEAPSETKVEEEGEKKHTSLLEKLHRSDSSSSSSSEEEGEDGEKRKKKKEKKKKEDTSVPVEKVEVVEGTTGTEEEKGFLDKIKEKLPGGHKKTEEVTTPPPVVAAHVPTETTATTTIHEGEKKGILEKIKEKLPGYHAKTATDGEDKDHHKDETTSH

SEQ ID NO: 40982 - protein, 235 aa, Oryza sativa (japonica cultivar-group)
MASGGGDARRRKEEGEEDGFSSDGGDTTDAESSDERAGAGAGRRAVPGANPILSRLAVSRNPSPLAAATAAPGVCLLRFAWESAAGSLVGAVVGYGKGLVTTKGFKGSFADAASSAKIFAVLAGVQSLVACTLRQLRGKDDVLNAGIAGCCTGLALSFPGAPQTMIQSCLTFGTFSYIIEMLNKQEPALARPSITGTKDLKAGHRVLPPFTLPLPQEAMEGFSSFQNFLSKFQGK

SEQ ID NO: 40983 - protein, 164 aa, Triticum aestivum
HYRILKLCIQRVGSSPIWSTCRRPGLVISVVAAEVSGINAEPAPRPKPIKFGEIIGILNKQFIEEAEKVKVLPDLKPGDIIELRMQRPNKRRLSLFKGIIIAKHKSGVHTTIRVRRIIAGVGVEITFPIYSPRIKEIKVIRHKKVRRAKLYYLKYKLPRFSTFK

SEQ ID NO: 40984 - protein, 206 aa, Porphyromonas gingivalis W83
MKAEIHNRTISEILAHEAEAIRTIPADNDYKAAIDLIVRQVHGSNGRLITSGMGKAGQIAANIATTFSSTGTPAYFLHPSEAQHGDLGLVRSGDIMLLISNSGRTREVLELVELTKRLVPDTKFILITGNPESQLAAEVDVCLATGNPAEVCPLGMTPTTSTTVMTVIGDVLVVGTMQEIGFGFEDYARRHHGGYLGDRSREICGR

SEQ ID NO: 40985 - protein, 518 aa, Ostreococcus tauri
MFAIPPTSVLRARLNWSHQTSHSRRTIVQRYLKSTQAAIHVRAQRMDKYKIARSRVLLANSLTSQAPNDHQQEAFLRTRLSVFCSILFGYSCYYLTRNSLTFTAPAMVASPTLNLDITSIGVITSIFPLCYGCSKFVSGVVGDVLSPSLMLGGGLIATGMVNIAFGASSTLPIFCILWAMNGILQGFGAPSCAKILTSWFAASERGTYWGMWNIAHNLGGFLAPILAGTAARIHGWSWGLWAPGVIALIVGSIIVCTLKDSPEDKGFAPVEPDLNIPTNATKPAESEQKLSLVQNLLQNVLSNPFIWGLAFTYFCVYVVRQGITSWSVFYLIKEKGVVDAGAAAVRVSGLELGGLLGSLLAGRISDSLISKTQDGSVGQRIRVVMAYLLGVTASLIAFKFVPASWPVTQAAIVFMIGFFLYGPQMLIGLCGAEIVGRRSVGASEGFLGWIAYLGAANAGVPLSLLVQQYGWDAFFAALLSATAVGILLLAPMIDAKSYLQRKQVYGKGHILGNAISRP

SEQ ID NO: 40986 - protein, 280 aa, Campylobacter coli RM2228
MALTILAGLSTAIGSVIAFFSRNDNLRILSFGLGFSAGVMIYISFMEILPSAFTDFKKYYNSNYGELLALLCFFGGIFLSAIIDKFIPEDVNPHDPKEDLSELKICPLPQKNEKAPAFHAGEPLKKINVKALKRTGIFTALAIAIHNFPEGFATFISSLDNLSFGVAIAVAVAIHNIPEGMAVSLPIYHATKDKKKAFIYSALSGVAEPMGAIVGAFLILPIMNELTLAITFAVVAGIMVFISFDELLPAAKTYDKAHDSLYGLVLGMAVMAVSLILLNP

SEQ ID NO: 40987 - protein, 313 aa, Bradyrhizobium japonicum USDA 110
MSPRPLMFFGTTNLDLCFNVERLPTPGESLMGSLKQNAGGKGANQAVAAARLGLRPSFYTRLGDDDAGRSLLQALREAGVRLDAIEVCPGEISGSALVLVGDDGSNMIVIDPGANANVTPSMVEKAAEFIERDAIVVAEMGMPVPALNHLFALKSVKEFDLIFNPAPVRAGLSPAAWRSVDFVTPNQTEAFELTGVEVHDFDGAAHAAGKLLDLGPKAALITLGAQGAYYADASATFALRAFPVKVVDTTAAGDAFNGAFAASLAHRLPIREAIKKALAVAALYVTRRGAQRSMPSSWAVDEFLNSQSILELE

SEQ ID NO: 40988 - protein, 584 aa, Oryza sativa (japonica cultivar-group)
MPRALQRSGSNSLAALLRADPPPNAAIADQDDAKRPGRRRRRRRRSCLRLPLGVGAGGCRVCACDEMDPATAAPRRRAPEEKDDDEEEEEAVPPAALQCFSWKKGAAAARTSGVGDGDRVMVEEVEAAAASLSVLPDDLMEMVLGRLPLASLLAARCACRRWRDLTVAPQFMRMRRVEARPHRTPWLFLFGVEGDGWGATAAATAVHALDVDAQRWRRVGADGLRGRFLFSVAGVGDELYVVGGRSGDAGSVKTKTHKGVLVYSPLAGAWRKAASMRSARSRSVLGVFEMGTISRSILLARADKHVHRHANTGGGKFRLGGTSAVYEDPHRLSLRRLRLRDVLNDDADSSEFAATDAKVAGQEEERRAQQRLALIAVGGRGRWDEPLVSGEIYDPVTDKWFEIAGFPADVGLACSGAVCGQMFYVYCESDTLVAYHLDKGFWSVIQTSRPPPRLRDYAPTLLCCSSRLLMLCVSWCDRAGNGSASRRERVMRKLFELDLGSRRWGEASSHPDAPMDLNAAFAAGADTVYAVEMFRVFGKVLDFVTACRVSDTDDHRWRRLARNNAAADADAMSSKLKSMAVLHL

SEQ ID NO: 40989 - protein, 376 aa, Oryza sativa (indica cultivar-group)
  misc_feature (202)..(202): Xaa can be any naturally occurring amino acid
  unsure (1)..(376): unsure at all Xaa locations
MIHFRRRILTLLLQPASPRPIAGIFLPPCSLRRLLSTTAPVSPKPFAVEDYLVAGCGLTRAEAVKASAKISHLSSPSNPDAVIAFLSDLGLPRPAIAAAIAADPRLLCADVEKNLAKRVGELGDLGLSRSQIARLLPLAGWCFRSSSLATNLAFWLPVFGSFDKILKALRMNKNLLSPGVQKSAKPILAFLEQCGINASDVXRSSTMYSSRLLTANPEYLRVRRGTGGGVGPGPQFEEDDLLVIMRKLPNFVALSEKKIRRAVEFLKRDVGLEGRYIVQRPVLLSYSLERRLLPRHCLLKVLRTKGLLNSELDYYSTAALSEKKFVNKFVHPYEDHIAGLADAYASGCSEERNGVASLLSLQTEMDGVQVYAGKSG

SEQ ID NO: 40990 - protein, 394 aa, Oryza sativa (indica cultivar-group)
MIRLRERILSLLLQPASPRPIAGIFPPPCPLRRLLSTTAPVSPKPFAVDEYLVATCGLTRAQAAKASEKLSNLRSPSNPDAVLAFLSDLGLSRPDGIAAAVAADPRLLCADVGSSLARRVDELGGLGLSRSQIARLLPLAGRCFRSSSLATRLAFWHPVFGSFENILKALKMNAALLGSDLDKVAKPNLAFLAQCGINASDVTRTTLSLYSCRLFTVNPRFLQDAVARVEELGVARGWRTFHRVLSTVAFLSRETIASKMQLLDDLGFSQDDFLVIVRRAPQVLRLSDGRIRRSVEFLIRDVGLEQSYIAQRPTLLAYSLERRLLPRHCLLKVLKAKGLLNCDLSYYCIAAMSEEKFVQSCHSSHIMCLPEVDLMVLEVELELPLPDTLLPAAA

SEQ ID NO: 40991 - protein, 673 aa, Oryza sativa (indica cultivar-group)
MAARRRLLLLLALLLCRLAAVLPTSEVEALQGFMAGFAGSNAAFQSWDASAPNPCTWFHVTCGPGNQVIRLDLGNQSLSGELKPDIWQLQALQSLELYGNSISGKIPSELGRDLSHNNLSGIIPTNGSFSHFTPIREIALGSARGISYLHEGCDPKIIHRDVKAANILLDEKLEAVVGDFGLARIMDYKVSHVVTGVMGTLGHIPMEYLTAGRTSDKTDVFGYGIMLFELISGKRGFDLVGLANEENARVHDWESAPSRPRMSTVVTMLEDGIAEHWDAWQRKTIVQASLQGGQGVSEARNDSVANLPPDTLSAQQLGSSGVGLVLNAFLLLSGATKASKSISHLKSPSRPDAVVAFLAGLGLSAADIAAAVAYDPRLLCAEVDRTLAPRLAELAGLGLSPSQIARLVLVDPARFRRPTVISKLQYYVPLFGSFETLLQALKNNSYLLSSDLEKVVKPNVALLRECGLGACDIAKLCIPLPRLLTTSPERVRDMVAQAENVGVRRGSKMFRHAILAVAYISEEKIAAKMQFLMKTLKWSDAEARIAVSKLPVVLRSSEDKLSRVSEFLISEVGLEPAYIAYRPAMLTYSLERRLMPRHCVLKYLKDNGLIESDKSYYSAVQVTEEVFVEKYISPYEDTAPHLAEDYAAVSSVKIPTRFRLKGPKTGHASAQTA

SEQ ID NO: 40992 - protein, 245 aa, Thermoplasma acidophilum DSM 1728
MITGGSRGIGRAIALGLAKQGANILISYASHDSEADEVLETASKYGVKAHKVKVDQSDPYESIRFAEKAIETFGKVHILVDNAGICPFEDFFRISVDLFEKVWKVNVESHYFITQRIAKNMIENKINGRILLISSISAHVGGEFQTHYTTTKSALNGFMHSIAIVLGKYGILVNSLEPGTILTDINKEDLSNQEKRAYMERRTVVGRLGLPEDMVAPALFLLSDDNTYVTGTELLADGGMLINLQ

SEQ ID NO: 40993 - protein, 202 aa, Cryptococcus neoformans var. neoformans JEC21
MSERIASVERTTSETHISCTIDLDHIPGVTEQKINVSTGIGFLDHMFTALAKHGGMSLQLQCKGDLHIDDHHTAEDCALALGEAFKKALGERKGIKRYGYAYAPLDESLSRAVIDISSRPYFMCHLPFTREKVGDLSTEMVSHLLQSFAFAAGVTLHIDSIRGENNHHIAESAFKALALAIRMAISRTGGDDVPSTKGVLAL

SEQ ID NO: 40994 - protein, 445 aa, Zea mays
MCRAGAASLSIRSAMHCFRFASWERDADERRESAAAATTGRSLSARSNGSTTSTDRDVRRSASECSLKASELSSASSLGRGRQLSLSQRPPNTLRVFTFQELKSATRGFSRALMLGEGGFGCVYRGTVRSALEPRRSLDVAIKQLGRKGLQGHKEWMTEVNVLGVVDHANLVKLIGYCAEDDERGMQLLLVYEFMPNGSLADHLSSRSPRPASWAMRLRVALDTARGLKYLHEESEFKIIFRDLKPSNILLDDNWNAKLSDFGLARLGPQEGSHVSTVVVGTIGYAAPEYIHTGRLSTKNDIWSFGVVLLELLTGRRPLDRNRPRGEQNLVNWMKPYSSDAKKLEAAIDPRLQGNYCKRSAAQLASVANKCLVRHARHRPKMSEVLEMVRKIVENSETGTPEHPLISNSEELVSDERKRKRLGLKRRIADIKAGEGRWFAWQRYR

SEQ ID NO: 40995 - protein, 101 aa, Arabidopsis thaliana
  misc_feature (10)..(10): Xaa can be any naturally occurring amino acid
  misc_feature (18)..(18): Xaa can be any naturally occurring amino acid
  misc_feature (37)..(37): Xaa can be any naturally occurring amino acid
  misc_feature (46)..(46): Xaa can be any naturally occurring amino acid
  misc_feature (55)..(55): Xaa can be any naturally occurring amino acid
  misc_feature (58)..(58): Xaa can be any naturally occurring amino acid
  misc_feature (63)..(63): Xaa can be any naturally occurring amino acid
  misc_feature (69)..(69): Xaa can be any naturally occurring amino acid
  misc_feature (72)..(72): Xaa can be any naturally occurring amino acid
  unsure (1)..(101): unsure at all Xaa locations
MASSMLSSTXVVTSPAQXTMVAPFTGLKSSASFPGTXKANNDLTSXTSNGGRVSXMKXVWPPXLVKKKXGTXFLTDLGGGWKTLKFAEFGLWPLLCSHLKL

SEQ ID NO: 40996 - protein, 425 aa, Methanococcoides burtonii DSM 6242
MNSISEEAKYTIQKVHAREILDSRGNPTVEVDIYTGCGFGRASVPSGASTGSNEALELRDKDADRYNGKGVLKAVDNINKTLSKELLGMDARNQREIDELMIALDGTENKKTFGANAILGISMATAKAAADSLGIALYRYLGGTNAFALPVPTMNVINGGKHAGNDLSIQEFMIQPKGADTFSNALRMGAETYHALGKVLEDKYGASATNVGYEGGYAPPISTTADALDALVSAIEEAGYTESEISIGLDSAASEFFDGDKYFIDGNKLAPAELVDYYLDLIETYPILSIEDPFHEESFEDFAALTSEAWDTIIVGDDLFVTNVNRLAKGIEMEAANALLLKVNQIGTISESFDAANLAQRNGYSVVVSHRSAETEDTMIADISVAIGGDLIKTGAPARSERTAKYNQLLRIEEDLGDAARYVQL

SEQ ID NO: 40997 - protein, 387 aa, Oryza sativa (japonica cultivar-group)
MEQVSASSDLIRFLFLGDSGVLILQTFACFCGCVCGGGGAQYEKEEKIGEGTYGVVYRARDKVTNETIALKKIRLEQEDEGVPSTAIREISLLKEMHHGNIVRLHDVIHSEKRIYLVFEYLDLDLKKFMDSCPEFAKNPTLIKSYLYQILRGVAYCHSHRVLHRDLKPQNLLIDRRTNALKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQDLATIVPTLDPAGLDLLSKMLRYEPNKRITARQALEHEYFKDLEMIQIALRCCYTHLSGVPLGLGSTGGHASLVLSKILSRLVACVRHHQTRVPQRLIMNMH

SEQ ID NO: 40998 - protein, 342 aa, Bacillus cereus ATCC 14579
MTRVAINGFGRIGRMVFRQAIKESAFEIVAINASYPSETLAHLIKYDTVHGKFDGTVEAFEDHLLVDGKMIRLLNNRDPKELPWTDLGVEVVIEATGKFNSKEKAILHVEAGAKKVILTAPGKNEDVTIVVGVNEDQLDITKHTVISNASCTTNCLAPVVKVLDEQFGIENGLMTTVHAYTNDQKNIDNPHKDLRRARACGQSIIPTTTGAVKALAKVLPHLNGKLHGMALRVPTPNVSLVDLVVDVKRDVTVEAINDAFKTVANGALKGIVEFSEEPLVSIDFNTNTHSAIIDGLSTMVMGDRKVKVLAWYDNEWGYSRRVVDLVTLVVEELAKQENVQHI

SEQ ID NO: 40999 - protein, 682 aa, Rickettsiella grylli
MGSFNPYRQRENNVMAYQKKYADALRFLTLDAVEKANSGHPGMPMGMADIATVLWNDFLVHNPNNPNWSNRDRFILSNGHGSMLHYALLHLTGYDLSLHEMKRFRQLHSKTPGHPEVGLTPGIETTTGPLGQGFANAVGMALAEKNLAAHFNQPSHLIIDHFTYVFLGDGCLMEGISHEAASLAGCLGLGKLIAFWDNNSISIDGHVSGWFKDNTPERFKAYHWHVISDIDGHDPQQIKTAIEKARDITDKPSLLCCKTQIAWGAPHFVGSHRSHGAALGEKEVAATRIALQWNYPPFEIPQEIYHAWDARSKGAALEKTWEEKWNRYQSKFPELANEYQRRVDKKIPKNWNLETKKLIEKIFKDPPQKIATRKASQNTLNAFAPLLPELLGGSADLTESNSTFWKGAQVLSKENPAGNYIHYGVREFGMSAMMNGIALHGGFIPYGGTFLVFSDYARNAIRLSALMKQKVIFVYTHDSIGLGEDGPTHQPIEHLNSLRLIPQLSVWRPCDALETAIAWQQAIQHEGPTCLVLTRQSVQAQSHNLETLQSIHRGAYILLDSPSLPEAIIIATGSEVSLAINAAQTLNQNGRHIRVVSIPCADRFEQQDAAYKAKILPNSITLRVAIEAGNPDFWYRYVGLKGKIIGLHQFGESAPGSDVFKHFGFTTENIIKTLNQLLADEA

SEQ ID NO: 41000 - protein, 338 aa, Rickettsiella grylli
MTIRVAINGYGRIGRNILRAFFENPTLHDIQIVAINDLGNIDINAYLTSYDTTHGKFAGSITIDKDCLIINHQPIKIFSERDPKNLPWKALDIDVVHECTGLFTSAEKAGKHIKAGAKKVIISAPAGKEVDATIVYGVNHHILKKSHTIISNASCTTNCLAPLAKALHENLGIVHGLMTTIHAYTNDQVLIDTYHSDLYRSRSATHSMIPTKTGAASALGLVYPELDGKLDGLAIRVPTLNVSLVDLSFQAERKTTSDEVNALLKKASEHNPLKGLLNYSELPLVSIDYNHNPASATVDAVQTRVIGNFVKVLAWYDNEWGFSNRMLDVTTALMNVST

SEQ ID NO: 41001 - protein, 924 aa, Prochlorococcus marinus str. MIT 9211
MSTERSDTTSDDVASMDLDPKGIFPFQLDDFQLEAIDALNQGHSVVVSAPTGSGKTLIGEYAIYRAIAHGQKVFYTTPLKALSNQKLRDFRNQFGSKNVGLMTGDLSVNREASIVVMTTEIFRNMLYAEVDENDDPLIDVETVVLDECHYMNDSQRGTVWEESIIHCPSSIQLVALSATVANAGQLTDWIQEVHGPTELVFSDFRPVPLEFSFCSAKGLHPLLNDAGTGLHPNCKVWRPPKGHRRKGRSVKPLQPEAPSIKFVVSNIAERSMLPAIYFIFSRRGCDKAVNDLGSVCLVNPEEKQRIQARLRSYIQLNSEAVRDGIHVDSLTRGIASHHAGVLPAWKELIEELFQQGLIKVVFATETLSAGINMPARSTVISVLSKRTENGHRQLMGSEFLQMAGRAGRRGLDSKGYVVTVQSRFEGVREAGQLATSAADPLISQFTPSYGMVLNLLQRYDMEKSRELIERSFGRYLASLDLVDDEELVDQLRDQLGKLQGIAGDIPWNDFEDYEKRKGRLKEERRLLRILQQQAAETLAHELTLALQFASIGTLVSLKASPLHGRITPAVIVAKQDGPGQYPMLLCLTDENIWILVSCKAVVSLHAELSCLDIESYKVPSLTRSNELAHGSEETKELSLAICAMSNANNMTTPQYDLAGEVLGQAKLVKELEDVLETLPAHKWGDRKKLKKHRRRMDELELEILHRQQLIHHRANKHWETFVSLLEILQYFGCLDEVDATEIGRTIASIRGDNELWIGLALMSGHLDELQPAALAGVLEGISTEVNRPDLWSGFISSPQSTEAFNDLSGIRRELNSHQERCQIDIPICWSPELMGLVEAWGHGVSWSELIANTSLDEGDVVRIIRRTIDLLSQIPHCEAISKQLRDNARLALKAINRFPVCEAEDLVKEAQASKKSNPATERIS

SEQ ID NO: 41002 - protein, 327 aa, Synechococcus sp. WH 5701
MAETLLFNALRDAIDEEMARDPYVCVFGEDVGQYGGSYKVTKDLYEKYGELRVLDTPIAENSFTGMAVGAAMTGLRPIVEGMNMGFLLLAFNQISNNMGMLRYTSGGNYTIPTVVRGPGGVGRQLGAEHSQRLEAYFHAVPGIKIVAVSTPTNAKGLMKAAIRDNNPVLFFEHVLLYNLSEEIPEGDYICSLDQAEVVREGKDITILTYSRMRYHCLKAVEQLEADGVSVELIDLISLKPFDLETITRSIRKTHKVMVVEECMKTGGIGAELLALITEHCFDDLDARPVRLSSQDIPTPYNGALENLTIIQPRQIVEAARQLKAGTI

SEQ ID NO: 41003 - protein, 693 aa, Magnetospirillum magnetotacticum MS-1
MTNLFVIACGVLALLYGVYAIRSVMAASAGTARMQEIAAAVQEGAAAYLNRQYTTIAMAGVVVAIILAAKLGLYQAVGFVIGAVLSGAAGYVGMNVSVRANVRTAEAARSGGMQQALDVAFKSGAITGLLVVGLGLIGVAGYYMVLKNVGIDSRALLEALVALSFGASLISIFARLGGGIFTKGADVGADLVGKVEAGIPEDDPRNPAVIADNVGDNVGDCAGMAADLFETYAVTVVGTMLLGSIFFTGVAQEQMMMLPLVICGVCIFASIVGTFFVKLDAGLNIMKALYKGVIVTALLSAVLIAGIIQINLGGFDAKFVAAGKEITGMSLYICAIIGLIVTGLLVWITEYYTGTDYRPVKSVAQASTTGHGTNVIQGLAVSMEACALPVIVISVAIIVSYKIAGLFGISVAATTMLALAGMIVALDAYGPVTDNAGGIAEMAELPKEVRKVTDALDAVGNTTKAVTKGYAIGSAGLASLVLFAAYTEDLHHYFPQLNITFSLEDPFVVVGLFLGGLLPYLFGAMGMQAVGRAAGSVVVEVRRQFKEIPGIMEGTAKPDYGRAVDMLTKAAIKEMIIPSMLPVLSPVVLYFVILLAADQKAAFTAMGAMLLGTIVTGLFVAISMTSGGGAWDNAKKYIEDGHHGGKGSDAHKAAVTGDTVGDPYKDTAGPAVNPMIKIINIVAILLLAMVAGH

SEQ ID NO: 41004 - protein, 354 aa, Zea mays
MHPKARIHADPVREVDHFDCLPDSLVLLILNKVEDVRSLGRCYAVSKRLCGLVSLVHDVYVKIDRVVAVDGDAEGTLNLSSPKPRSIFSHFLRLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLKLRVVWTISSLIAASTRHYLLRSIINGHPTLQSLVLTDADGQGTLCMGAKQLEEFRENQLSASACSNRTQVPACNMKLKYAPYVELPGGMALQGATLVAIKPSPEGSNGSHPNRKEAEGFVFGAFDGPFKAAVKTLMKRRTYLLEMNGF

SEQ ID NO: 41005 - protein, 425 aa, Zea mays
  misc_feature (154)..(154): Xaa can be any naturally occurring amino acid
  misc_feature (217)..(217): Xaa can be any naturally occurring amino acid
  misc_feature (297)..(297): Xaa can be any naturally occurring amino acid
  unsure (1)..(425): unsure at all Xaa locations
MESFGVPPAPVAAPEKRKKPLDLKDPVPAAAAAAANGGGATKASPAAKWAEKKKLVGGDAGYVLEDVPHLTDYLPQLPTYPNPLQDNPAYSVVKQYFVNPDDTVTQKIVVHKTSARGTHFRRAGPRPRVYFQPDEVNAAIVTCGGLCPGLNTGXSASLGGYKGFYSKNTVALTPKSVNDIHKRGGTVLGTSRGGHDTAKIVDCLQDRGINQVYTSGXRAGTQKGAPVIYEEVRRRGLKCAVVGVPKTIDNDIAVIDKSFGFDTAVEEAQRAINAAHVEAESAENGIGVVKLMGRNSXDHFKKKPRFPITLKYIDPTYMIRAVSSNASDNVYCTLLAHSALHGAMAGYTGFIVAPVNGRHAYIPFYRITEKQNKVVITDRMWARVLCSTNQPCFLSHEDVENMKHDDDEHHLHNTLLLDSPENSSK

SEQ ID NO: 41006 - protein, 854 aa, Zea mays
MGASRKLQGEIDRVLKKVQEGVDVFDSIWNKVYDTENANQKEKFEADLKKEIKKLQRYRDQIKTWIQSSEIKDKKALMDARKQIEREMERFKVCEKETKTKAFSKEGLGQQPKTDPKEKAKAETRDWLNNVVSDLESQIDNFEAEIEGLSIKKGKQRPPRLVHLEKSITRHKAHIKKLESILRLLDNDELSPEQVNDVKDFLDDYVERNQEDFDEFSDVEDLYSTLPMEKVEALEDMVSLAPSSLVKGVASVPTTAVSSTKSSIATSLTQPTVSTAPSQSTSQDQTEDTASQESNSESVPQTPPPKGGNSGPSIPAVPIAVSTGSAAISVLAETISSPVRPIVPTTVATILSSAIPRSAPENTSTVTSIPANLSITLKDDESMSFPPRRPSPAITEIGIGRGIARGTTSQALGTAPITIGPVPGNGSVSALPGINDLSKRNILNTDEKINSGGLSQQLVMPLGSKVQPQQVPRTNDAISSESANTNESPILGGRVFSPPVVSGVQWRPLGAAAFQNQSEISHFRGRPEISADHREKYIQRLQQVQQQGGSLLNVSHITGINQKQFPTQQPNPLLQQFNSQSSSISSQVNLGVQGTDAGHIKSEEEEQLLAEDGVESSATTGANKQTSEDDTKIPYSNPSAPAAESNQLPRDTDPSPGQPLQPGMSSSGVGVIGRRSVSDLGAIGDNLTGTSASSGHDQLYNLQMLEAAFHKLPQPKDSERAKTYIPRHPAVTPASYPQVQPSIVSHPSFWERIGSDTLATDMLFFAFYYQQNTYQQYMAARELKKQSWRFHRRYNTWFQRHVEPQVTTDEYERGSYVYFDFHVTEDGSGWCQRIKNDFTFEYNFLEDELSVQTN

SEQ ID NO: 41007 - protein, 432 aa, Zea mays
  misc_feature (137)..(137): Xaa can be any naturally occurring amino acid
  unsure (1)..(432): unsure at all Xaa locations
MGASGKWIKSLVALKAPEKAAGHKGGRKWRLWRSSSATSRASAGEGSALASESSSASADSFNSVLGRRGPRGRPGDFLLIRQEWAAVRIHTAFRGFLARRALKALRGIVPAAGRWCGGRRVAQATGRHALRGWHALXRVQERAPGAPGRAPSADGHGSQGQDALNGCASSTKDAMEQWCDRHGSVAEVRSNLHMKHEGAAKRERAIAYALSHQPRGSRQKGTPSSPANCVRSHDPNGCNQDFSYLDGWMATKPWETRSTERNHSDSQLAKHEELNLPASKLSDASSVKIRRNNVTTRVSAAKRPPPSSVLSAASSDSAYGDKSPRSRPSVTLTSATTNTVLASEARSDSGDTGGPNYMSLTKSAKARLSGCSGSSHHRSFQRPRSGDMSRVTLSSIDTQSNAGSEISVTSKRLNSMSLNLKGRSLDKENEED

SEQ ID NO: 41008 - protein, 508 aa, Oryza sativa (japonica cultivar-group)
MAGHLGLGRVPLSQKPLLSILNHEQDDDHQLVLASASASVQWCYLTPDWLLACFLRRRLRLLLHWAKQRLLQEEALRVSVSVYSELEGGSLPIDVFILARERHRQREEEEEEAPLLLMASSAASSLLVAVVVLVLVAAAEVNKPAVRTIESPDGDLIDCVAAHLQPAFDHPRLRGQRPLRGPPERPRGWRPRPGPNDTAAGDAGVQLWASSAGGASCPEGSVPIRRTTEADVLRASSVRRFGRAPTARVRRDSVSGGHEHAVGYVAGEEYYGAKASINVWAPKVSTPEEFSLSQIWVIAGSFGNDLNTIEAGWQVSPQLYGDNSPRFFTYWTTDAYQTTGCYNLLCSGFVQTNSRIAMGAAISPTSGYKGGQFDISLLVWKDPNHGNWWLEFGNGELVGYWPSFLFSHLASHASMVQFGGEVVNTRADGGAHTATQMGSGHFAGEGFGGASYFRNLEVVDWDNSLVPLAAGFHVTADHPDCYDIQGGVNAVWGNYFYYGGPGKNVKCT

SEQ ID NO: 41009 - protein, 177 aa, Triticum aestivum
MAGAQTGSSATPCASCKLLRRRCARDCVFAPYFPPEDPHRFATVHRVFGASNVSKMLQELPAAQRADAVSSLVYEATARMRDPVYGCAGAISYLQQQVSQLQVQLAVAQAEILQRINHPSPASAFHLQELQQRQVQQQQQMQMDDDDKAYSSLVMQNDLMSTLLLQEACLKKESLWT

SEQ ID NO: 41010 - protein, 133 aa, Oryza sativa
MASKSLFLLGAVLASLLLVAQDVSAARELAEANEAKGKNMKQEVAYGPQDEKLAHHADGYGHGGGYGGGGGGGGGYGGYGGYGGYVGGGYGGYNQGYGGGGGGGYSKGFGGGYGGGGYPGGGYYGGGGGGGWH

SEQ ID NO: 41011 - protein, 381 aa, Oryza sativa (indica cultivar-group)
MGEEEKKEAAKAKEEEKPKQEEKPKEQEEGKKEEKPKEEGEKGKDGGGGEEKKDGEAAAAADAPPPPPPPEEVVMRVYMHCEGCARKVRKILKGFDGVEDVIADSKSHKVLVKGKKAAADPMKVVERVQKKTGRKVELLSPMPPPPEEKKEEEKKEEPEPPKPEEKKEPPVIAVVLKVHMHCEACAQGIKKRILKMKGVQSAEPDLKASEVTVKGVFEEAKLAEYVHKRTGKHAAIIKSEPVAPPEKVAAEGGDEKKAAEGGDEKKDEKEEKKDGKEEGGNGGGDEKKEEKEKEKEGGNADGEEKDKDKEKDPAAIAAANLYLHYPRFAFPAGYYPPGPGYAYPPPYPPPYQPSYPPYPSHPSHHPSQIFSDENPNACSVM

SEQ ID NO: 41012 - protein, 202 aa, Beta vulgaris
  misc_feature (189)..(189): Xaa can be any naturally occurring amino acid
  misc_feature (191)..(195): Xaa can be any naturally occurring amino acid
  unsure (1)..(202): unsure at all Xaa locations
MNQDYDYLFKLLLIGDSGVGKSCLLLRFADDSYVESYISTIGVDFKIRTVEQDGKTIKLQIWDTAGQERFRTITSSYYRGAHGIIIVYDVTDQQSFDNVKQWLNEIDRYASDNVVKILVGNKSDLTSNKVVSSETAKAFADEIGIPFLETSAKNSTNVEQAFMTMAAEIKKRVASQPASNATRPTTVPXRXXXXXQKSNCCS

SEQ ID NO: 41013 - protein, 368 aa, Oryza sativa (indica cultivar-group)
METLSMLKVGYTLLRSETPATDLVNAFMDWAARRSLLLLAVFVPPYLAYRLASSALAAASPEDVAGKVVLVTGASSGIGEQVAYRYARRGARLALVARREASLGEVAARARALGSPDVLAVPGDVARPDDCRRFVQATVEHFGRLDHLVNNAGLANVCWFEEVPDVANFKQVLDVNFWGTVHPTHAALPHLKASRGKIFVNSSASAVLAMPRMSFYNASKAAVHNFAETLRMELHGEVGVTVATPGWVDSEMTKGKHLSSHGAMEVDQDTRDAQVGVFPVERGERCAEAIVDAVARGRRRVTSPAWYGALFLWRTMAPEVADACQRVFYHRRSSAGGGGGRARAALEATGAKAVLQPPSLRSSEIKVE

SEQ ID NO: 41014 - protein, 355 aa, Oryza sativa (indica cultivar-group)
MAALAQLAGAAVRVALAALLALLLPAYRVYRLTASFLGALLAAAAADDVAGKVVLITGASSGIGEHLAYEYARRGAYLALVARREESLREVGDAALAAGSPGVLVVAGDVSSPDDCRKFVDDTIRYFGRLDHLVNNASIWQVGKFEELTDVNHFRKLMDINFWGHVYPTRHAIPHLKKTRGRIVGVTSNSSYIFMPRNTFYNASKAAAANLYETLRMELAGDGIAITEVIPGVVESEITKGKMLTKEGDMRVDQDERDAILGAAPVERAGEFARATVRGVCGGERYVFEPRWYRAAYTLRVCFPEALEWCARLLTVWRLGPATTDTVGRWLLLGVPGQRWLSQPASLRSPEIKAR

SEQ ID NO: 41015 - protein, 705 aa, Rickettsiella grylli
MHMFSDLKQELQTYLSPAHIKQVYSAYQFAARAHSGQKRHSGDPYISHPLAVAKILAQMRMDVQTLIVAILHDVIEDTAIEKTVLTATFGHEIAELVDGMSKLTQIQFQSRAEAQAENFRKMLLAMSKDIRIIIIKLADRLHNMRTLSAVSLEKRHRIAKETLDIYAPIAQRLGVHMVRIELEDLCFLNLYPWRYRILQETVQKNRRKHKTSIHKIEFALKECLDKHHLRFHAIWHKKKHLYQIYKKMHENHLAFNEIIDIPIFSIIVDTIDNCYRVLGAVHSLYKPLPDHFHDYIALPKANGYRALHTTLFGPEATSIHIQIRTTTMDNGADHGIVSYWLEEKTKAHELRPHLRAREWLKRLLDIQQTTPSSLEFLETVKIDLFPTDIYIFTPKGDIIELPHKATLIDFAYAIHSDVGNHCIAAKIDKHLAPLSTHLKSGQTVEIITDSKTFPDAHWLEFVATGRARSHIRQFFKNKQHNEAVQLGQRLLDNNLTPLGQDSTHIHPKNLNKTLQKFQYNSLENLLEAIGLGYIHPALVAHSLCNLKLSAKNPINALPLFLKNSDNSLIHFAECCRPIPGDEMRGLLNAGHGLTVHLQRCKYAARLIKKNPERAILCQWEKQTHGFFKTDIYVETINQHGVLALLTHNIAKADANIENIKVESRDRQHSIIQFTLSVINRKHLAKVIRFLRAVHSTVKITRHLFL

SEQ ID NO: 41016 - protein, 310 aa, Saccharomyces cerevisiae
MNRSPGEFQRYAKAFQKQLSKVQQTGGRGQVPSPRGAFAGLGGLLLLGGGALFINNALFNVDGGHRAIVYSRIHGVSSRIFNEGTHFIFPWLDTPIIYDVRAKPRNVASLTGTKDLQMVNITCRVLSRPDVVQLPTIYRTLGQDYDERVLPSIVNEVLKAVVAQFNASQLITQREKVSRLIRENLVRRASKFNILLDDVSITYMTFSPEFTNAVEAKQIAQQDAQRAAFVVDKARQEKQGMVVRAQGEAKSAELIGEAIKKSRDYVELKRLDTARDIAKILASSPNRVILDNEALLLNTVVDARIDGRGK

SEQ ID NO: 41017 - protein, 510 aa, Cryptococcus neoformans var. neoformans JEC21
MYHSMPDSHDLPAQSIASSSRQPSSILNRADQHASEAGPSRSASTDKGYHADVVNRPKGDHLGVPPSSAYARGPTSPTSELSPLSCSGMTPHLDICKYPTQQLLRLLAGLLQHIAGSNDQLRAELEAEEDDEMDEQHVDDNTANVDRRSRPHSRASGRSYVPSGTSSTAELFSEPASSTLTSPALTSRSSSAASSPTSYPLSQFPLFTASKSSLSHPSALLAFHARHIPSISIEAYLLRILKYCPATNEVFLGVLVYFDRMTKLGTPAGIGGESSKVGKKGKGFAIDSYNVHRLVIAGVTVASKFFSDVFYTNSRYAKVGGLPPTELNSLELQFLLLNDFRLRVSVEEMQRYGDRLLAYAEEAGEDIGTVGVERRRSDASEWGEFEASANAPLPNPVSIKYASTQPPLPPNQSSTPVTVPTSPRIVQSKTQPREAQQPQTRAQTQPMKSHTFPVGSSVPSASAGSRTGTGGGVANAGNGADTVSGGIRDWVRGDDPIAVVGGRMTSPMRD

SEQ ID NO: 41018 - protein, 331 aa, Oryza sativa (indica cultivar-group)
MAASSTATRLSPPRLHAPTTPSPHLPLRRSRFSPLRAAKLEAVLSIGTHLIPHPRKAETGGEDAFFVNGDDGGVFAVADGVSGWAEKDVNPALFSRELMAHTSTFLKDDEVNHDPQLLLMKAHAATTSVGSATVIIAMLEKTGILKIASVGDCGLKVIRKGQVMFSTCPQEHYFDCPYQLSSEAIGQTYLDALVCTVNLMEGDMIVSGSDGFFDNIFDQEIVSVISESPGVDEAAKALAELARKHSVDVTFDSPYSMEARSRGFDVPSWKKFIGGKLIGGKMDDITVIVAQVKAVMIPDDEGVDEEKGQGDEQGSAVAVASSEQKEDSITT

SEQ ID NO: 41019 - protein, 371 aa, Bacillus cereus ATCC 14579
MTVIRGLEGVVATTSSVSSIIDDTLTYVGYNIDDLAENATFEEVVYLLWHRKLPNEKELAEFNEIVSEYYKVPGEILTYLKQVDLKIAHPMSVLRTAISMLSLYDESAEIMDEKSNYLKAVKLQAQVGTLVAAYARIRKGLDIVEPRKDLSLAANFLYMLNDREPNEVEIEAFDKALVLHADHELNASTFTARVCVATLSDVYSGITAAIGALKGPLHGGANENVMKMLTEIGEEENVESYIHNALQNKVKIMGFGHRVYEQGDPRAKHLREMSKRLCVLLGEEKWYNMSIKIEDIVTKEKGLPPNVDFYSASVYHCLGIDHDLFTPIFAISRMSGWLAHILEQYENNRLIRPRADYNGPTHQVYVPIAQR

SEQ ID NO: 41020 - protein, 108 aa, Rickettsiella grylli
MTQLTTFEIIKQQIERYPLILYMKGTPEKPCCGFSARVVDILKACRVKFAHVNILEQSDIRRDLPQYSNWPTFPQLYYKGELLGGCDIVEQLYITGQLEKIIGKLDFN

SEQ ID NO: 41021 - protein, 473 aa, Synechococcus sp. WH 5701
MANPAQDLLRRIRDEGIELIDLKFADLHGQWQHLTVCTDLLNEESFQSGLAFDGSSIRGWKAINESDMVMVPDPATAWIDPFLRHKTLSLICSIQEPRSGEAYGRCPRSLAQRALAHLAGTGLADTAYFGPELEFFLFEDVRYGSSEGGSFYSVDSIEAPWNSGRLEEGGNLAYKMNAKEGYSPVPPSDTFQDIRSEMLLTMGQLGVPIEKHHHEVAASGQQELGIRFAELISAADNVMIYKYVVRNVARKYGRSATFMPKPVFADNGSGMHVHQSLWRDGQPLFFGLGTYADLSQTARWYIGGLLRHAPSFLAFTNPTTNSYKRLVPGFEAPVNLVYSQGNRSAAVRIPLSGENPRAKRLEFRSGDAMANPYLAFSAMLLAGLDGIRQQIDPGDGMDLDLFELPPEDLEQIATLPSSLEGVLAALEADHEYLLAGEVFSEDFISNWIALKSEELQQLRQRPHPYEFSLYYDG

SEQ ID NO: 41022 - protein, 96 aa, Synechocystis sp. PCC 6803
MADPLTPAISDRICKHMNEDHASAIALYAQVFGQQTDVTMAQMQAIDPTGMDLVVESEGGSKTIRIEFEQPLKDSEDAHQVLIAMAKQARSVGKNS

SEQ ID NO: 41023 - protein, 172 aa, Brassica napus
  misc_feature (29)..(29): Xaa can be any naturally occurring amino acid
  misc_feature (35)..(35): Xaa can be any naturally occurring amino acid
  misc_feature (56)..(56): Xaa can be any naturally occurring amino acid
  misc_feature (92)..(92): Xaa can be any naturally occurring amino acid
  misc_feature (112)..(112): Xaa can be any naturally occurring amino acid
  unsure (1)..(172): unsure at all Xaa locations
DNNRQETRYDGQQPFITNDASIGFSRKRXKVPKPXQQHDKFLEAGISSKIMKVALXQQKEIADEENAERNSITAVFCVASALNAEEENRVIXEEEDDIDDFDGKYDDDSYQXDVNEEDEKLFELFLVKKAPPQHTLADIIIKKIKDNDAELPEEERHDPDQMDPMIAKLCKG

SEQ ID NO: 41024 - protein, 864 aa, Gibberella zeae PH-1
MAGQEPDGSEPPSPRTSRRHPPLPRNRSAGELDERTPLLTTSRSHIRISTASSSRQQRGTLSREHSYLGAYHGSRNHSRHPSWSSRLVNALSDRHESSMTESKGTIFPDERMWYDQFTSTDWVHDAIADSHRVKELRSRKDFWGRLRVVFDGAQGWILSALCGFIVALMAYTVDVAESTVFDFKDGHCTRGWYLNRKRCCPDITCDDWETWSYKLNNPFGEVWSSFVIYMAFVLILAAMACWMALWTKTVVPSAYQLTTLDENLAVDNIHHTYDDSNESESSTPQPQAEPKPENPPMVYYSAAGSGVAEVRVILSGFVLHGFLGARTLIVKMVALILSVASGMSLGKEGPYVHMAACVGNILCRIFSKYDRNDGKRREVISAAAAAGVAVAFGAPLGGVLFGLEEVSYFFPAKTLFRTFFCCIVAALSLKFLNPYGTHKIVMFEVRYLVDWEYFELVSFIFVGVIGGALGALFIKASKYWAQSFRKIKLIKKHPLLEVLLVALVTGLMSYWNSLTKLPVAELLLNLASPCEGSNIDWEERALCPGSIDEIPPILSHLFVALLIKGFLTVITFGIKVPAGIYVPSMVVGGLMGRIVGHIVQWAVLRVPHWGIWGDCAFSRDGSCIQPGVYGLIAAGATMCGVTRLSVTLAVILFELTGSLDYVLPFSLAILVAKWTSDAIEPNSIYDLLTSMNSYPFLDNKHKPIFTEDLADIVPRIRKERIIDITNSPVVPATSLRIKLELLHRAGELDGGLPIVRHGILVGLIPAPDLGFALDQLEDEATDLCLMDRVPNIDEDDESHDPTDFTPYIDPAPVALDIKSPMDLVYELFSKLGLRYICVLKDGRYAGMTHKKTFVRYMREHEKHD

SEQ ID NO: 41025 - protein, 375 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 41026 - protein, 269 aa, Brassica napus
MEHSKYKRGRMAQTTLGSGSYPIKTIVVWVQENRSFDHMLGWFKELNQEIDGVTKSDPKSNPVSSSDPNSLHVVLGDQSQYVDPDPGHSIQDIYEQVFGKPWDASHPDPNPGPATMSGFAQNAERNKTGMSSAVMNGFKPDAWAVYKELVQNFAICDRWLASVPASTQPNRLFVHSGTSHGASSNDRKLLIEGFPQKTIFESLDEAGFSFGIYHQFPPATLFYRNLRKLKYLTHFHQYGLQFKKDGKEGKLPNYVVVEQRWSIYCYSAT

SEQ ID NO: 41027 - protein, 306 aa, Pasteurella multocida subsp. multocida str. Pm70
MKKLTVLGSVNADHVISVPHFAKPGETLTGNHYHIAYGGKGANQAVAAARLGANIDFIACIGDDAIGQAMKKAFQQDGINTQAVVEIADQMTGIAMIQVNAHGENSIVIAAGANAYLTETVVEQFADKITQADTLLMQLETPLRAVIFAAKLAKSANTKVVLNPAPAQPLPDELLTQLDMITPNETETEILTGVKVVDEHSAAQAAALFHQKGIETVLITLGSKGVYASQKGTPGKMVAGFRVDAKDTTAAGDTFNGALMTALLEDKPLADAIRFAHAAAAISVTRAGAQPSIPTRQETLNFLQSH

SEQ ID NO: 41028 - protein, 229 aa, Triticum aestivum
MASFARQEHQFLAELGLAPRNPGSFACGAWGGSGPVVTTTNPSNNEVIAEVVEASMDDYEKGMSACFDAAKTWMAVPAPKRGEIVRQIGDALRAKLHHLGRLLSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVFKKHYQVNLKTFVGVLIATIR

SEQ ID NO: 41029 - protein, 328 aa, Glycine max
MALRLTTVVSSVGHSGKPRFRFRIRSVAATVRNMAFSATSKVIDSHLHVWASPQEAGRFPYSLGQEPTLPGNAEFLLQCMEEAGVDGALIVQPINHKFDHSYVTSVLNKYPTKFVGCCLANPADDGSGLRQFEDLVLKDGYRAVRFNPYLWPPGEKMTNKVGKEIFQRAGELNVPVGFMCMKGLDLHISEIEQLCTEFPSTVVLIDHLGFIKPPLNEEEGLVFSQLLNLSRFPKVYVKFSSLFQVSREKFPYLDLAPLFSQVVSHFGANRVMWGSDFPFVVAECGYKGAKEAVHLIASEISLPLSDLEWIMGRTATQLFQNQLTPVNS

SEQ ID NO: 41030 - protein, 405 aa, Rickettsiella grylli
MKNNEITAMISALMPIYPHRLPVAFEKGSGIWLTDTQGACYLDALSGIAVCGLGHAHPAITETICNQATKLIHTSNTYHIPEQERLASALSRVSGMDQVFFANSGAESNEAAIKMTRLYARQKGIEQPIIIAMNNAFHGRTMATLSVSGSERLQIGFEPLLTRFIHIPFNDETALKNTIKKYKKNIIAIMLEPIQGDGGIKIATPRFLRAIRDYCDHYDFLMILDEIQTGLCRTGPWFAYQAYNIFPDILTIAKTLGNGFPISAYCSRGKANNLFPSGKHGSTFAGSPLACAVALTVIKILEKENISAHVTEIGDYLIRKLNDCLGQHPHVVAIKGQGLMIGVELDTECHHIPKIGLKHRLLFNIVSNHTIRILPPLILQKKEADEICHRLMKSIDEFYNLPSRL

SEQ ID NO: 41031 - protein, 304 aa, Oryza sativa (indica cultivar-group)
MEGQGAPAAPGGKGSAIVVVNSHLHVWASPQQTAERYPYFTGQEPPIRGDVDLLLQCMDEAGVDGALIVQPINHMFDHSLVTSVLKKYPSKFIGCCLANPADDGSGIKQLEHLIVQEKYRAVRFNPNLWPSGQKMTNEVGRSLFAKAGELGAPVGIMVMKGISTYIQEIEELCTDYPKTTVIFDHMAFCKPPMNIEEEKAFTSFLELSRFPQIYVKYSALFRISREAYPYEDTSQLLSRVISSYGANRIMWGSDFPFVVPECGYKGAKEAISHVAGKIPVSSSDLEWILGKTVTQLFQGAWVSA

SEQ ID NO: 41032 - protein, 319 aa, Bacillus cereus ATCC 14579
MKRIGVLTSGGDSPGMNAAIRAVVRKAIFHDIEVYGIYHGYAGLISGHIEKLELGSVGDIIPRGGTKLYTARCLEFKDPEVRLKGIEQLKKHGIEGLVVIGGDGSYQGAKKLTEQGFPCVGVPGTIDNDIPGTDFTIGFDTALNTVIDAIDKIRDTATSHERTYVIEVMGRHAGDIALWAGLADGAETILIPEEEYDMDDVIARLKRGSERGKKHSIIVVAEGVGSAIDIGKHIEEATNFDTRVTVLGHVQRGGSPSAQDRVLASRLGARAVELLIAGKGGRCVGIQDNKLVDHDIIEALAQKHTIDKDMYQLSKELSI

SEQ ID NO: 41033 - protein, 471 aa, Hyphomonas neptunium ATCC 15444
MSTQYDLIVIGSGPGGYVAAIRASQLGMKTAIVERESLGGICLNWGCIPTKALLRSAEVLHLAKHAKSFGLKIEKPEFDLEAIVKRSRGIAAQLSGGVKFLMKKNKIDVIEGAARLEKGAPAPKVIVKGKDGKDTPYTAKHVMLATGARARDIPQAGLKADGKLVWTYREAMTPDVMPKRLLVIGSGAIGIEFASFYNELGSDVTVAEVMDRILPVEDAEISGLAEKDFKKQGLNILTGAKVENVKPGKNTVTADITTKDGKKETKEFDRVILAVGIVGNVENLGLETLGVKVEKTHVVVDGFGRTGVPGLYAIGDLTGPPWLAHKASHEGVMCVEGIHGKNHAEPFDASNIPGCTYSHPQIASVGLTEAAAKEKGYDIKVGRFPFLGNGKAIALGAENGLVKTIFDKKTGELLGAHMIGAEVTELIQGYVIARQGELTEADLIHTVFPHPTLSETMHEAVLDAEGRVLHI

SEQ ID NO: 41034 - protein, 636 aa, Triticum aestivum
MSAAVGGAEFHGFGGAAQLPRSRMLGRPVRVAPPGATPAGGGGPSAASIRAVSTPLKKDAKEVKRSKVEIIKEKSNFLRYPLNEELVSEAPNVNETAVQLIKFHGSYQQSDREVRGQKNYSFMLRTKNPSGKVPNQTYLAMDTLADEFGIGTLRLTTRQTFQLHGVLKKNLKHVISTVIKNMGSTLGACGDLNRNVLAPAAPYARKDILFAQETAENIAALLAPQSGAYYDLWVDGEKIMSAEEPPEVTKARNDNSHGTNFPDSPEPIYGTQYLPRKFKIAVTVAGDNSVDILTNDIGVVVVSDSAGEPVGFNLYVGGGMGRTHRIETTFPRLADPLGYVPKEDILYAIKAIVVTQRENGRRDDRRYSRMKYLLDSWGIDKFRAEVEKYYGKKFEDFHPLPEWQFNSYLGWQEQGDGKLFYGVHVDNGRLGGQAKKTLREIIEKYSLDVSITPNQNLILCGVDQAWREPITAALAQAGLLEPKDVDLLNITSMACPALPLCPLAQTEAERGILPILKRIRAVFDKVGIKDEESVVVRITGCPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 41035 - protein, 412 aa, Bacillus cereus ATCC 14579
MSTLREEALHMHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYDGRPTGMNPVKDEVAKYTNKNRIEGSLADVVQGADVFIGVSAEGALTEEMVRTMNDDAIIFAMANPVPEIMPELAKAAGAAVVGTGRSDFPNQVNNVLAFPGIFRGALDVHATQINEEMKMAAVQAIAELVAEDELNADYIIPAPFDARVAPQVAAYVAKAAMETGVARRQVDPNEIAEKTKQLALIGKE

SEQ ID NO: 41036 - protein, 199 aa, Rickettsiella grylli
MSSSAFPLTLFLKSVAQLDQLPPDKGAEIAFIGRSNSGKSSAINAITGKKGLAKISKTPGRTQLLNFFQLNENLRLVDLPGYGFAKVSDNRKIDWEKTITHYLKMRKSLKGLIMTMDIRHPLNDRDEVLLAFVSHYHIPTYILLTKADKLTRAQAIHTLRSIRQQLTILNKTCELQIFSAIQSIGLGNARHKILDWLSK

SEQ ID NO: 41037 - protein, 369 aa, Synechocystis sp. PCC 6803
MKSRAAVAFEVGKPLQIVEIDVAPPQQGEVLVKITHTGVCHTDAFTLSGDDPEGLFPVVLGHEGAGIVVEVGEGVTSVQLGDHVIPLYTAECGKCLFCRSGKTNLCVAVRATQGKGVMPDGTSRFSYNGQSLYHYMGCSTFSEYTVVAEVSLAKINPEANHEHVCLLGCGVTTGIGAVHNTAKVQPGDSVAVFGLGGIGLAVVQGARQAKAGRIIAIDTNPAKFELAKQMGATDCINPKDHDQPIQQVIVEMTGWGVDHSFECIGNVEVMRSALECAHRGWGQSVIIGVAGAGQEISTRPFQLVTGRKWMGTAFGGVKGRSQLPGMVEQSMRGEIQLAPFVTHTMELKDINQAFDLMHDGKSIRSVIHY

SEQ ID NO: 41038 - protein, 1051 aa, Gibberella zeae PH-1
MNLVEKATSLRVNKHKHVGTSKKFIQPSVGPIVSEDRGHKIPTNATICSSFDQVGESVLDSNWLRPSHRIAYARSTTFNTPLIPLAVFARIIPRVCIDSSTRLFASRQYLGQTSTPRSKLGLWAIASDVLMEDDEYTTSKMEEIKLEEGANDAQVKQETNTPMSITNGDHESSRSPTASQDGLKSRSESADTPSSNRPSKLSRKASQKLAASREPVLFDHLPDMTTESCKFFQRIPDCLYGSKHLGSTDNDALDCECRDEWHDGKNLACGEDSDCINRATKMECSAEGGNCAGGCQNQRFQRKQYANVSVIKTEKKGFGLRADSDLQPNDFVFEYIGEVINEPTFRRRMIQYDEEGIKHFYFMSLNKSEFVDATKKGNYGRFCNHSCNPNCYVDKWVVGDKLRMGIFTSRKIQSGEELVFNYNVDRYGADPQPCYCGEPNCVGFIGGKTQTERATKLPAATVEALGIDGGDGWDTSVAKKPRKKKPDEDDEEYVNSIRPRSLSEDDARKVMAALMQCKEKWIAVKLLDRIMQCDEERVIHCVMRMHAYQILKTTLNTFIDDHNVVLQVLDILDKFPRLTRNKVQDSKIEATIEGLTQSEHEDVASKSKHLLNEWSKLEVAYRIRRRKFDPNAPAANSFEERRGAGREEETVQSTSKTASPTPIDAPKGPRNSMPQRNNAFFQNGGRSRRPPFNASLPQGWFTAKDAAGNTYFYTKQGATTWQRPTQPATEPAAKAPSKAMKEQLAIQSIINQVTEKGTPKHTSVSTPKAAETPPKEVKEEKWRSLPVDKRMKIYENTLFPHIKHVLDKFHHKLPKEELKRFGKDIAKKLVASDFKNNRVEDPGAPLSDKQVKKIKQYVKDFLDRAVKKYGEHKRKADEDADTQMKDDQGPSAAGSGAGSVVDGSDGTALAKVDGTSMGEVDVTAVSDREGTGSLGSPDRKRKRDLDTSGSPYVTSTDGPNMKRLREDELEAPSPPPPPPPPPQSDMDEVVTAEQEALREQEEALMRENEEAQRLEDEASHTKGLEDVLDASNEISRLNKEARKPGSQKMPA

SEQ ID NO: 41039 - protein, 654 aa, Spiroplasma citri
MKKSIDTIKMLGIEAINKANSGHPGIVLGAAPMAYTLFTRHLVVNPQVDKWINRDRFVLAAGHGSALLYSLLHLSGFDLNIDDLRNFRQVDSITPGHPESHLTPGVDVATGPLGQGLAAAVGLALAETHLAARYNTKKYPLYDHYTYVLCGDGDLQEGVTQEAISLAGHWKLNKLIVLFDSNDVQLDNMVNVAQSENIADRFKAANWNYLFVKDGNDIEAIDQAIIKAKKSNKPTLIEVKTIIGDGTTKQGTPAVHGAPLGSDIETVRKMLEWNYKPFEVPSEVYKDFEVNVKQRGIKKYQQWLKMYQGLCKENPALAKELDDAVYGNFNFNPQDFRDLKPIKPQATRISSGAILDRLSNIIPGLIGGSADLSGSTKAKGADGVYSAENRLGRNLAYGVREFAMAAINNGICLHRGLIPFASGFFVFADYMKPAIRLSSLMEIPAIYILSHDSIAVGEDGPTHQPIEQLAMLRSQPNLNVFRPADFNETLGAYHMALQSKHTPSVILITRQDLPKLEHSNVELVKKGAYQVYGQEDNNHVVLLATGSEVSMAIAVAKKLEHDKKIKVKVVSMPCWELFEQQDAKYKQRLLEPLALIASIELGTTFGWERYTSNSGLNFGINTFGQSGPFQDVLEYFSFNVEKIVNVINKKMQVL

SEQ ID NO: 41040 - protein, 337 aa, Arabidopsis thaliana
MVAVERVESLAKSGIISIPKEYIRPKEELESINDVFLEEKKEDGPQVPTIDLKNIESDDEKIRENCIEELKKASLDWGVMHLINHGIPADLMERVKKAGEEFFSLSVEEKEKYANDQATGKIQGYGSKLANNASGQLEWEDYFFHLAYPEEKRDLSIWPKTPSDYIEATSEYAKCLRLLATKVFKALSVGLGLEPDRLEKEVGGLEELLLQMKINYYPKCPQPELALGVEAHTDVSALTFILHNMVPGLQLFYEGKWVTAKCVPDSIVMHIGDTLEILSNGKYKSILHRGLVNKEKVRISWAVFCEPPKDKIVLKPLPEMVSVESPAKFPPRTCSTY

SEQ ID NO: 41041 - protein, 820 aa, Ashbya gossypii ATCC 10895
MKYYSKKGHREQAEAMGVPPDVNNPPFYIPLKPVEGRYKLIQELGNGSFGSVTLAKAQFEISQINGKEGTLMDQSIIPTIREENWNNKNKGLVAIKTMMTRLPTLNDYTRVREIKFILQIPAHAHLVQIYELFIDDSLYQLHIVMECMEQNIYQLMKCRKRRVFSLPTLRSILSQILSGIRHIHAHNFYHRDIKPENILISPANRYYSKEWISAGHYPDNYVVKIADYGLARHVTNKSPYTAYVSTRWYRSPEILLRQGSYSRPLDIWAFGCVAVEVATFKPLFPGADEMDQIWKILELLGTPHPCHESKISGYVPHGGAWLQAEHLASRLNLKFPYVEGKDISWVMCNPQLESLCDVVRACLVWNPDDRATVEDLSQMPYFAGTIVQETKQPPLSTAQSALMFAGLLPSSGLQHRRLIFNDNANNHNSNNSNGSNNATTTTTTTMTTNMTAATTKKTTRTGGPVNRKRETNDENDVESLAHPIPIKRTLANLLSFNKEEPQLSFREFLKETSADKAKPNASNSNSGNCAANQLGHSNHNINNYLNRNNNSGTQHGPSYNNYGQNLNQQSGSSNHSGNGRNPTNNTHAVNTAITQTNTNKTNPTNNNTNNNNNTPTPTTTTTTTTTTPTPATTTTTITNHNGQHDDNDNDKSNFRNVGDGRAASDSTLSGPEELTKEISANIELYQEPPPLAEEQPLYDDIFGTTENIELDEDGDDDDPEDEDVSFILMYKNAVNQGGAGATQRENIEPLARNYIHESTHQNCHAIDEMSIDDASTDSHSQIPRDFIMEPTTIPQHDILPPAQVRHEPTPNHSFEDGLSF

SEQ ID NO: 41042 - protein, 801 aa, Staphylococcus aureus subsp. aureus COL
MAKQKLVMIGNGMAGIRTIEEILERANDLYDITVIGKEPYPNYNRIMLSNILQNKMTVEETIMNPYEWYEEHGIELITNDPVIEVDRANQSVTTANGIEVSYDKLIFATGSKAFVIPVPGSTLPSVIGWRTIDDTEQMMNIAKTKKKAIVIGGGLLGLECARGLLDQGMEVTVLHLAEWLMEMQLDRKAGNMLKADLEKQGMKFEMQANTTEILGEDDVEGVKLADGREIPADLVVMAVGIRPYTEVAKESGLDVNRGIVVNDVMQTSDSNVYAVGECAEHNGKVYGLVAPLYEQGKVLADHLTNKETNGYKGSTTFTSLKVSGCDLYSAGQIVENAEIKGIEIFNSVDNNYKKIFLKDGNVVGAVLYGDIDDGSRFYNMMKKGESTEDYTLVSLLTKGGEEASLSIADMADDETICGCNGVDKGTIVNAITENGFTTVEEVTAKTKAGNSCGKCKPQIAQILQHTLGDDFVAAKPAGICGCTDLTRDQIVTQIRAKGLKTSKEVRHVLNFKNKGGCPKCRPAINYYLNMVYPHDHEDERESRFANERYHANIQNDGTFSVIPQMRGGVTDADQLIRLGEVAKKYHVPLVKVTGSQRVGLYGVKKEELPNIWEDLGMRSASAYGKKTRSVKSCVGKEFCRFGTQYTTRLGIRLEKTFEYIDTPHKFKMGVSGCPRSCVESGVKDFGIISVENGFQIYIGGNGGTEVEKAEFLTTVETEDEVIKLCGALMQYYRETGIYAERTAPWLRRLGFENVKEVLLDPERQNELFERIMDAKKAVEAEPWEAITSNAQARRIFEVEKV

SEQ ID NO: 41043 - protein, 325 aa, Arabidopsis thaliana
MVAVERVESLAKSGIISIPKEYIRPKEELESINDVFLEEKKEDGPQVPTIDLKNIESDDEKIRENCIEELKKASLDWGVMHLINHGIPADLMERVKKAGEEFFSLSVEEKEKYANDQATGKIQGYGSKLANNASGQLEWEDYFFHLAYPEEKRDLSIWPKTPSDYIEATSEYAKCLRLLATKVFKALSVGLGLEPDRLEKEVGGLEELLLQMKINYYPKCPQPELALGVEAHTDVSALTFILHNMVPGLQLFYEGKWVTAKCVPDSIVMHIGDTLEILSNGKYKSILHRGLVNKEKVRISWAVFCEPPKDKIVLKPLPEMVSVSG

SEQ ID NO: 41044 - protein, 430 aa, Rubrobacter xylanophilus DSM 9941
MTEIVAVRGREILDSRGNPTLEVEVVTAAGFVGRAAVPSGASTGQNEAVELRDGEGGRYGGKGVLRAVANVEGELAEAVVGMDVTDQRALDLAMIEADGTENKGRLGANAMLGVSLAAARAAAEYAGLPLYRYLGGPGAHVLPVPCANILNGGAHAANNVDFQEFMVVPVGFESYREALRAVAEIYAALKKLLAERGLAGGIGDEGGFAPDLSSNGEALGLLSEAVERSGYSLGEQVCFALDPAASEFYEGGRYELSGEGRSLERGEMVDYYVRLCGEYPIISIEDGLAEDDWEGWEMISARLGGRVQLVGDDLFVTNPKILRKGIERGIANSILVKVNQIGTLTETFETMDLAHKSGYTAMVSHRSGETDDTTIADLAVAVNAGQIKTGAPARGERVAKYNQLLRIEESLGEAAVYPGLGAFNPRMREG

SEQ ID NO: 41045 - protein, 191 aa, Brassica napus
  misc_feature (161)..(161): Xaa can be any naturally occurring amino acid
  unsure (1)..(191): unsure at all Xaa locations
MGKKRKATETSLDEVDRTVYASFRTAANSLSQLYTQSMNHQKLSFQAGERHGLEKLYQWIWRQQEGGSRVTPVDIINYIQNELECCTEEPPISPRAPPPQPTMHVTNSGLIASSGTSCPTAVPAVRSEQCENQAKNSVFSNALSSPVRRSLQNYQVPQGGXYISGGTRSSELNRGSNSPGSFDSSMDMHAE

SEQ ID NO: 41046 - protein, 419 aa, Thermoplasma acidophilum DSM 1728
MTYMPENMDPFEMALQQLEKAAAVLKLDEQALEILKQPEKILQVSIPVRMDNGRIKVFTGFRVRYNTARGPGKGGIRYHTEETLSTVKALAAWMTWKCAIVDIPFGGAKGGVICDPKSMSQGELERLSRGYIRAIADFIGPEVDVPAPDVYTNPQIMAWMMDEYENVVRHSAPNVITGKPLEVGGSEGRGDATAKGGMYVLREGAKRIGLDLSKARVAVQGFGNAGQFAVKFVHEMFGSKVVAVSDTKGGIYVKDGIDYAALLEHKKKTGSVVGFPGSEPITNEELLESDVDVLIPAAIEEQITGKNADRIRAKIVLELANGPTTPEADEILYKRGILDLPDFLSNSGGVTVSYFEWVQNNYGEYWTADDVYKKLDQKMTKAAHDVFDAMDKYKVNPRTAAYVVSVKKVADAMKARGMY

SEQ ID NO: 41047 - protein, 90 aa, Glycine max
  misc_feature (25)..(25): Xaa can be any naturally occurring amino acid
  unsure (1)..(90): unsure at all Xaa locations
SLTRLPLNELTDRTPLNVTTGVFTXASTLIHCSSPENFAMLNRYGDTTESHINANPKASYLEVDRTILTPGSLKSVDHHSDHPNPLSIFE

SEQ ID NO: 41048 - protein, 874 aa, Gibberella zeae PH-1
MADNEKRLSSSETHEIPLEPLPPTQLPIAGDSASEYDESFSYDQDDMRDYHTTEQDLHVTEDDLLEARELASKYTLEDVRHIMARVYRIHEKDPNFPHTVIQKIKAFLENDELFTNPEKHENLVQEMKLEAALITNNSPYAEVRAVVENKDDTSIPSSTIRSWAIGLIFSMLLAFTNQLFDIRQPAIRIMANVAQLLSYPIGKGCERWLPDYGITLFGVRHSLNPGPFSKKEHMLITIMANVAYNTPYTNLIIWVQYLPQYFNQPYASHFAYQILIALSTNFIGYGMAGVCRRFLVYPSYCVWPASLVTIALNSAFHTDNNSPVQGPFAKIWRVSRIKFFYVMFGAMFVWFWFPNYIWTSLSNFSWMSWIDPYNRDLNTITGFNNGLGINPFPTWDWNVLLWDSADPLMVPFFSTFNRFVGAFISMWVVLGLWYSNIYNTGYLPINSNRVYDRWGQLYNVTRAINDRGLFDAKKYEDYSPPFLGAGNVVIYIFFFGIYTSTLTYALLFHRREIVTGFKGLFNSMRKKSKRAEEVHDLDVHTRLMKAYREVPEWWYLVCLLCAMAFGVSGIAGWDTHTSPGVIFYGLALCLVFVIPVGIIKAMTGIEVTLTVLAEFIGGSFVEGNALAMNYFKSFGYVTCAHAVMFSNDLKLAHYVKIPPRHTFFAQIIATFISTFVCVGVLNFQMTQIDGVCTEDARWKMTCPSVNTFFTASVLWGTVGPSKIFGKNGLYTEVLIGFPLGVVVVLVVWAINKRFPHWTWTRQIHPVAIMYGGIVWAPYNMSYVWPSVPIAYFSWIYLKSRYLGLWSKYNFVLSAAWSCGIAIAGIIIFFSLQLEGTEFKWWGNTVGYTGCEDDACPLQPLDGSDYFGPRVGEFH

SEQ ID NO: 41049 - protein, 567 aa, Hordeum vulgare
MASPALISDTDQWKALQAHVGAIHKTHLRDLMADADRCKAMTAEFEGVFLDYARQQATTETVDKLFKLAEAAKLKEKIDKMFKGEKINSTENRSVLHVALRAPRDAVINSDGLNVVPEVWAVKDKIKQFSETFRSGSWVGATGKPLTNVVSVGIGGSFLGPLFVHTALQTDPEAAECAKGRQLRFLANVDPVDVARSIKDLDPATTLVVVVSKTFTTAETMLNARTIKEWIVSSLGPDAVSKHMIAVSTNLKLVKEFGIDPNNAFAFWDWVGGRYSVCSAVGVLPLSLQYGFPIVQKFLEGASSIDNHFHTSSFEKNIPVLLGLLSVWNVSFLGYPARAILPYSQALEKLAPHIQQLSMESNGKGVSIDGVRLPYEAGEIDFGEPGTNGQHSFYQLIHQGRVIPCDFIGVIKSQQPVYLKGETVSNHDELMSNFFAQPDALAYGKTPEQLHSEKVPENLIPHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 41050 - protein, 334 aa, Zea mays
SARDLKCFLSADPQALSTVCAELSEACKKHGFFLVVNHGVDSKLIAQAHKLIDDFFCMQLSQKQKAQRKIGEHCGYANSFIGRFSSKLPWKETLSFHYSADKSRKTVEDYFLNVMGEDFKQFGSVFQEYCEAMSKLSLGIMELLGMSLGVGRECFRDFFEGNESVMRLNYYPPCQKPELALGTGPHCDPTSLTILHQDQVEGLQVFVDGRWYSVAPKEDAFVVNIGDTFMALSNGMFKSCLHRAVVNNKIVRKSLAFFLCPNRDKVVTPPKDLISYENSRTYPDFTWPSLLEFTQKHYRSDTKTLDAFSRWLLEKNNPNRGAPTNVPWPTKSIN

SEQ ID NO: 41051 - protein, 512 aa, Triticum aestivum
  misc_feature (30)..(30): Xaa can be any naturally occurring amino acid
  misc_feature (198)..(198): Xaa can be any naturally occurring amino acid
  misc_feature (200)..(200): Xaa can be any naturally occurring amino acid
  misc_feature (271)..(271): Xaa can be any naturally occurring amino acid
  misc_feature (368)..(368): Xaa can be any naturally occurring amino acid
  misc_feature (402)..(402): Xaa can be any naturally occurring amino acid
  unsure (1)..(512): unsure at all Xaa locations
MAELLRAADFFDLRAAAPFVAAAVALYFLXEQLSYLRKKGPLPGPSLVVPFLGSAVRMIRDPTGFWDVQAARARESGAGLAADFLFGRFIVFIRDSELSHRVFANVRPDAFHLIGHPFGKKLFGDHNLIYMFGEDHKDLRRRITPNFTPRALSTYAAIQQRVILAHLRRWLDQSAATGEAMPIRVPCRDMNLETSQTXFXGSYLTEKARERFAKDYALFNLGLMTVPVDLPGFAFRRARLAVARLVRTLGECARKSKARMPRPAASPECLXDYWMQETLREMDEAAAAGRPPLAHTDDEEFGGFLFDFLFAAQDASTSSLCWAVSALDSHPDVLARVRAEVATVWSPESGKPITAEKIQAMKYTQAVXAREVVRYRPPATLVTHVAGEPFQLTEWYTVPKGXIVFPSVYESSFQGFTSPDAFDPERFFSEARREDVACKRNFLAFGAGAHQCVGQRYALNHLVLFLALFVTVADFRRDRTAGCDEPVYMPTIVPRDGCAVYMEQRCDTFPSF

SEQ ID NO: 41052 - protein, 323 aa, Rickettsiella grylli
MNTKKFSDSARNVIEIEANAILNLLPQLDSKFERACELFLNCQGHIVVIGIGKSGHIGNKIAATLASTGSPAFFIHAAEANHGDLGMINSKDVVLAISHSGETDELISILPTLKFLNIPFILMTGNPNSTLAQQATVTLHIPIEQEACSLGLAPTSSSTATLVMGDAIAIALLNRRGFSSNDFAKVHPRGHLGRRLLLKVADIMHTGPALPNVRSGTPLIQTLFEISQKRLGMTIITDENQRLLGIFTDGDLRRAIDQGLNLQTTLVDHVMTAHCKTINKDKLATEALHLMETSKITTLIIADKEKKPLGVVHIHDILSRKIT

SEQ ID NO: 41053 - protein, 440 aa, Polaromonas sp. JS666
MQRIVIVGGGAGGLALATQLGKRLGKKGLAEITLVDAARTHVWKPLLHQLAAGSFDTHAEEIEYLAQARWNHFKFRLGSLVGIDRHSKTLQLAASHDAAGREITPAQQLGYDTLVIAVGSQTNDFGTLGAAEHTIKLDSPQAAQHFNDRLINAFIRAQTVPRTAGSGRLTVAIVGGGATGVELAAELHAAARVLANYGFDHIHPEKDLQIVLVEAAPRLLAQLPERLSESALRELRKLAIEVHTNEKVVEVTADGLKMASGKVVPSSITVWAAGVKAADFLKTIGAGPDGAEPLETSRLNQLIVNGNLQTTRDPSIYAFGDCAACQQPDGTWVPPRAQAAYQQAMYLARALPLLGAGKTVRPFVFRDQGSLVSLAEYSSVGSLMGSLSHGSFFIEGQLAKLMYWALHKQHQLALGGLKKTLLITLSEMIDRTHRPRIKLH

SEQ ID NO: 41054 - protein, 262 aa, Oryza sativa (indica cultivar-group)
MHSGRLMHTASTFSWILWSFNFPASVSLICNSASRQMCSIRSFAFVLVLAFSVAVAESRDSFNVLAHKSFPLENKKTGLTSANGKLCQLCEQYSTEALFYLQQNETQTEILSILHHACANVGPLKQQCITLVDYYIPLFFLEVSVVTPEKFCESVHLCRKGTMLRLPSRGDTCGICHHVLVEVLIMLKDPDMQLEIVEIFLKACSKADNYVQQCKKMVLEYTPLILVKSQKFLETTDVCSTIHACKTGTQASAETMLLSAAS

SEQ ID NO: 41055 - protein, 402 aa, Campylobacter coli RM2228
MDYKKLKDEFQTPFYIYDFDFIKERFLKLKNAFKARKSQIFYAVKANSNLSLLQMLVKLDSGFDCVSIGEVKRALKAGAKSYKIIFSGVGKTQEELRLALEYDILYINLESEAEMMLLESVAKELNLKARISIRVNPNVNAKTHPYISTGLNENKFGVEIDLARKMYLYAKNSPHLEPIGVHFHIGSQLLDISPIHEAAAIVAKLVRELKALQIELKFFDIGGGLGVRYEKEDVEPDLYDYAQGILAQLHGLDVTIGMEPGRFLVANSGEFVCSVLYEKHNKTKRFVIVDGAMNDLIRPSLYEAYHEILLPYNQGEESPCDVVGGICESGDFFAKARSLPSTQSGDIMVIKNTGAYGFSMSSNYNTRNKVCELALEEGQVRLIRQRENFEDQIALEEKFLKA

SEQ ID NO: 41056 - protein, 241 aa, Synechococcus sp. WH 7805
MLVDGMEEYWWSARRAALSLCQGAVLPETIPDGFRALRPWIHHGWEMVLIASVFSESHRAPMQADVDWMIHDYSAFCSEGLTRFGWTPSLLQERLEQVRREAVLADRPGWLAMHRPYPGVRERLASLVEEGVSWAVLTTKGKAFTAELLASMDLTPARLDGRESGPKPEVLRSLSRDWRLLGFVEDRRATLETVRRTAGLEGLPCWLASWGYLKPDDPAALPDGVALLSPECFARPLANWN

SEQ ID NO: 41057 - protein, 485 aa, Oryza sativa (japonica cultivar-group)
MERDAWLLCAALAAATVVYYLACTTSRRAQRRRLPPGPTPLPVIGNVLSLRGNMHHALARLARERYGPVMALKLGLVTAVVVSSPDAAREAFTKHDRRLAARAVPDTSRVRGFADRHVFSPGSIAAARGFRERKVRDIVGYFAAHVGEVVDVGEAVYSGVVNLVSNAFFSGDVVDVGEESAHGLREAVEDIILAIAKPNVSDLFPFLRPLDLQGWRRWAEKRYDTVFDILDNITNSRLADASAGNHAGDFLDSLLGLMSYGKIARDDVTTIMFDVFGAGTDTIAITVQWAMAELLRNPSIMAKARTEMEDVLAGKKTIEENDTEKLPYLRAVIKEAMRLHPVAPILLPHQAAEDGVEIGGYAVPKGSTVIFNVWAIMRDPTAWERPDEFMPERFLQRAEVDFRGKDFEFMPFGAGRRLCPGLPMAERVVPFILASLLHAFEWRLPDGMSAEELDVSEKFTTANVLTVPLKAVPILASSASELQAS

SEQ ID NO: 41058 - protein, 139 aa, marine gamma proteobacterium HTCC2143
MRNIYFQSIEQLKTGQALALRDIVDELIFNHQALIPVITQNADSKEVLMMAWMNKACLEQTLVTGLMTYWSRSRQEVWIKGETSGNYQRLESMRFDCDGDAVLCLVKQTGAACHTGRQHCFYLEASQSRQSVSMLSAAP

SEQ ID NO: 41059 - protein, 248 aa, Porphyromonas gingivalis W83
MKRIVLIRHGESLWNKENRFTGWTDVDLSEKGIEEAKKAGELMKKEGFQFTKAYTSYLKRAVKTLNGVLDVMDLDWIPVEKTWRLNEKHYGMLQGLNKAETAEKYGDEQVLIWRRSYDVPPTPMEKEDPRSPFMDPRYKGVCEKDLPLTEALCDTVNRILPYWNETIFPTLKEHDEVLVAAHGNSLRGIIKVLKNISDEDIISLNLPTAVPYVFEFDDNLRLVKDYFLGDPEEIKKLMEAVANQGKKK

SEQ ID NO: 41060 - protein, 379 aa, Triticum aestivum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMIGDGQSRFTIDGKPIFHFVGTSTFSEYTVIHVGCLAKIDPEAPLDKVCLLSCGISTGLGATLNVAKPKKGMTVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTDLPGVVDMYMRKELELDKFITHSVPFSQINTAFDLMLKGEGLRCVIRMDE

SEQ ID NO: 41061 - protein, 281 aa, Zea mays
  misc_feature (69)..(69): Xaa can be any naturally occurring amino acid
  unsure (1)..(281): unsure at all Xaa locations
GSSTSPFLEARLVKIDHTGRVLQFFEKPKGADLNSMRVETNFLSYAIDDAQKYPYLASMGIFLEDINAXDALLDLLKSKYIQLHDFGSEILPRAVLDHSVQACIFTGYWEDVGTIKSFFDANLALTEQPSKFDFYDPKTPFFTAPRCLPPTQLDKCKMKDAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 41062 - protein, 541 aa, Prochlorococcus marinus str. MIT 9211
MPQIPSSSNIKKPGGVAPVVLAILDGWGHSEKFEDNAIKNADTPIMDALWQAYPHTLIEASGADVGLPDRQMGNSEVGHLTIGAGRIIQQELVRITNTVRSNKLFEIDALKDLAELLKANKKTLHIIGLCSDGGVHSHINHLCGLLDWSSNQGIQKVAVHAFTDGRDTPAQSAKKYLEIITEKLNSSDIGELTSLCGRYWAMDRDNRWERTSKAYELLTNPNFPICDSSPEELIANSYQEGVTDEFLEPVRFKRSYIENGDGVIMFNFRPDRARQLIKAISLPDFDQFAREYTPKPNVLTFTQYEANLPVSVAFPPESLEDLLGEVISKHGLLQYRTAETEKYPHVTYFLNGGIEKPLPGEHRHLVPSPRVATYDMTPAMSADILTESCLKAIESGLYSLIVINYANPDMVGHTGVMEAAKEAINKVDTCIGRILDSTGKMSGTLLITADHGNAEVMKGADGQPWTAHTTNPVPVIIIEGEKRKLSGEGNSIQLRQGGGLADIAPTVLQLLSLPKPKVMTGSSLIENIETPTIPSRVTQTA

SEQ ID NO: 41063 - protein, 482 aa, Gibberella zeae PH-1
MPPPQLRGFGGGPAVAAPYHQGGFPSHGQPQGGMPGANQYMNANAQLGPFSANGNAFTSGLNSLNTQGFADTGFGSQSARMGFHGPAAALQQSQHGLHQNMLMEHPTIRSQPNKGRIREVWKHNLHEEMAVLRDLVDKYPYIAMDTEFPGVVSRPMGGFRGKSDYHYQCLRTNVDMLKVIQIGLTFFNEDGETPPARPTNDLKLGTAAQKAATNAPFPCSWQFNFKFSITDDMYNEKSIESLQQAGINFELLDRDGIDPHEFASLLIPSGLVCFDNVRWISFHGGYDFGYLTKLLICLPLPNDEVDFDHKMKLYFPTTYDVKHLMKHAIRLHNSGLLTPSDPSSAEILQKFEHKSGLENIAETLKIKRVGSAHQAGSDSLLTGKVFFSMRDKIFAGDIPDEHVGKVWGLGFPDSNSNIISMNQQNNNDGQTNGNAPSTPNTTSVGLATTPGPQGHNGILNTGPMTPGGGGGVFGSFAFGGNR

SEQ ID NO: 41064 - protein, 440 aa, Colwellia psychrerythraea 34H
MSKKNKPNSNAMFTRAIDNMPLGVADSYRYWGEENTVFLSSMKGCTITDCDEQTFVDFRLAYGPIILGYRDERIDNEVISAITTVGTISGFSTGLDSDVVELVKSLCPNIDKMRFSNSGTEAVIGAVRTARGFTKRNKIVVVEGGFHGLHDEVMWKSDVDNWDVNTQQVPDIVPFGGGIPQSTREHQVSVPLNDFDAIDAVFTQYGDDIAAILIEPIMGNCGSIASTQAYMQKLRDVCDNNGSLLIMDEVKTGFRVAKGGAQALYGIFADLTTYAKAMGNGYPVAAFGGRAEVMDTISFAKDGVTHGGTYTANMVALSAAKATLTVLKETDALETIANVGQKIQALLSRVFTKFGVEHCFAGPDAMFGVHFGSKVPQNYRDWKQTNSDLYTQFALNLIENGVMLEPDSREPWFICEAHQTVDLNWLEQVAEQSMAAAINE

SEQ ID NO: 41065 - protein, 649 aa, Triticum aestivum
  misc_feature (637)..(637): Xaa can be any naturally occurring amino acid
  unsure (1)..(649): unsure at all Xaa locations
MNSSMDEINLLRQHQRHQQHHLSVRGIGEEIDLEIDQCEDPTFSGAALEGVTSHHPQDPVVPADDHKSFLIPCSQPGAVDGQPQPTPPQAEERAGMLRLSAHTKKKKKVVKKWRDEWADTYKWAYVAVHDNTSRIFCTVCNARGRKHRRNPYGNEGSRNMQMSALEEHNNSLLHREALRLQSASKEKVQTPEKERLVYVKALSKTAASILESLFKKDPYEAEFIQSIQEVVHSIEPVLVKNSQYVQILERLLEPERCFIFRVPWVDDRGEAHVNRGFRVQFSQALGPCRGGLRFHPSMNLSVAKFLAFEQTLKNALSLYKLGGAAGGSDFDPKGKSEIEVMRFCQSFMDELYRYLGPDQDFPAEDVGVGPREMGFLFGQYRRLSGHFQGNFTGPKIFWSGSSFRTEATGYGLVFFARVVLADMNKELKGLRCAISGSGKIAMHVLEKLLSCEAIPVTVSDSEGYLFDGDGFDYVKYTLIRNIKAQQRSLKEYLKTFPRAKYINDAKPWGEQCDIAFPCASQNEIDQGEALSIISSGCRVLIECSNMPCTGQAVDILRKAKVHVAPAKATAAGGVAVGELELNPEFSLMQWSVEDFENKIQEAVKQTYDRSMKAAQEYGILKENPESLVHGANISAFXNIAQAMTDQGCV

SEQ ID NO: 41066 - protein, 394 aa, Oryza sativa (indica cultivar-group)
MLIGIGVVKEGVGLIFCVCTKAVSNSDGTPGTSSSPHVVCFGELLIDFVPTVNGVSLAEASAFKKAPGGAPANVAVGIARLGGSSAFIGKPQFELGRNIEKVFQPSSFSFKIKRLFFHYTLFNIQHMQVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 41067 - protein, 88 aa, Prochlorococcus marinus subsp. marinus str. CCMP1375
MTNDPMTTEVSARICNHMNSDHKDTLAKYAIHYGGINSVSTVEMLEITSLWMKLKVDGNDLQIPFDHTLIDSSDAHKTLVSMSKSIPE

SEQ ID NO: 41068 - protein, 1047 aa, Thermoplasma acidophilum DSM 1728
MPRRDDIHRILVIGSGPVVIGQAAEFDYSGSQACLSLREEGYYVVLLNSNPATIQTDHRIADRVYIEPITVEAVERIIEKEKIDAIEPHMGGQTALNLAVKLKNSGILQRYGIKIIGTPVESIELAEDREKFYEFLKAMGEPQPARYRIRRDHIDEDVASIPDIPVIVRTSFSLGGTGGSIVQNRQDLLAMAENLFRASDIDYLEVNESLEGMKEIEYEVIRDSFGNCITVCNMENLDPMGVHTGESIVVTPSQTLSDIEYQMLRDSAIRIISGLGIEGACNIQFALSEGRYYVIEVNPRTSRSSALASKATGYPIARIAAKIAAGYGLHEIKNPITKSTFAAYEPSLDYVTVKIPRWPFDKFSVDRTIGVQMKSIGEVMGIGRTFEEALMKAIASLDNAFSSNIRLHVPDDELWRLIGKPNDRRIFAIFEGLFRNFDVKRMSRLSGYDEYFIEKMRNIVEALRNMDMGRIPENLLRIKRIGIPDEIISAFCGVPADTITKYRIDRNIMPVYKRIDTCSGEFEVAVPYMYSTYEDEDETPDLSGSIMIIGSGPNRIAQGLEFDYGSVKAILALRDMGYRSIMLNSNPETVSTDFDISDALFFEPVTPEYVVNVIRRSGCAGLIVQFSGQTGQNMARRIEEILGKHIVLGTSTESIDRIEDRTVFSRVIEGLGIKQPPFAIAENENDTVRKAMGLGLPIILRSSHVIGGRSMEIIYDVDYLADRAREIFAISKNVLVSKYLENAVEMDVDFVSDGTSYSICGIIVHIEEAGVHSGDATMVYGPGIVPVDIEKKIEGIVGSMVREFRLIGLSNLQIAVRDGDVYVIELNARSSRSVPFISKATGIDWVRLAVECMIGSRIENKRMEAKSYFLKVSVFPFSKFSDMDVVYGPEMKSTGEAMYPGRTLAEALRKSLQRSISSVLITVRDEDKPRIVDIARILLEKGVKLYATAGTSKFLADHGIPTETLYRVRDRREPRILDMISSGSIDMVINTTEMTAGAVRDGFKIRRICIMRGIPLIMNINLARAYAEALGQVEVDYREIGDYLQVS

SEQ ID NO: 41069 - protein, 130 aa, Gibberella zeae PH-1
MVRTSVLSDALKNINNAEKAGKRQVLLRPSCKVVVKFLELMQAQGYIGEFEELSDNRSGKIVVQLNGRLNKCGVISPRFNVRLGELEKWVVRLLPARQFGHIVLTTSSGIMVHESARRKHVSGKIIGFFY

SEQ ID NO: 41070 - protein, 502 aa, Persea americana
MAILVSLLFLAIALTFFLLKLNEKREKKPNLPPSPPNLPIIGNLHQLGNLPHRSLRSLANELGPLILLHLGHIPTLIVSTAEIAEEILKTHDLIFASRPSTTAARRIFYDCTDVAFSPYGEYWRQVRKICVLELLSIKRVNSYRSIREEEVGLMMERISQSCSTGEAVNLSELLLLLSSGTITRVAFGKKYEGEEERKNKFADLATELTTLMGAFFVGDYFPSFAWVDVLTGMDARLKRNHGELDAFVDHVIDDHLLSRKANGSDGVEQKDLVDVLLHLQKDSSLGVHLNRNNLKAVILDMFSGGTDTTAVTLEWAMAELIKHPDVMEKAQQEVRRVVGKKAKVEEEDLHQLHYLKLIIKETLRLHPVAPLLVPRESTRDVVIRGYHIPAKTRVFINAWAIGRDPKSWENAEEFLPERFVNNSVDFKGQDFQLIPFGAGRRGCPGIAFGISSVEISLANLLYWFNWELPGDLTKEDLDMSEAVGITVHMKFPLQLVAKRHLS

SEQ ID NO: 41071 - protein, 546 aa, Synechococcus sp. WH 7805
MSTERITDDLQRLLSLLPASVGRVLEQDDHSDQLLEVVLDLGRLPEARYPGRSLALGERLLERKDLEEMVDRLGQFGADNRAGIERTLHRISAIRNRRGDVVGLTCRVGRAVFGTVAMVRDLLDSDQSLLLMGRPGVGKTTALREIARVLADELQKRVVVIDTSNEIAGDGDIPHPAIGRARRMQVARPELQHQVMIEAVENHMPEVIVIDEIGTELEAQAARTIAERGVMLVATAHGNALTNLIKNPTLCDLVGGIESVTLGDEEARRRRSQKTVLERAAEPTFPIAIEMHSRHRWAVHDDVARTVDLLLRGQSPRPQERELTEHGSVRLVDSGVPNSPRAPQRRPALAVVPLPNPETGSTRDSHRRDEETGGRDRDAETLRVFCCGISRQRLEEAVRCHRWPVQAVDDLSAADVLLSVRQGLGCQPDLRRQAREAEVPILVIKSDSLPQVERALERLLSRRPLAGDQPLLPTSGSELGRADALAALEECRLAVEQVVMPEGRPVELLPRSDVVLQMQADLVARYRLRSDVYGPSDQRRLRVFPP

SEQ ID NO: 41072 - protein, 205 aa, Fucus distichus
MSRNDSPFDMQIKLLMIGDTGVGKTCLLLRYANDSFSQTFITTIGIDFKIKNIDLDSKRIKLQIWDTAGQERFRTITTSYFRGAQGILLVYDVTDKKSFNSIRNWVAQIQQHADVAVNKILIGNKCDMDEDREVSKEEGANLAAEYGIQFFETSAKNDINVEKGFITIAREVKDRLMADGPGGGGGHGRTVDINGQASKKKTGCC

SEQ ID NO: 41073 - protein, 472 aa, Arabidopsis thaliana
MAATLTGSGIALGFSCSAKFSKRASSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHANSFLVKAGSGVATLGLPDSPGVPKAATSDTLTAPYNDIAAVEKLFEANKGEIAAIILEPVVGNSGFITPKPEFIEGIRRITKDNGALLIFDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 41074 - protein, 182 aa, Brassica napus
  misc_feature (126)..(126): Xaa can be any naturally occurring amino acid
  unsure (1)..(182): unsure at all Xaa locations
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWXKLPLFGCTDSAQVLKEVQECKTEYPNAFIRIIGFDNNRQVQCISFIAYKPPSFTGA

SEQ ID NO: 41075 - protein, 165 aa, Brassica napus
  misc_feature (141)..(141): Xaa can be any naturally occurring amino acid
  misc_feature (151)..(152): Xaa can be any naturally occurring amino acid
  misc_feature (160)..(160): Xaa can be any naturally occurring amino acid
  unsure (1)..(165): unsure at all Xaa locations
DHGKRLLAFGKFAGRAGLVDFLHGLGQRYLSQGYSTPFLSLGSSYMYSSLAAAKAAVISVGEEISSQGLPSGICPLVFVFTGTGNVSLGAQEIFKLLPHTFVEPSNLPELFVKDKGMGQTGKSTKRVHQVYGCIITSQDMXVNTQDPSKSXXDKLDYYAXHPEHY

SEQ ID NO: 41076 - protein, 715 aa, Salmonella enterica subsp. enterica serovar Typhi str. CT18
  misc_feature (140)..(140): Xaa can be any naturally occurring amino acid
  unsure (1)..(715): unsure at all Xaa locations
MKKVVTVCPYCASGCKINLVVDNGKIVRAEAAQGKTNQGTLCLKGYYGWDFINDTQILTPRLKTPMIRRQRGGKLESVSWDEALNYVAERLSAIKAKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYSKIVEGYTPESVEEITGVSAQEIRQAARMYASAKSAAILWGMGVTQFYQGVETVRSLTSLAMLTGNLGKPSAGVNPVRGQNNVQGACDMGALPDTYPGYQYVKFPENREKFAKAWGVESLPAHTGYRISELPHRAAHGEVRAAYIMGEDPLQTDAELSAVRKAFEDLELVIVQGIFMTKTASAADVILPSTSWGEHEGVFSAADRGFQRFFKAVEPKWDLKTDWQIISEIATRMGYPMHYNNTQEIWDELRHLCPDFYGATYEKMGELGYIQWPCRDTSDADQGTSYLFKEKFDTPNGLAQFFTCDWVAPIDKLTEEYPMVLSTVREVGHYSCRSMTGNCAALAALADEPGYAQINTADAARLGIEDEALVWVHSRKGKIITRAQVSDRPNKGAIYMTYQWWIGACNELVTENLSPITKTPEYKYCAVRVEPIADQRAAEQYVIDEYNKLKTRLRESAMG

SEQ ID NO: 41077 - protein, 344 aa, Glycine max
MHCEGCARKVRRSLKGFPGVDDVVTDCKSHKVVVKGEKEEAAAAEKPSEEKKPEQESKEEVAAPPPPPPPAEIVLKVFMHCEGCARKVRRSLKGFPGVDDVVTDCKSHKVVVKGEKADPLKVLERIQRKSHRQVELLSPIPKPQEEKKVQEEEKPKPTPEEKKEEAQIVMTVLKVGMHCEACSQEIKRRIQRMKGVESAEPDLQNSQVSVKGVYDPAKLVEYVYKRTGKHAVIMKQEPEKKEKVEEAKEEEMKSDGEGEENKEKKEKEEAKGEEAKAEEPTTPTITEDTNKVVPEVKINEYFYNPPRYGMEVYAYPAHPAHPAYFHSYPPQIFSDENPNACTVM

SEQ ID NO: 41078 - protein, 547 aa, Burkholderia pseudomallei K96243
MFLSPSAAMHDKILILDFGSQVTQLIARRVREAHVYCEIHPNDVSDDFVREFAPKGVILSGSHASTYEDHQLRAPQAVWDLGVPVLGICYGMQTMAVQLGGKVEWSDHREFGYAEVRAHGRTRLLDGIQDFATPEGHGMLKVWMSHGDKVGEMPPGFALMASTPSCPIAGMADEARGYYAVQFHPEVTHTVQGRKLLERFVLDIAGAKPDWIMRDHIEEAVARIREQVGDEEVILGLSGGVDSSVAAALIHRAIGDQLTCVFVDHGLLRLNEGKMVLDMFEGRLHAKVVHVDASEQFLGHLAGVADPEHKRKIIGREFVEVFQAEAKKLTNAKWLAQGTIYPDVIESGGAKTKKATTIKSHHNVGGLPETLGLKLLEPLRDLFKDEVRELGVALGLPAEMVYRHPFPGPGLGVRILGEVKRDYAELLRRADAIFIEELCGTLATEQDAAAGLCEPSQVGKSWYDLTSQAFAVFLPVKSVGVMGDGRTYDYVAALRAVQTTDFMTAHWAHLPYALLGRASNRIINEVRGINRVVYDVSGKPPATIEWE

SEQ ID NO: 41079 - protein, 559 aa, Polaromonas sp. JS666
MPRSITPPATSLWHNLAVSALRFPDKPALVFFDRVLSYAEVLRQAERLAATLHRLGVRKGDRVVLNMQNCPQWVIAHFAILRANAVVVPVNPMNRAEELKHYITDPDARVAITAADLAPELARANAELAPGERLAHLIVTHYSDAFDADAGENGVALPEAWRDWLGSRHALPALEGGSVMHWADALADGDGGSELPAHTATPQDLAVLPYTSGTTGLPKGCMHTHASIMHNAVASILWGNSTFENVTLSVVPMFHITGMVSVLHATIYGGGTLVIMPRWDRELAGRLISHWHVTHWTNIPTMVIDLLGSPNFASFDLSSLVYIGGGGAAMPQAVAQRLWEQYGLRYAEGYGLTETGGPSHSNPYDATRQQCLGVPFVSTDARVIDPETLQEVPQGEQGEIIMCGPQNFQGYWKRPDATAAAFIELDGKRFFRSGDLGRMDEQGYFFLTDRLKRMINASGFKVWPAEVEALMFRHPAIQEACIISSSDAYRGETVKAVVVLRAEARGKTSEDDIIDWCKQNMAAYKYPRIVQFVDALPKSGAGKVMWRILQEAESEGGNG

SEQ ID NO: 41080 - protein, 360 aa, Rickettsia bellii
DISKVYSEADCFTYDPGFMSTASCRSTITYIDGDQGILRHRGYDIKDLAEKSDFLEVAYLLIYGELPNNKQYNDFTKKVAHHALVNERLHYLFQTFCSSSHPMAIMLAAVGSLSAFYPDLLNFFKEADYELTAIRMIAKIPTIAAMSYKYSIGQPFVYPDNSLDFTENFLHMMFATPCEKYKVNPVIKNALNKIFILHADHEQNASTSTVRIAGSSGANPFACVSTGIASLWGPAHGGANEAVINMLKEIGSVENIPKYIAKAKDKNDNFRLMGFGHRVYKNYDPRAAVLKETCKEVLKELGQLDNNPLLQIAIELEAIALKDEYFIERKLYPNVDFYSGIIYKAMGIPPQMFTVLFATA

SEQ ID NO: 41081 - protein, 555 aa, Pseudomonas fluorescens Pf-5
MTEPEDPSRERLKHHFAQRVIHQARQILEIWQRLQRSEWSTTDMSELCEANLRLLRFAERFEQPEHTQLARSISQSLEAVDANRGRLSSNLITDLNRLMQRLSRTGLRHGDQLEQTFLPPLRKPIYVMLQDHDRAERLAKQLEFFGLSAQSLDSIPAFRSSMVERLPAAIVIDVDFCGAGMGLTLAAEAQVGLEQKLPLLFFSLHETDTPTRLAAVRAGGQEFLTGTLEASSLLEKIEVLTCVAQYEPYKVLIIDDSRAQALHTERLLNSAGIVTRTLIEPIQAMAELADFQPDLIILDMYMPACTGTELAKVIRHNDRYVSVPIIYLSAEDDLDKQLDAMSEGGDDFLTKPIKPRHLITTVRNRAARARNLKARMVRDSLTGLYNHTHILQLLEDCSFRARREGKPLSFAMLDIDHFKRVNDSHGHPMGDRVIKSLALFLKQRLRKTDFIGRYGGEEFAIVMPDTDQDAACKVLDEIRQRFAEIHYPAQPQDLWCTFSAGVVEMQEDSDSLIMASQADEALYRAKHGGRNRVQAARSSQSAIFSSESTDSVITL

SEQ ID NO: 41082 - protein, 421 aa, Glycine max
LCNFPLCVYPFYFISLSLSFIYKFQVQSSITQHNTPICSCRQDLGSHINRPKRLTFRHIMRTRRRLSYLPTMSCRKRQKTSPDKTSDCFDSLPDDLVLSILCKLSSTATSPSDFISVLITCKRLNSLGLHSLVLSKASHKTFSVKAKNWCDSLHRFLKHCADAGNIEACYTLGLIRFYCLQNRGSGAALMAKAAMNSHAPALYSLAVIQFNGSGGTKNDKDLRAGVALCARAAFLGHIDALRELGHCLQDGYGVKQNVTEGRRFLVQANVRELAAVLSAGNNKRPWLTWSHQPVPHPRLRSETGSGCPLLSDYGCNVPAPEVHPASQFMSEWFDIRGGFPSAGMRLCSQSGCGRPETRRHEFRRCSVCGVVNYCSRACQALDWKFRHKAECAPVERWLDDDDEDVAGENDGGDDGVMMVDS

SEQ ID NO: 41083 - protein, 379 aa, Staphylococcus aureus subsp. aureus Mu50
MAKRDYYEVLGISKDASKDEIKKAYRKLSKKYHPDINKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPAGTQTGKQFRLKEKGIKNVHGYGYGDLYVDIKVVTPTKLTDRQKELMKEFAQLNGEEINEQPSNFKDRAKRFFKGE

SEQ ID NO: 41084 - protein, 72 aa, Glycine max
  misc_feature (15)..(15): Xaa can be any naturally occurring amino acid
  unsure (1)..(72): unsure at all Xaa locations
KGSKGCAAADAPRAXTVSAAATSSTAVGACVLTEGTDTTFQPDSEYTDWVWPLLDTCPALSDLCMTNIDTLS

SEQ ID NO: 41085 - protein, 698 aa, Thermoplasma acidophilum DSM 1728
MISSEVSEDRIKDLWRDFFRLYGYSDEINRIHQEYPEVRTLYVSFRDLEDYNWQFAGSILVSPEIYIRAGEEVILQDYLLDRVTQRFNIFNLRIKDLEEKNVAYRIRDIRSANIGTLISVSGIVRKNTEVFPKLKNAAFECSSCHGLTYVEQTENRLSEPQVCDHCGLSRGKDKIFFKLRPNLSEFIDVQKVEIQEDPETLEGGSQPQRITIITEDDLAGLLYPGNRVIVDGILRTEQRRQGNIPLTEFFTYLYAINVRKDVKELESVKITEEDKKRIIEISKKPDIIDVISRSIAPTIHGLDMVKKALALQMFGGVRKVMKDGTTMRGDIHILMVGDPGTAKSQLLKYMAEVSPRGIFTFGRGSSAAGLTAAAVRDEFGEGRWTLEAGALVLADNGFVAIDELDKMDEHDTAAMHEAMEQQTVTISKAGIMATLKARASVLAAANPKFGRYDLNRNLAEQINFPLPLLSRFDVIFKMVDHPNKDSDSRLAEHVLKAHRIGEIYRSIEHSDADIEIDEQGFEPEIDKDTLRKYVAYARNNVFPRLSDEAIAILQDQYVKTRSTSHDAIPITVRQLESTIRLAEAAARARLSTIVTVEDALLAKKIVDYYLMDVSMDNGKMDIDIIYTGASSKQRNDMETVLDIIKQLKSEKGMAEVADVINVAMSRGMTQKKAEEALLKLKNAGQIFEKSYGKIDVIS

SEQ ID NO: 41086 - protein, 341 aa, Prochlorococcus marinus str. AS9601
MYIYDYLDMKSILEQLSSMTVVVADTGDLDSIKKFQPRDATTNPSLILAAAKNPDYVKLIDKALESSQKTLSQGFSEIELIKETVDQVSVFFGKEILKIISGRVSTEVDARLSFDTDATVEKARKLINLYKNFGIEKERILIKIAATWEGIKAAEILEKEGIKCNLTLLFNFCQAVTCANAKITLISPFVGRILDWHKAKTGKTSFVGAEDPGVISVTQIYNYFKEKGFKTEVMGASFRNLDEIKELAGCDLLTIAPKFLEELKKEKGELVRKLDESTQINNSIDYEFEEKDFRLSMLEDQMASEKLSEGITGFSKAIEELEELLIKRYSEIKNHKLIPAN

SEQ ID NO: 41087 - protein, 316 aa, Gibberella zeae PH-1
MAPSGPFPVTVHPFDSECRGSAAYEVGLTSAHNAIVFIGGLTDGPHTIPYTRLLAERLEQAADLGYSVFEFRMRSSFSGFGTSNLSNDVEDISALAKYLRGIGKKKIVLFGSSTGCQDCIEYADYPKHNNEPVDGFILQGPVSDRETLDLIMPDPQPSLDLAAKMISEGKGGDCMPFDMIPAVLGAPISAYRFQSLASKGGDDDYFSSDLDDEILEKNWSRFKKPVLVLHSAEDEFVPARIDQAASNKKYKELNSTAVSDLSGLIPGASHTVEQLESQEWLSKTVIEFLKTFTWLLHLREAIKVTNQLYLYRVGSL

SEQ ID NO: 41088 - protein, 493 aa, Thermoplasma acidophilum DSM 1728
MDTKLYIDGQWVNSSSGKTVDKYSPVTGQVIGRFEAATRDDVDRAIDAAEDAFWAWNDLGSVERSKIIYRAKELIEKNRAELENIIMEENGKPVKEAKEEVDGVIDQIQYYAEWARKLNGEVVEGTSSHRKIFQYKVPYGIVVALTPWNFPAGMVARKLAPALLTGNTVVLKPSSDTPGSAEWIVRKFVEAGVPKGVLNFITGRGSEIGDYIVEHKKVNLITMTGSTATGQRIMQKASANMAKLILELGGKAPFMVWKDADMDNALKTLLWAKYWNAGQSCIAAERLYVHEDIYDTFMSRFVELSRKLALGDPKNADMGPLINKGALQATSEIVEEAKESGAKILFGGSQPSLSGPYRNGYFFLPTIIGNADQKSKIFQEEIFAPVIGARKISSVEEMYDLANDSKYGLASYLFTKDPNIIFEASERIRFGELYVNMPGPEASQGYHTGFRMTGQAGEGSKYGISEYLKLKNIYVDYSGKPLHINTVRDDLFQ

SEQ ID NO: 41089 - protein, 391 aa, Arabidopsis thaliana
MVQISDLPRDLTEEVLSRIPVTSMRAVRFTCKKWNTLSKDRSFTKKHLRGARAAAKKKQTKEFQVIMMIQFRVYLYSVNLLNPSIERIGKLISLDVEDHVDISKIFHCGGLLLCITKDISRLVVWNPYSGQTRWIKPRNSYHRLDRYALGYEEKNKSCRCYKILRFMDDYEDDRALRLIREFEIYDLNSDSWKVVNVTPDWDVEFYHRGLSLKGNTYWFAQEKLPPLPRGRVITISDMADFLLCFDFTRERFGPRLPLPFHSFVEDTVTLSSVRDKKLAVLFQPCSASTVKIWISRKIEPNAVSWRKVFLAVDMKSLTGFQFDINAASFFVDEKKKVAMVLDKDRFSYKFTRNIAYIIGKKGYFEKVDLGESTVSSCASLVCSYVPSSVQI

SEQ ID NO: 41090 - protein, 408 aa, Mycobacterium smegmatis str. MC2 155
MTDRTFVTVGAGQTAAVAARTLRRRGFDGRIILVGDEPHAPYQRPPLSKEFLCDTAASDDLWILPEKWCADNGVEIRTGAEVTRVDAATGTVEIAGQAPVRADAVLFATGGRPRRLPVPGPRPELVHYLRTLDDARRLHDALASGCRLGVIGAGFVGLEIAATAVGLGASVTVLEAAPMPLGTVVGSRVAAEIVRLHRGNGVELLTGVAVNGVRTDADGVVVSTGAQDLRFDAVVIGIGITPNTAVAEVSGLAVDDGIVVDAQGRASVPNIYAAGDVARRYSERAGKHVRIEHFDNANRQGAAVANAMLGRDAVNDDAPWFWSDQYEHNLQLLGEATGNLVIRGDVGEFEFTAFYVDTDDTLRGVFTVDRGEDVMVGRELLGRRIPRAVLEDDDADLWELVDTEEVAQ

SEQ ID NO: 41091 - protein, 379 aa, Methanococcoides burtonii DSM 6242
MEENGKTKEEILLFLKKAKSADASYERVLSSMCTYPHEIAVLAHTQFIESNMGDPGLFPGTFNLEKQVLAMFGKMLHHKNSPEKAGYLTTGGTESNIQAIRSMHNFRHDISRPNIVMPESAHFSFDKVANLSGIEIRKASLDKLLKVDLDSVRSLIDKNTIGLVGIAGTTEFGQLDPINELSKIAIEKGIFLHIDAAFGGFVIPFMDIDYTYDFRLEGVTSMTIDPHKMALSTIPSGGLLFKEPEYFECLEIHTPYLSVNKQYSLTGTRSGAGVASTYAVMKHLGRKGYKKVVSDCMSVTKKLVDGAEKLGINTVIDPVLNIVALDVPEADLVRKKLLDEYGWHVSITRNPRALRIVIMPHIKNETIELFLKDLAKVIK

SEQ ID NO: 41092 - protein, 210 aa, Schizosaccharomyces pombe
MGLTSWLFGGGKSPQEQLRAHQRSLGRAERELDRERTKLDQRERALIQEIKGSAKAGNTGAARIQARDLMRLRNSRKKMMNAKTQLQAISLRLQTMRTSEQMMQSMRGATRLLTGMNKSMNIPAMARITQQFERENEIMEQRQEMIDENMDDALEEDDEEEADELVNKVLDEIGVDLSQGLPDAATQIGTVPELKTEDNLQARLDELAKR

SEQ ID NO: 41093 - protein, 118 aa, Zea mays
MAGLQRSSQTFRRSGSSGLVWDERLTSQDDDQSGPEDADAATDLKELRHSRSVGSVGLQPQPLPQPQRRRSDDSGQGFRTRRVAPALDPPSPKVPGCIFCGIFRKAGASEPKSKPRRY

SEQ ID NO: 41094 - protein, 455 aa, Gibberella zeae PH-1
MDDLHLAPEPHLMHRSLLTRPEAVSSASGVYLNLSSGRKILDGCAGAAVAIIGHGSTEVQDAVVAQASQVSYVHTLTYTTSSAEELADHLLENEPFGLTRAYLVCSGSEAMDSAMKLARQYHVENGQPERTRFVSRRQAYHGNTVGAMSVGSHLARRAPYEGAILLDNVSHVSAAYEYRTKKDGETEEEYSKRLVDELEAEFLSVGPEKIMAFIAETVGGATAGCITPPAGYFSGVSKVCKKYGILLILDEIMCGVGRCGTFFAFEQDGDVQPDMVTIGKGLGGGYMPIAATLVHKGIIETLKKGTASFNHGHTYQAHPVSCAAALAIQKIIRRDNLVSRCATLGERLHKSLVETFKDAEFVGNIRGRGLFWGIEFVQDKKTKMPFDSKIRFGVKVQERAFELGLAVYPGMGTADGLVGDHVIVSPPLTITEEEMDVLVGLLKRAYDDVASKYGV

SEQ ID NO: 41095 - protein, 496 aa, Psychrobacter arcticus 273-4
MSTAAKNTQANTYTDFHLQYIAGEWKKGDDDSINTNTNPFNGETLVEIQQATDKQLDEAYQAASDAQKQWAKQTPNERAAILYKVVSIFDQRQDEIVDWLIKESGSTRIKAMVEFSSARAITLEAASFPNRVHGEIRPSNTPGKENFIYREPMGVIAVISPWNFPLHLTQRSIAPALALGNAVVLKPASDTPITGGLLLAKIFEEAGLPKGLLNVVVGSGSEIGDAMVTHHVPSLVSFTGSTSVGKHIGELANGGEYIKQVALELGGNSPFVVLKDADIEQAVKAAAFGKFLHQGQICIAINRIIVEDEIYDDFVTRFVAHVKTLNVGDPNKADTAVGPIINKKQVASLKEKIVKAKDEGAKMLLSGEIKGQVVPPHVFSDVTREMDLSCNEVFGPLVGIIRAKDEDDALSIANDSMYGLSSAVFTQDMAKGLRFARGIKAGMTHINDISVNDESNAPFGGEKNSGIGRFNGEWILEEFTTLHWISMQHTPRDYPF

SEQ ID NO: 41096 - protein, 363 aa, Rickettsia rhipicephali
DISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEVVINMLKEIGSSEYIPKYIAKAKDKNDPFRLMGFGHRIYKNYDPRAAVLKETCKEVLKELGQLDNNPLLQIAIELEAIALKDEYFIERKLYPNVDFYSGIIYKAMGIPSQMFTVLFAIARTVG

SEQ ID NO: 41097 - protein, 137 aa, Campylobacter coli RM2228
MEKTLSIIKPDAVKKGVIGKILDRFESNGLRIAAMKKVQLSKEQAEAFYAVHKERPFFKDLVEFMISGPVVVSVLEGEGAVLKNRDLMGATNPKEAQPGTIRADFAESIDANAVHGSDSLENAKIEIEFFFKSNEIC

SEQ ID NO: 41098 - protein, 275 aa, Rickettsiella grylli
MKQDASPIQFKHFKTYLSPRPRDAHKGLFGHVLVIGGYQGMTGAARLAAEAALRVGAGLVSVATQAESITPIMNGRPEIMAHTLKTSRDLMPLLKKANVVVVGTGLGQSRTSEHVMTVLLKTSHVKVVDADGLNVLAKKQPKKSNHWILTPHPGEAARLLECSVKAIQANRIEAVKALQKRYGGVIVLKGAQTLVCTRKSLCMCLAGNPGMASGGMGDVLSGVIGGLLAQGFSLQGAAECGVYLHATAGDKAAVSKGERGLLASDLMDYLHQLVN

SEQ ID NO: 41099 - protein, 224 aa, Triticum aestivum
MGSRVFALFITGVVLLGSRILALDHTVVEKRLNENTVSLTTKGSPQLCQLCEQFATETLFYLKENETRIEIIDTLHQACLKFHSLKLECTKLVDYYAALFFAQIDSLSPEEFCVSASLCEEVTYIRLPGHEHACTLCHEVVDEICTGLEDPEMELKIIEILLKGCNNTESFVQKCKKMIIQNAPLILEEYQKFLEKRDFCDSIRVCGGKIARPPVGGLRSLSTV

SEQ ID NO: 41100 - protein, 736 aa, Arabidopsis thaliana
METRSRSPPCRTLKNLRKFLLGRDQNLPRCSSLSLPPISSFSACVLKSSSIGADIEDVGEVIQPITNHHSSRDQAIFVFGAEARFYRTCLIQHTLISSGYRCCFRQGDPGDIFYHGDATPDEDGTVNFNNAEQTSQVGWITYSKKVPIWSHKTGKASDFSTSFSFKIDARNLSADGHGICFFLAPMGAQLPAYSVGGFLNLFTRKNNYSSSFPLVHVEFDTFNNPGWDPNDVGSHVGINNNSLVSSNYTSWNASSHSQDICHAKISYDSVTKNLSVTWAYELTATSDPKESSSLSYIIDLAKVLPSDVMFGFIAAAGTNTEEHRLLSWELSSSLDSDKADSRIGLVIGISASGFVFLTFMVITTVVVWSRKQRKKKERDIENMISINKDLEREAGPRKFSYKDLVSATNRFSSHRKLGEGGFGAVYEGNLKEINTMVAVKKLSGDSRQGKNEFLNEVKIISKLRHRNLVQLIGWCNEKNEFLLIYELVPNGSLNSHLFGKRPNLLSWDIRYKIGLGLASALLYLHEEWDQCVLHRDIKASNIMLDSEFNVKLGDFGLARLMNHELGSHTTGLAGTFGYMAPEYVMKGSASKESDIYSFGIVLLEIVTGRKSLERTQEDNSDTESDDEKSLVEKVWELYGKQELITSCVDDKLGEDFDKKEAECLLVLGLWCAHPDKNSRPSIKQGIQVMNFESPLPDLPLKRPVAMYYISTTTSSSSPSVNSNGVSVTFSGIEYGR

SEQ ID NO: 41101 - protein, 214 aa, Ostreococcus tauri
MSAEADDYDYLFKVVLVGDSGVGKSNLLSRFTRNEFCLESKSTIGVEFATRTIEIQNKIIKAQIWDTAGQERYRAITSAYYRGAVGALLVYDVTNKDTFGNVEKWLSELRDHADANIVIMLVGNKCDLAQLRVIQAVKAQQFADTEDLIFIETSALDATNVETAFINALSNVYNVVSKNQAVNAEETSNKQNRSILISAAEDGFRPKSKCCSTQ

SEQ ID NO: 41102 - protein, 532 aa, Daucus carota
MGGCFSKKEYQADGNGYRSAPTAYHTVTDQSYEKSSQRSQPQAQPQPQVQQTGPSLKPRQVHRPESNTILGKPFEDIRGKYTLGKELGRGQFGCVYQCTENSSGQLYACKSILKRKLVSKNDKEDIKREIQILQHLSGQPNIVEFKGVFEDRQSVHLVMELCAGGELFDRIIAQGHYSERAAATICRQIVNVVHVCHFMGVMHRDLKPENFLLSSKDKDAMLKATDFGLSVFIEEGKVYRNIVGSAYYVAPEVLRRSYGKEIDIWSAGVILYILLSGVPPFWAENEKGIFDAILEGVIDFESEPWPSVSNSAKDLVRKMLTQDPRRRITSAQVLDHPWMREGGEASDKPIDSAVLSRMKQFRAMNKLKQLALKVIAESLSEEEIKGLKSMFANMDTDKSGTITYEELKSGLARLGSKLSEVEVQQLMDAADVDGNGTIDYLEFITATMHRHKLESYEHQAFQYFDKDNSGFITKDELESAMKEYGMGDEATIKDIISEVDSDNDGRINYDEFCAMMRRARNRRKLFSVSLTS

SEQ ID NO: 41103 - protein, 452 aa, Staphylococcus aureus subsp. aureus COL
MNYTQQLKQKDSEYVWHPFTQMGVYSKEEAIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEMMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSKKIYNAFLSDSHGVNTFFHGHTYTGNQIVCTVALENIRLYEKRKLLSHIETTSSTLEKQLHALKRHRNVGDVRGRGLMFGVELVTDKDSKTPLEIEKVERIVRNCKENGLMIRNLENVITFVPVLSMSNKEVKTMVRIFKKAVHNILDRKC

SEQ ID NO: 41104 - protein, 537 aa, Gibberella zeae PH-1
MASTPPQADYGKEAVLDVSENQDVETGEVKNGGLQRDLKNRHMQMIAIGGAIGAGLFVGSGGALQKGGPAALLIGYLIIGIMLLCTCLALAEMAVLYPVNGAFFTYICRFVDPSWGFAMGWQYALAWLTVLPFELIAASITIKFWREDINMAVWVSVFLVTLIGIQFFGVRGYGEVEFVLSIIKICACVGFIILGIVINCGGVGDQGYIGVKYWQDPGAFTSFKGFCAVFVVAAFSFGGTEMVGLAAAESADPRRSIPMASKQVFWRIAIFYILNLFIVGLILPANDPRLMGASGANTKASPFVLAIQDAGIKVLPSIMNAVITVAVLSVANSCTFGSTRTIQAMAERNMAPGFFKYIDSKGRPLYCVLLQIAFGLLAYIGAAPQGMEIFGWLLALTGLGFLFVWGSICLAHIRMRAGMKAQGVNLGLIPYKTPFGVAGSYLGLGLNILALIASFYTALYPASGASPAAEAFFSSYLAFFSVTLLYVGYKVCTRKWQMYVRPSEMDLSTGAVFLEEEEPKEPFVWADAPKRVLRSFF

SEQ ID NO: 41105 - protein, 418 aa, Rhodococcus erythropolis
MTAVSEPDTRTVVIVGTGIAGSGAAQALRKEGFGGSIILIGSETEEPYRRPALSKELLSGKASIDRVRLRPPTFWTEQGIDLRIGVTVTSIDTDSRTVCLVDGDSIDYDVLILAAGGRSRRLTAEDSERVHYLRDIADMRRLQSQLIEGSSLLVVGGGLIGSEVASTARDLGCSVQVLEAQPVPLSRLLPPSIAEKIAALHASAGVALQTGVDLETLTTGVDGVTARARDGREWTADLAVVAIGSLPDTDVAAAAGIAVDNGISVDRYLRTSVIDVYAIGDVANVPNGFLGGMHRGEHWNTAQDHAVAVAKTIVGKEEPFESVPWSWSNQFGRNIQVAGWPGADDTVIVRGDLDSYDFTAICMRDGNIVGAVSVGRPKDIRAVRTLIERSPDISVDVLADSNRDLTELAAGLVASPVL

SEQ ID NO: 41106 - protein, 332 aa, Zea mays
MGECEDGKEYRCWEELLPDALGLIFRNLPLQEVLTVLPRVCKSWGRVVAGPYCWQEIDIEEWSQQQGKPEQIARMVELLVGRSAGSCRRISVSGLPCDPRFSFIGDNARALRTLEIPRSEISDSMVESVAPRLPNVTFLDISSCTKMGARGLEAFGKHCKSLAGLRRVMHPIDLADRACQHDEAHAIACSMPRLRHLEMGYMLVATEAVAEILGRCRELRFLDLRGCWAVDDKLLPRDRHPGLRVLGPRVDDCYENSYWEECSDDYSDDSSIYSWELMDDVDDDYDYAAGSDDDDDEAVWDDDGQGLENLEVRFYGGGFGETFAGFDWPPSP

SEQ ID NO: 41107 - protein, 328 aa, Oryza sativa (indica cultivar-group)
MAVYIAREATKLWRKVCAEIAVELQLLFEKWRLLLAGLVFQYIHGLAARGVHYLHRPGPLLQDLGFMALPELGQDKGYVSESVFTFIFISFLLWSFHPFIYHSKRFYTVLLWRRVLAFLVASQFLRIITFYSTQLPGPNYHCREGSKMATLPPPHNVLEVLLINFPRGVLFGCGDLIFSSHMIFTLVFVRTYHKYGSKRLIKILAWLMAIIQSLLIIASRKHYSVDVVVAWYTVNLVVFFIDNKLPGESARRQRMLGFLCMMTGFSGASAPAFCLSAMAICSRMNETEPGAIAPALLWTAKESESQLSSLPATFLRLPLQFCTLVSNL

SEQ ID NO: 41108 - protein, 148 aa, Triticum aestivum
MASKGLVVFAVLLAAAFLVATAEQTQAKKEETKAGVQGYHGGGGGGGGYHGGGGGGGYPGHGGGGGGGYPGHGGGGGGCYPAHGGGGGGGYPGHGGGGGGGYPGHGGGGGGSNRCPIQCCGHGRGGCPCCPNPKQHPGPHVSGRRSPN

SEQ ID NO: 41109 - protein, 512 aa, Arabidopsis thaliana
MASIGLYEAFIGFLCFLISFYFLVKKPFRYLLIKKTHQSYPWNWPVLGMLPGILLRLQRIYDYSVEFLENSNMTFQFKGPWFVGMDILATADPTNIHYIMSSNFSNYIKGPIFHEIFEAFGDGIINTDAELWRDWRNASQLIFNHQRYQNFSASTTKSKVNDGLVPLFNVDLQDVFQRFMFDITFIFLTGTDPRSLSIEMPEIEFAKALDDVGDVIVYRHITPRFVWKLQKWIGIGTEKKMSKANATLDRVCEKLIAAKREELRSQGIIDNANGDSEDLLTSHIMLDATKYELLNPNDDKFLRDFTVSFMAAGRDSTSSALTWFFWNLTENPNVLSKILQEINTNLPRTGSDQDMSSYLNKLVYLHGALNESMRLYPPIPFERKSPIKDDVLPSGHKVKSNLNIMIFIYAMGRMKTIWGEDAMEFKPERWISETGGLRHEPSYKFFSFNAGPRTCLGKNLAMNLMKTVIVEILQNYEIKIVSGQKIEAKPGLVLHMKHGLKVTMTMKCSSLE

SEQ ID NO: 41110 - protein, 135 aa, Gibberella zeae PH-1
MALRTGILTTDAPAPSPHLSQAIIHNGTVYCSGSFGMDPQTRELADGPYHQTAGALRNLDSILKAAGTTLHNALKVTIFILNMDHYAEVNKAYLEFFTSDPKPSRTCVAVAQLPLKGAHVEMEAIAAIPEKSSKL

SEQ ID NO: 41111 - protein, 245 aa, Burkholderia pseudomallei K96243
MTVNTRLAGAVLAALALIGPAAAQPLPLPAGLIDLGSLAGEQMLAESGARSAYASLGSHFVTQKTQSYCGVASLVMVLNALRVPAPAAAQYPPFHYFTQDNVLGDATERIRPRALIERHGMTLDQLGALANALGASGDVRHASDVSVDVFRADAIAHLGRPGRYVLVNYLRSRLGQQTGGHISPLGAYDAAADRFLILDVSRYKYPPVWVTTADLYAAMNTPDADSGGRSRGYVLIDGVVAGADS

SEQ ID NO: 41112 - protein, 115 aa, Legionella pneumophila str. Lens
MGFLFYKRCIVDTLEKIKKQIAENAIMLYMKGTPKMPQCGFSARAVQCIEACGVDFAYVDILANPDIRQVLPQFSDWPTFPQLYVKGELIGGSDIIAEMFQQGELEPMLRDAVAA

SEQ ID NO: 41113 - protein, 291 aa, Zea mays
  misc_feature (239)..(239): Xaa can be any naturally occurring amino acid
  unsure (1)..(291): unsure at all Xaa locations
MEKYEKLEKVGEGTYGKVYKAQDKATGQVVALKKTRLEMDDEGIPPTALREISLLRLLSSSLYVVRLLAVEQATKGGGAGRGGKPVLYLVFEFLDTDLKKFVDAYRRGPAPKPLPTQVVKSFLYQLCKGIAHCHGHGVLHRDLKPQNLLVDKEKMILKIADLGLSRAFTVPMKSYTHEIVTLWYRAPEVLLGATHYSTSVDIWSIGCIFAEMVRKQALFPGDSELQQLLHIFKLLGTPXTEEDWPGVTALRDWHEFPQWKAQRLTRAVPTLEPEGIDLLSKMLQFDPANRI

SEQ ID NO: 41114 - protein, 126 aa, Brassica napus
  misc_feature (91)..(91): Xaa can be any naturally occurring amino acid
  unsure (1)..(126): unsure at all Xaa locations
MPGPTTPFRGPLANTGWFVFNNGVKLTKAGKVKILGKDLIVGPTPKVVVASLGEDPDDLLLNSPQSVTPGGDPQDLPEVFGEAPRGGIHSXLLGAWDNSFLVGGFGIQGFKTLRQGIKGKGVGVNF

SEQ ID NO: 41115 - protein, 374 aa, Ustilago maydis 521
MSAREKRSGDAESTPVTVADGVHTHGVLNQHPNASPSAVAGEVANGSSAGSKADLSFRVGISEDSNKRWRRAMEDAHAFVYDFAGVHGQGFFGIFDGHAGKDAAEWCGQNFHKSLLKTLELNPDKPVPDSLNLTFHSVDRELANLASQQGSSSGCTAAIAFLRLEDESGQPLKVGGRASTGPDGHAHEEATRPEHSSERTSGDGLWGKLSKRFDSSDPKNERNSSPSSRRVLYTANVGDARAVLCRGGKAIRLTYDHKGSDAQEAKRITDAGGFVMNARVNGVLAVTRSLGDSAMKEFVVGSPYTTETVLGNEDSFLIIACDGLWDVIEDQEAVDLVRDVQDPQVASQELLKHALNEFSTDNTSVMVVRFASPS

SEQ ID NO: 41116 - protein, 576 aa, Oryza sativa (japonica cultivar-group)
MGAVGVEAGVFDTVDGLVGEVMRLHRSLPARPAVEDVEAAEALAAAADREERARADAVARLRRSPAVPDELLCVAQEMHRALAGFQCREQKRDAARLLELEALHTLFDDLIQRASQCLPSTSTRAAPRIAAPAAATTTTSTAAAGSSSSSAVGNAERHASSGTNGFTASRVAGTSTSTGRVSMDDSYVRKAKAAMWDGGAAATNSHLPRGPVEANSVAVRADGNYGDDNEKLSLIKLASMIEVSAKKGARDLNLQGKLMAQIEWLPDSIGKLTGLVTLDISENRLLALPDAIGKLFSLAKLDIHANRISQLPESIGDLRSLIYLNMRGNQLSSLPSSIGRLLNLEELDVGSNGLSSLPDSIGSLTRLKKLIVETNDLDELPYTIGHCVSLVELQAGYNHLKALPEAVGKLEPLEILSVRYNNLRSLPTTMASLTKLKEVDVSFNELESIPENFCFATSLIKLNVGNNFADLQYLPRSIGNLEMLEELDMSNNQIRVLPDSFGNLKHLRVLRAEENPLQVPPRDIALKGAQAVVQYMSDASKRTTKSEPMKPKKTWVHFCFFSRPNKRKHDRIDNAT

SEQ ID NO: 41117 - protein, 444 aa, Oryza sativa (indica cultivar-group)
MASSGCSSNRLRQTIVVALLLLASSSCLASAKHRGNGTTTTVPFHGKDELRRYRKIMAQSPDGDVIDCVPARLQPAFDHPKLRGQKPEAEPEERPKVGGAAAAEAEEEAVFPQAWTDGGESCPEKTVPVRRTRRRDVLRSSSAVRFGMKQPRAAGVVRRDSTSDGHEHAVGYVTGDQFYGAKASLNVWSARVATAAEFSLSQIWVISGSFGNDLNTIEAGWQVSPELYGDNNPRFFTYWTFTLSFSYRYLDFDILPLKTCKKQQYLILQQTDAYQATGCYNLHCSGFVQTNNRIAIGAAISPTSVYNGRQFDISLLIWKDPRRGHWWLQLGSGPLVGYWPSSLFTHLGGHANMVQFGGEVVNTRPSGSHTPTQMGSGHFPREGFNRAAYFRNLQVVDWDNNLLPAAALRLVADHPSCYDIQGGYNRAWGNYFYYGGPGRNVRCP

SEQ ID NO: 41118 - protein, 248 aa, Cytophaga hutchinsonii ATCC 33406
MIILLFFVAHWYLSLFMQTFFLHRYAAHQMFTMSKGWEKFFYILTWLFQGSSYLSPYAYGVMHRLHHTYADTDKDPHSPKYSTGMFDMMWKTKNIYNDILHGRIELDPKYKKNVPYWGFIEKMGDNWFSRVAWGTAYTLFYVYFATHWWMFLLLPIHYLMGPVHGAIINWFAHKYGYVNFVVNDTAKNLLPVDFLMFGESYHNNHHKLGGRANFGVKWHEFDPAYPIILFFNAFHIIKLKRNNDLNYM

SEQ ID NO: 41119 - protein, 358 aa, Agrobacterium tumefaciens
MPRKASVFIVEFKFELESCPLGVVIPLEESKNKLASVKPLVDLTRPDMERVNQLILSKAGSDVQMIPEVANHLISSGGKRLRPMLTLASASMFGYEGDNHIKLATSVEFMHTATLLHDDVVDESDLRRGKSTARTIWGNQASVLVGDFLLGQAFRMMVDVGSLDALDVLSTAASVIAEGEVLQLSVAKNMETTEDDYLQVIRAKTAALFAAAAEVGPIVAKTDKATRSALKSYGMNLGLAFQLVDDVLDYGGKSADLGKNTGDDFREGKITLPVILSYRRGTQDERAFWRTAIEKGESSDENLEKALGLITKYNGLGDTIGRATHYGTIARDALAPLPQSPWKDALLEVIDFCIERLN

SEQ ID NO: 41120 - protein, 1711 aa, Methanosarcina mazei Go1
MRGLAFAEIDRTEASILCFEKALELMPEYAAAWCAMGTVAGKAERYEEALENFERALEINPKDSEACYAKGLVLAKLEKYDSALECFDSLTRENPRNENALEQKCLLLAKIGKKDLALEALEDFLKKYPANEAALYHKGILLSELSRYEEAEKIFSKVLKLDPENREAWFRKGFALVQLLRLNEAIKAFEEAIKIDPSYFEAWNCRCFALMKLEVYEEALEAFDSMLRIYPDVKDIWYSRALALLKLQNYAEAVQSFARVTELDPENKDAWLQQGLLLARTGKHEEALNALEKLLEYDPDFTEAQKLRGTVLAGLGRFEEALGPLEKSLEKEPENYNLWLQKGLILLDTGKLEPAIDAFENAARLNPDNETCWMNMGFALYSLERYEEALEAFKEGLRLNPYLETGWNRKGIVLGKLGKTGEALEAFEEAIKLRPDFEDAWKNRGLLLFASEECEKAEEAFAEVLKINPEDIDSLYNRGISLLKLGRKETALEYLEKVVSLRPDYPDLSYSLGVALTELGEYEKALETFEKLASENPYDLEIQCRRGKLAMEVGNYETALQAFERILTEKPASREAWYRKGLALLKLENFEEAVKAFDAVATKDADYEDAGVLKGFAQMKLKECASALETFERVLEKKPDSDTAWYYRGMILYTLQRQEEAAKAFESASRLNPGLYTAFEYRAKCLFETGQYEAAFEAFEAVLEKDPENLSALEKRAICLFELKKNKEAVDALSTLLESDPERKDTKLRLEEAKLRLGIEYFELGQYENALELFEGINEKAEGIYEKTRDPQKPNSVLYWKGLVFIRQEAYEKAVEAFKGITDQDPNFAEGWYFTGLSCSKLGRYEEASEAFKKALEINSALRDTHDICYQLGISNFELGKFEEALKAFEKAFKTTPDREQITETTYTDLIYMKSLSLLRLGRYKEAEVGFKEVIFRDSDNAEALAHLSTACFKQEHYEEALEIFEKVLSQTPERKTVLFRKGVALKALGKIQDSLDIFDLVLKLKPDCSYALEQRGYALFELGRYGEAAEAFKEALEYCPNKTYMQYLKGLAFFRIGNFTEALEGFGKALELGCQKPDIPYYTGLSCFETGDYAGALKAFDRLPEEGTQDPDVLQKRALALFELGRQEEAVSAVNFLLELSAENLTIGEKGNEPEGNEPEKSPEENNRICQELLEKFASALIELGKPEEALLPLEKLAREGSASKETLYDRGIALLELGRQEEAFEIFSDLIEIYPDFKKAWYGKGLVLFSQEHYEEALKALKQAVPDGEESKIGEPELEDALTKIGLSQLKTGKYEDACDTFEKVLEKNPMAADIWYLSGLVMRGLDQNEDAVEAFNRALEIKPDLRAAQEQKGLALLSLCRYEEARDAFSSVLEESPENADVLYNRAVASFKTLNFEDAAKDLEKVLLFAPDSPDYTEACYMLGIASIELQDYERALQALDMVLEWEPEHEEALYNMALVLFNLEEYEEAARTFEQLLETSPEDPESLNYLGLCLLELDNLKEALKAFEKAALFNPKNEEALYNAATTLIKLNRAQESLGYFDRILEISPDNLDVLNYKGVIFCMLDQYREALRAFDGVLKRDPENIKAIYNVGVVCFKQKLYETAARAFKEALSINPWHEQSLRYLGISLAKIGEYEEALKAFEKLLRINPQDVQSMNYRGVILGKLERFGEAIRAFDEILRIYPDMADAREKLEVLKSLENDEELY

SEQ ID NO: 41121 - protein, 473 aa, Methanosarcina mazei Go1
MSLSVHPVQDLNIQIQDLNVYGWNLQDLSTSGLEYYSSTSHTEQKMTLMEDAKKGVITPEIEAVAKAEGIDAEIVRSCVAKGLVAIPKNARRDTLPVGIGKYMSTKINANVGTSRDCIDIDAEIEKAKAAEAFGAHAVMDLSTGGDLDEIRTRILKAVNIPVGTVPIYQAAASRKIVVEMSSDDMFNAVRKHAEQGVDFVTVHAGVNLNSLERLRQSDRIMNVVSRGGSFTLAWMLHNGEDNPFYAEFDYLLEIAKEYDMTLSLGDGMRPGCIADASDRPKFMEFITLGELVKRSREANVQTFVEGPGHVPLNEIELSVRGMKELCDGAPLYLLGPLVTDIAPGFDHITGAIGGAVAGMHGTDFLCMVTPSEHLALPSIEDIKEGLLVTKLAAHTIDLIKEGPRERAWKQDTAMAYARRDLDWEKQFELAIDGDRARKIRDARKTESDACSMCGELCAVKIVKEAFGEKKEEE

SEQ ID NO: 41122 - protein, 268 aa, Staphylococcus aureus subsp. aureus Mu50
MKFAVIGNPISHSLSPVMHRANFNSLGLDDTYEALNIPIEDFHLIKEIISKKELDGFNITIPHKERIIPYLDYVDEQAINAGAVNTVLIKDGKWIGYNTDGIGYVKGLHSVYPDLENAYILILGAGGASKGIAYELAKFVKPKLTVANRTMARFESWNLNINQISLADAEKYLAEFDIVINTTPAGMAGNNESIINLKHLSPNTLMSDIVYIPYKTPILEEAERKGNHIYNGLDMFVYQGAESFKIWTNKDADINSMKTAVLQQLKGE

SEQ ID NO: 41123 - protein, 255 aa, Methanosarcina mazei Go1
MKNLFDLTGRVAIVTGASSGLGVEFARALANQGADIAIVARREEKLKEVQKEIEKIGVTCRYYICDVMQTDQIKSAVEKIEKDFGKIDILVNNAGLGLVDAADKTSDEMWRNMIDTNLNGVFFFAREVGKVMLKQKYGRIINIGSIHSTVSMKGMPVTAYCSTKGGVLMLTKSLATEWAKEGITVNAIGPGYFALGMAEGVVADPEFAKIIEFMCPMGRAGQTGDLDTTVVYLASEASKYITGQIITVDGGWTAL

SEQ ID NO: 41124 - protein, 231 aa, Zea mays
MDLATTPARRRPMEPGLARRLWHVVVAVCHILRRGLSPKRIMMDVHLLLGRGKLVGRTLRGHLAHPSSGHHLATYGASSSSSSTLASFYGHPREVEFSCATTPSYPQQHYGLFPSNKARGGGGYGGLDAATVARAFEMLSRAEVDAGGGSGTPATATPSPMLAWILGRSPAGVRPLRVTDSPFPAVAGDGDGCCGERVDADADDFIRKFYEQLRLQPTAATPDAHLRRRGY

SEQ ID NO: 41125 - protein, 504 aa, Xanthomonas oryzae pv. oryzicola
MTQTNGFDALHAHAQRLRGAAIPALLAAEPERPTQYAWQVGPLYFNFARQKYDRAALDALFAIARERDLVGAFQRLFRGEQVNVTEQRAALHTALRGDLTDAPVASEAYATAAEVRQRMGALIQQLEATDVTDIVSVGIGGSDLGPRLVADALRPVSGARLRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLEGAAQFDAHALNTPLEENVAVLHGLTAVWNRNLLGSATHAVMTYDQRLALLPAYLQQLVMESLGKRVKLDGSAVDSDTVSVWWGGAGTDVQHSFFQALHQGTSVVPADFIGTVHNDDPYAENHVALMANVLAQTEALANGQDSSDPHRSYPGGRPGTVILLDALTPQALGALISMYEHSVYVQSVMWGINAFDQFGVELGKQQASQLLPALKGESADVADPVTRELLSKLRG

SEQ ID NO: 41126 - protein, 301 aa, Rubrobacter xylanophilus DSM 9941
MAGVFVMGSINQDFVLRVERRPGPGETVTDAELSLHPGGKGANQSAAAALLGAEVAFLGRVGDDGLGEPLVRNLREKGVDAGLVERVAGRSTGAAFITVTPDGENAITVAPGANRALLPPDVEAARERIAASRVLVAQMEIPRETVFRGVEVASEAGTRVLLNLAPPFEVPGELLGLLDPLVVNEHEAAFLLGEPVEGVEGALAAAPELLGLGARSAVITLGPAGAVFALEGRAEHASAPRVRAVDTTGAGDAFVGALAARLAAGEALGEAVAYAVRAGAAAVTREGAQGALPTPEVVEGL

SEQ ID NO: 41127 - protein, 269 aa, Zea mays
  misc_feature (161)..(161): Xaa can be any naturally occurring amino acid
  misc_feature (185)..(185): Xaa can be any naturally occurring amino acid
  unsure (1)..(269): unsure at all Xaa locations
YGPGLRAGPRAPPQAHRHRGHRHPSHRPLASGRQRRRRGRAGRRGGRGEPPPPAAVADGELVFDNKWPQDLPGFREALEEYAKAMEELAFKLLELIARSLKLRPDRLHGFFKDQTTFIRLNHYPPCPSPDLALGVGRHKDAGALTILYQDDVGGLDVRRRXSDGEWVRVRPVPDSFIINVGDLIXRYESAEHRASVNSARERFSMPYFFNPATYTMVEPVEELVSKDDPPRYDAYNWGDFFSTRKNSNFKKLNVENIQIAHFKKSLVLA

SEQ ID NO: 41128 - protein, 420 aa, Oryza sativa (indica cultivar-group)
MVRDFATDESHGERGMSVLKLRLDGVRSAYDAAAAELETAKRAREDAEQELGGNQVQVAIAVVSIHGLEATISHLQEEISQVRSDLDALKGKGDIERDEFISQMDQLNTKIRKFQQMVSVELNGKKCSELSSGEGQQVTDWSEVIELEGSFEELNGNVSNADSERSLFEEQYEKDDHDKVTGKECHRKGFTFLRSTGKFESSDEGSTFSDDETILELLPLGPSTSRILVASTSVNNGQNIYASDQPLSTLPPLPDLEIPQRKGPLCIDGDANESDNDDTATTSSQGSYIELHTIQDEYVIGGPSWEAMIAPITGLALEEEEELMIEGQILLANDQKANRLITLFDEEERAMVRMLAALGQPLLTMGTFPTSRSFLLNLPLIFVCKEKDTECSICKSTLATKYRCHVHASLVNTYSICNAY

SEQ ID NO: 41129 - protein, 261 aa, Mycobacterium smegmatis str. MC2 155
MTDAATPENPFDLTGHVAVVTGGGSGIGLGMAEGLARAGAAVAILGRTASRLETAAEHLRRHARPVLPLVCDVADEQATTAAMARVRGEFGFLDSCFANAGVRGEFTPVLETSLEMFREVTRVDLDGVFVTLREAARQMIEAGRGGSLVAVSSLGAFQGMPRQPAYAASKAGVASLIDSMAVELARHGIRANTVAPGWFDTEMTADGLADERFRERVLPRVPARRWGAADDIGGVAVYLAGSASRYHTGDVLRIDGGYLKF

SEQ ID NO: 41130 - protein, 556 aa, Legionella pneumophila str. Lens
MAIKVTKRGMDLLRDPIVNKGTAFSLQERDEFALHGLIPTTVETLEQQVIRCLDAYSAKENPLEKHIYLRALQDRNEVLFYRFIIDNLVDILPIIYTPVVGQACEMFSHIYRQPRGVFLSYPERDKLDSIIQNIASTRSIKVIVVTDGERILGLGDQGAGGLGIPIGKLSLYTSCGGIHPSNTLPIILDVGTNNKERLDDPEYIGWRHARISGKEYDDFVDQFVQSIKRHMPHVLLQFEDFAQQHAYPLLERYKNQLCTFNDDIQGTASVAVAAILAATRVTNTPLKEHRVALLGAGSAGCGISEQLVHAMINQGLSEEEARSRFYLVDRYGLLHDEMTDLLPFQKGFVRSSTSLQNWKLEKKGEITLTDVINNAQPTILLGVSGQPNQFKEAMIKTMLSYCERPIIFPLSNPTSRAEAIPQDLLNWTAGKALIATGSPFEPVVINGHKIEIAQCNNSYIFPGVGLGVVAGQAKRVTDLMMMAAAVALSELAPAIRTGEGRLLPELNSIREVSQHIARAVILQGIKEGHIEPMNNNKIDESIKRTMWTPQYEPYVL

SEQ ID NO: 41131 - protein, 467 aa, Psychrobacter arcticus 273-4
MIAKKALGLPLKGLRFAIKSGDTLIKTASTQVTRFKTRFDENKAKNSLDEMPVAKRNYASVSEQTELSTNADSIDMREFEFTKAPINWIPATILVATPIAAAIITPWYLFTHQVSAPVWGVFGAFMVWTGISITAGYHRLLSHRAYKAHPIVKNFLLLGSTFAVQGSAFDWVSGHRTHHRHVDDRLEDPYSAKRGFFFSHMGWMLRNYPSGKFDYKNIPDLTKDRTLQIQHKYYGLWVAALNVGAVAAIGWLLGDVWGTLVIVGLLRLVLTHHFTFFINSLCHMFGSRPYTDTNTARDNFFLAIFTWGEGYHNYHHFFQYDYRNGVKWWQYDPTKWLIAGLSKLGLTSELRTVDDTTIKHAEVQMQFKAAQQQIDTATSSGIDIPHAMKSFQDRIKFEYDAFTQTVEEWQALKAKTIELKKTEFADRLHEVEDELKNDYAKIEEKILAHNSNLKTAFRSIDKSAKAA

SEQ ID NO: 41132 - protein, 524 aa, Vigna unguiculata
MNNGVRQESSVLLDLASHVNRFAFDHFRTDTAVQSSFLRFNGGAGAKRGVSLRVGAAGVRVRNILSEFNRAVRFHCEKIPIGFASLRVAEGDGGGGGGGCDGDGDGSGVRVDECGGVENEGLRGNGVEGERPKKVLILMSDTGGGHRASAEAIKAAFYEEFGDDYQVFVTDLWADHTPWPFNQLPRSYSFLVKHGPLWKMTYYGTAPRVVHQSNFAATGTFIAREVAKGLMKYQPDIIISVHPLMQHVPLRILRSKGLLDKIVFTTVITDLSTCHPTWFHKLVTRCYCPTTDVAQRALKAGLQQSQIKIFGLPVRPSFVKPVRPKDELRRDLGMDEDLPAVLLMGGGEGMGPIEATARALADSLYDESIGVPVGQILVICGRNKKLLNKLNAINWKVPVQVKGFVTKMEECMGACDCIITKAGPGTIAEAQIRGLPIILNGYIAGQEAGNVPYVVENGCGKFCKSPKQIAKIVADWFGPKAYELQQMSQNALRLARPDAVFKIVHDLHELVRQRSYLPQYSCTA

SEQ ID NO: 41133 - protein, 359 aa, Chondrus crispus
MQALMKEQEDGGLKPPTGLEGLDSVTLTRFVLHGQRKHHDASGDLTLLLAAVQLACKVTETCVRRAGIAKLYGLAGSGNVQGEDQKKLDIIANDTFKVNIESSERCGVMVSEEDELAIVCTKSSIDGTTGKYAIAFDPLDGSSNIDANVSIGTIFSIFKIDDPDSITDAKSAAAAISQPGRQMVAAGYAMYGSATNLVISVGTGVYGFTLDPSLGEFVLTHPDIKIPSRGKIYSVNEGNAKNWDKATTEYIQSLKYPEEGKSSYSLRYIGSMVADVHRTLFYGGVFIYPADKKSPNGKLRLLYEAAPMAFLMEQAGGKATTGKTEILDIVPEDIHQRVPVYMGSSEDIADFEALASKYA

SEQ ID NO: 41134 - protein, 323 aa, Streptococcus thermophilus LMG 18311
MERIRKRLKENNMSIDQLRDVKLITALITPFHEDGSINYDALPDLIEHLLAHHTEALLLAGTTAESPTLTHDEELELFAAVQKIVNGRVPLIAGIGTNDTRDSIEFAKEVAKFGGFAAGLAIVPYYNKPSQEGMYQHFKAIADASDLPIIIYNIPGRVVVEMTPDTMLRLAEHPNIIGVKECTSLANMAYLIEHKPKDFLVYTGEDGDAFHAMNLGANGVISVASHTNGDEMHAMLKAIENSDLKTAAAIQRRFIPKVNALFSVPSPAPVKAVLNHLGLEVGPLRLPLVACTSEEAKRIIKVVLEEDVEATRETVTGVVRPDY

SEQ ID NO: 41135 - protein, 424 aa, Methanosarcina acetivorans C2A
MVSEVTLDKSRQMYEKAKTLIPGGVSSPVRAIKPYPFYTASADGSKIRDLDGNEYIDYCLAYGPAVLGHNHPVIKAAIKEQLDKGWLYGTPTELEVTLAEKVAGYYPSIDMLRFVSTGTEATMSALRLARGFTRKNKFIKIEGGFHGAHDAVLVKAGSGATTLGEPDSLGIPADFTKYTLQAPYNDIETMTTLVEKNRDDLAAVIIEPVLGNIGPILPLPGYLKELRKLTKENDVLLIFDEVITGFRLAMGGAQEYFGVVPDMTTLGKIVGGGLPIGVFGGRREIMEMIAPSGAVYQAGTFSGSPCSVAAGIAVLDYLKKEDIHAKLNSTGDYMRAVVSEIVEDEGLDYTVCGIASMFKIFFGAEPHNYQEALKCDKEGYLSFFHRMLANGVFLPPSQFETNFISAAHSEEDIEKTLEAYVENL

SEQ ID NO: 41136 - protein, 627 aa, Oryza sativa (japonica cultivar-group)
MEVRRRAPLPPPPGRVQAGDALPLPIRHTNLIFSALFAASLAYLMRRWREKIRSSTPLHVVGSPRCSPSSASSPRSSTSSASSGIGLSCSPSSPPATTRRRNFLVGPARGSSAAAAVAPPAPPSSPAQCSLLGSPHDDAARERMPEEDEEIVSSVVAGKVPSYVLETKLGDCRRAAGIRREAVRRITGRQIEGLPLDGFDYASILGQCCELPVGYVQLPVGIAGPLLLDGQRFYVPMATTEGCLVASTNRGCKAIAESGGAVSVVLRDGMTRAPVARLPTARRAAELKAFLEDSVNFNTLSMVFNRSSRFARLQGVQCAMAGRNLYMRFSCCTGDAMGMNMVSKGVQNVLDYLQDDFPDMDVISISGNFCSDKKPAAVNWIEGRGKSVVCEAVIKEDVVKKVLKTNVQSLVELNVIKNLAGSAVAGALGGFNAHASNIVTAIFIATGQDPAQNVESSHCITMLEAVNDGRDLHISVTMPSIEVGTVGGGTQLASQAACLDLLGVKGANRESPGSNARLLATVVAGGVLAGELSLLSALAAGQLVKSHMKYNRSSKDMSKRSRAHQTKVKDSEVYGDIVMAADADTNSSCSEAMVGRYWTTGGRRASLVASRSCPLSSFALVITFALF

SEQ ID NO: 41137 - protein, 237 aa, Hyphomonas neptunium ATCC 15444
MAENGRFDGWTVAFDLDGTLVDTAPDLLGALNHVLTDAGLEPVDLPTIATLIGNGARAMMEKGFGVQGVTLPAAEMDAAFERFIAYYIANIAVDSRPFEGCTEALDALLDAGATLCVCTNKRQDLSERLIGELGLTDRFAAILGADRATNRKPHQDHVFEAVRAAGGTPERALFVGDSRTDERAARNAGLPFLFVTFGYEAETPEMIAPDGIIGHYAQLFDALSVLRDQAIASLRGR

SEQ ID NO: 41138 - protein, 496 aa, Mycobacterium bovis
ELDPAAETEVAPQTERPKVLILGSGPNRIGQGIEFDYSCVHAATTLSQAGFETVMVNCNPETMVSTDFDTADRLYFEPLTFEDVLEVYHAEMESGSGGPGVAGVIVQLGGQTPLGWRTGSPTPGPARGHPPEAIDLAEDAAVRRPAERGLPAPKYGTATTFAQARRIAEEIGYPVLVRPSYVLGGRGMEIVYDEETLQGYITRATQLSPEHPVLVHRFLEDAVEIDVDALCDGAEVYIGGIMEHIEEAGIHSGDSACALPPVTLGRSDIEKVRKATEAIAHGIGVVGLLNVQSALKDDVLYVLEANPRASRTVPFVSKATAVPLAKACARIMLGATIAQLRAEGLLAVTGDGAHAARNAPIAVNQAVLPFHRFRRADGAAIDSLLGPEMKSTGEVMGIDRDFGSRFAKSQTAAYGSLPAQGTVFVSVANRDKRSLVFPVKRLAHLGFRVLATEAPQRSCAATVFPATTSANISSRRSPAAPQCRRWTRSEPARSTW

SEQ ID NO: 41139 - protein, 433 aa, Nicotiana tabacum
MAGQTIIVSGLNPAAILQSTIGGGASPTAAAAAENGTRKVIPLSRDALQDFMLSIITQKLQDEKQPFYVLDLGEVVSLMDQWKSALPNIRPFYAVKCNPEPSFLSILSAMGSNFDCASRAEIEYVLSLGISPDRIVFANPCKPESDIIFAAKVGVNLTTYDSEDEVYKIRKHHPKSELLLRIKPMLDGNARCPMGPKYGALPEEVDPLLRAAQAARLTVSGVSFHIGSGDADSNAYLGAIAAAKEVFETAAKLGMSKMTVLDVGGGFTSGHQFTTAAVAVKSALKQHFDDEPELTIIAEPGRFFAETAFTLATTIIGKRVRGELREYWINDGLYGSMNCVLYDHATVNATPLAVLSNRSNVTCGGSKTFPTTVFGPTCDALDTVLRDYQLPELQVNDWLVFPNMGAYTKAAGSNFNGFNTSAIVTHLAYSYPS

SEQ ID NO: 41140 - protein, 269 aa, Triticum aestivum
  misc_feature (134)..(134): Xaa can be any naturally occurring amino acid
  misc_feature (220)..(220): Xaa can be any naturally occurring amino acid
  unsure (1)..(269): unsure at all Xaa locations
MDPKLVEVTQLFDRFKAAFKASNFDVCSTLLSQLKVLLTKFPSLPPVFQQTPNAVEELKLAREIYEQAVILSVKMEDEDAFERDFCQLKPYYMDTCGIIPPSSEEYPIMGANLLRLLVQNRIAEFHTELELLPXKALDNAYIKHGVELEQSFMEGAYNRVLSARQTAPHETYIYFMDLLVKTVRDEIAGCSEKGYDYLSINDAKQMFKFSSDKELQQYIXAEEHPEWDVKDGRVLFQKAKESQPLQGDPRRAPVINQTLGYARELERIV

SEQ ID NO: 41141 - protein, 486 aa, Burkholderia sp. 383
MPIFEAEHLRKAFIGGRWVAPANGGVEHDIINPATGEVSGVLLFSDEADVNLAAEAARDAFAAFSNTPLVERLKLLERVIGAYTERLQDMADAITLEMGAPMDAISRPLQAALGLWHLHTTLEVAKQYPFERTQGTSRIVKEPVGVCGLITPWNWPMNQVMCKVAPALVAGCTIVLKPSQNAPYSAIVLAEILEKAGVPPGVFNLVQGAGQRLGRAIASSPLFDMVSLTGSTSAGVEVAQAAATTIKRVTLELGGKSANIILDSENFQQGVTHGVLQMMANSGQTCTAPSRMLVPAHRLEEAEQIAVAACGQVVVGDPRDPGTTMGPMANQRQHQKVQEMIRVGIDEGAMLLSGGLGNPSGLERGYYVKPTVFSRVNNRMKIATEEIFGPVLVIIPYRDESDAVTIANDSPYGLSGYVYGDSIEQAERVARKLRTGMVHLNGAAVDIAAPFGGYKQSGNGREWGYAGIEEFLETKSMFGATPGAVS

SEQ ID NO: 41142 - protein, 337 aa, Phanerochaete chrysosporium
MPVKAGINGFGRIGRIVLRNALLHGDIDVVAVNDPFIDLEYMVYMFKYDSVHGRFKGSVEAKDGKLYVEGKPIHVFAEKDPANIPWGSVGAEYIVESTGVFTTTEKASAHLKGGAKKVIISAPSADAPMFVCGVNLDAYDSKYKVISNASCTTNCLAPLAKVIHDKFGIVQGLMTTVHATTATQKTVDGPSNKDWRGGRSVGNNIIPSSTGAAKAVGKVIPSLNGKLNGLAFRVPTVDVSVVDLVVRLEKPASYDEIKQAIKEASETTHKGILGYTEEKVVSTDFTGNDNSSIFDRDAGIALNKTFVKLISWYDNEWGYSRRCCDLLGYAAKVDGAL

SEQ ID NO: 41143 - protein, 438 aa, Arabidopsis thaliana
MSNLPLDLVEEILSRVPATSLKRLRSTCKSWNNCYKDQRFTEKHSVIAAKQFLVLMLKDCRVSSVSVNLNEIHNNIAAPSIELKGVVGPQMQISGIFHCDGLLLCTTKDDRLEVWNPCTGQTRRVQHSIHYKTNSEFVLGYVNNNSRHSYKILRYWNFYMSNYRVSEFEIYDFSSDSWRFIDEVNPYCLTEGEVSLKGNTYWLASDEKRDIDLILRFDFSIERYQRLNLPILKSDYETEALSVVREKQLSVLLKRNDTLEREIWVTTNDKIDHTTKNLLWIKFLAIDQRTCYHWSCVSFFIDEEKKMAVFCDGYIGGINETSRRMFYIIGEDKYYRELYVGDSPIRSHRPFVFNYVPSLVQIPQATVIPKRRRQQLSLVLQRCRASKVDVWITDKIDTKEVQWSKFFTVDVDIGGRAMLSYDSFFIDKEKGMALLCGL

SEQ ID NO: 41144 - protein, 130 aa, Prochlorococcus marinus str. AS9601
MSSKQVIKTSNAPDPVGPYNQAIKAGDFIYCSGQIAIDPALNEITCLGDIEKETIQVLKNLAEVLKAGGAKIEDVIKTTIYLTDLSNFQIVNKIYSDFFNIDNPPARACVEVSSLPKGVLIEIDCVAFLD

SEQ ID NO: 41145 - protein, 249 aa, Mycobacterium smegmatis str. MC2 155
MSLSGDLQRALTAVAATPHLLVTSDFDGTLAPIVNNPADARPLADAAEALAALAELPQTASALISGRALEVLRALSGMPDTVHLVGSHGAEFTSGFGHDIDTALLQRITDRLHTIASGRPGVTVETKPASVALHVRNASPEHGAAALTEARTAAAEWDAQLTEGKAVLEFAVIQTDKGEAVDILRQQENATAVVFFGDDVTDEKAFRRLRGDDVGVKVGPGESLAAYRVDSPEDVAAALDHLLAVRRGA

SEQ ID NO: 41146 - protein, 525 aa, Brassica rapa subsp. pekinensis
  misc_feature (6)..(6): Xaa can be any naturally occurring amino acid
  unsure (1)..(525): unsure at all Xaa locations
MPLTEXIYNHLSLFDLSLALLGLFVFCCLREKLTNKHGPMLWPVFGITLEFFIHKNDVYAWVTKSLKKSRNTFLYRGFWLDGSHGAVTCSPANVEYMLKTNFKNFPKGTFFKDRFKDLLEEGIFNADDESWKEQRRVIITEMHSTRFMEHSFQTTQRLVRKKLLKVMESFARSQEAFDLQDVLLRLTFDIICIAGLGDDPETPAQDLPQVPFAKAFDEATESTLFRFMIPPFIWKPMRFLDIGYEKGLRKAIDVVHGFVNKMIMDRICMVNDDETLDNRSVLTRIIQIESHKKGNEIGPSTIRFFRQFCTSFILAGRDTSSVAISWFFWVIQRHPQVENKIIQEIREILKQRGDPSDSSLFTVRELNNMVYLQAAISETLRLYPPIPMEMKQAIEDDMFPDGTFIKKGSRVYFSIYAMGRMESVWGKDCEDFGPERWIHAGKFVSGDQSKYVVFNAGPRLCLGKTFAYLQMKMIAASVLLRYSIKVAQDHVVVPRVTTNLYMKYGLKVTITPRSLEEKILESFHM

SEQ ID NO: 41147 - protein, 668 aa, Arabidopsis thaliana
MMAGPLLRSLWSNTTRRSFSSHSSPSKFGYSLSSLRSFSAATASTAAAGAPNSSLDPNRLRNVAVIAHVDHGKTTLMDRLLRQCGADIPHERAMDSINLERERGITISSKVTSIFWKDNELNMVDTPGHADFGGEVERVVGMVEGAILVVDAGEGPLAQTKFVLAKALKYGLRPILLLNKVDRPSVTEERCDEVESLVFDLFANCGATEEQLDFPVLYASAKEGWASSTYTKDPPVDAKNMADLLGAVVRHVQPPKANLDEPFLMLVSMMEKDFYLGRILTGRVTSGVVRVGDRVNGLRKTDSGSEKIEEAKVVKLMKKKGTTIVSIDAAGAGDIICMAGLTAPSIGHTVASAEVTTALPTVELDPPTISMTFGVNDSPLAGQDGTHLTGGRIGDRLMAEAETNLAINVIPGLSESYEVQGRGELQLGILIENMRREGFELSVSPPKVMYKTEKGQKLEPIEEVTIEINDEHVGLVMEALSHRRAEVIDMGPVPGNEGRTRLSLTCPSRGLVGYRCVFSSDTRGTGFMHRAFLTYEKYRDPLGNVRKGVLVSMARGTITAHSLMSLEARGILFVSPGLDSYDGMIIGEHSRETDLDLNPVKAKELTNIRSAGKDENVKLSPPRLMTLEEAIGYVASDELIEVTPKTIRLRKRCLDVNKRKSQSKRAKD

SEQ ID NO: 41148 - protein, 422 aa, Burkholderia sp. 383
MDRLAKKNEWFARAEKVIPGGMYGHQSVKYLTEDFPLYFAKAKGTHLWDVDGNKYIDYVCGYGTNLFGYGNERIEQAAALQLQKIDTATGPSEVMVQLAEALTQQVSHADWAMFCKNGSDATSMAMVISRAYREKRKILVARGTYHGASPWNVPYTTGITKEDRAHIVYFEYNDIESLNAAVKSVDGDVAAIYATPFRHEVLYDQFFPSIEYAKECRRLADEQEALLVVDEVRTGLRLSRDCSWSDWGVHPDLSCWGKAIGGGYAIAAVLGSDKAREAATNVFVTGSYWLSAVPMAAAIETLRLVRETDYLEHTKRLADKLRAGIAEQAERHGFELKQTGPSVMPQMLFAGDDELVSRGRAWASEVIKNGAYLHPWHNMFFTASHTDDDIARTLEATEVAFGAIKQKAVAVSRLDILDTVQR

SEQ ID NO: 41149 - protein, 487 aa, delta proteobacterium MLMS-1
MTPTANIRQVALQLLLAQEQSGQPVEQLLEHQLREHPLADGRDRRLLEALVYGVLRWRGLLDQVVAGYARHPLAKMKPLTLAALRLGILQLLILERLPASAAINETIKALRAARQPRWLTGFVNAVLRKAAADIERLGRQQYLAGLVAEGTAPTGQYASPDPLPMAVAAWLSHPPWLRQRWEQRYGLELCRELCHINNCLPPLVLRVNLHRLTASELLAQLQKAGIAATAGDYAPAAVVLPPGSGRVEDLPGYALGWFAVQDEAAQLVTMLLAGAGPGHYLDACAGLGGKTAHLAELLPPEATITALEPQSRRALLLTANLHRLGVTARLIQGELAAHLPAAELEAAGASHDKKGDTIPSPFLGFYRGILVDAPCSGLGVIRRHPDIRWNRRAAELKNYQRRQLELLSTAAELLQPGGVLVYVVCSFEPEENEEVIQLLLKRRPELRLSAPAPYLPVAARQLVRGDFFRSLPSDGLDGFFAARLVSV

SEQ ID NO: 41150 - protein, 537 aa, Zea mays
  misc_feature (214)..(214): Xaa can be any naturally occurring amino acid
  misc_feature (353)..(353): Xaa can be any naturally occurring amino acid
  unsure (1)..(537): unsure at all Xaa locations
MAPPPASPADSAPDPRPTASAPVPITVPSPRDHAHHHHLVDRRDTPRGRAWEPERNRRGEAMDGAAAVKLVPGEAGYVLEDVPHVSDYLPDLPTYSNPLQDNPAYSVVKQYFVNPDDTVCQKIVVHKDGPRGNHFRRAGPRQKVYFEPDEVHACIVTCGGLCPGLNTVIREIVCGLSDMYGVTKILGIQGGYRGFYARNTITLTPKSVNDIHKXRGGTSRGGHDTVKIVDSIQDRDINQVYVIGGDGTQRGAGVIFEEVRRRGLKVSVAGIPKTIDNDIPVIDKSFGFDTAVEEAQRAINAAHVEAVSAENGIGLVKLMGRHSGFIAHYATLASRDVDCCLIPESPFYLEGGXEGGLFRYIEKRLKDNGHMVIVVAEGAGQKLIAETMQSIGKDASGNELLLDVGLWLSQKINEHFKKNKMTINLKYIDPTYMIRAIPSNASDNVYCTLLAHSVVHGAMAGYTGFTIGQVNGRHCYIPFYRITEKQNRVSITDRMWARLLSSTNQPSFLCNKVVEEAKKEHERATRLLDGSPSHRKG

SEQ ID NO: 41151 - protein, 540 aa, Burkholderia sp. 383
MEKIWLDAYPPEVPAEIDSGAYRNISALIEQSFSKFHANPAFACDGKQITYGELDVLSRSLAAWLQSRGLERGARVAIMMPNVLQYPISICAVLRAGYAVVNVNPLYTPRELQHQLNDSGAEAIVILDGCTATLDAIIAHTQVKHVLVAAQGNAAAAEQTPSPHVKFDDAIEEGRRGKFVLASPSPDDVAFLQYTGGTTGVSKGATLLHRNIVANVLQTDVWLKPARDWRPDVTQFITVAALPIYHIFALNVCCLLTMHTGGLCVLVPNPRDIGGMIQSLAGYKVTSFPGVNTLFNAMLHHPEFSRLDLSNLLLANGGGMATQEAVARRWKEMTGAPIIDGYGLSETSPCVAINPVAGREFNGTIGLPLPSTEVSIRDDDGKELPPGAAGELCIRGPQVMAGYWQRPDETAKVMTADGFFRSGDIASISEDGFVRIVDRKKDMILVSGFNVYPNEIEEVVANHPGVFEVAVIGVPDEHSGEAVKLFVVRKDPELTFDDLMAFCKGQLTGYKRPKSIEFRDSLPKSNVGKILRRELRVPNN

SEQ ID NO: 41152 - protein, 454 aa, Prochlorococcus marinus str. AS9601
MEFEFDLIVVGAGSGGLAAAKRAASYGAKVAIIEANQIGGTCVIRGCVPKKLMVYAAKSKKNMDSSEGYGLKNEGINFESNILLKNVREEVSRLSNLHRSSLKKLNITIFEGLGRFITQNELEIICSNTKKIKNKISSKKILISVGGKPKKLNIPGVDLAWTSDDIFELEKFPKSILIVGGGYIACEFASIFRNLGTEVTQLIRGQHLLNGFDEDLSSCLEESPTFADINIIPNTQLNSIKKVNGNLESTLDSGDKLLTNNILIATGREPNLLPLNLDFLNLKMDGQYLDVDELNQTSNANIFAVGDIINKPNLTPVAIEQGRVFSDNFFNDQKRKVNYEYIPKAVFTIPEISTVGLSEKRAKEIYSEKNIKIFKCKFTPMSNTFKKNKSKCMLKIVVHKLTDKVLGCHMFGETSSEIIQMVSISLNAGITKKDFDITMALHPTISEEFVTMYG

SEQ ID NO: 41153 - protein, 1149 aa, Mycobacterium smegmatis str. MC2 155
MFVTEDGGSGPRVIYSASDLAAAARCEYALLRAFDAQLGRGPAVSSEDELLKRTAQLGGEHEQRHLDELREGSEITVIGRPRYTVPGLTAAANATLAAVTQRAPVIYQAAMFDGRFAGFADFLILSDGQYRLRDTKLARSVKVEALLQLAAYSETLSAAGVPVAPEVELVLGDGAVATYPVDELLPVYRPRRAALEHLLDAHLASGEPVSWEDTEIRACFRCPECEVQVRAHDDLLLVAGMRTSQRARLIDAGITTVADLAARRDDEPVEGLHPRIAQGLTAQARLQRAPRTGKKPPYEVVDPQPLMSLPNPDRGDLFFDFEGDPLWTDDGVQWGLEYMFGVLGTAPRADEDFHPLWAHNRREERQALRDFLALVRKRRKRHPHMHVYHYAAYEKTALLRLAGRYGEGEDEVDELLRAGVLVDLYPLVRKSIRVGTENYSLKSLEPLYMGAQLRDGDVTTATDSITQYGLYCTLRAEGRDDEAALVLKEIEDYNLYDCVSTRKLRDWLINRAIECSVPPLGAQPVGRDTAPEPEDQIARTLRRFVGDDERTPQQQAVAMIAAARGYHRREDKPFWWSHFDRLNHPVEEWSDGAGVFVADTAHVEVDWHTPPRARKPQRWVRLTGAMAAGELSREMYALYEPPAPSGLTDDPERRAFGSVQVLEADDASAPTEVLICEREPKEGGTFHQLPFALTPGPPIRTTALQNSIEATAAQIAEGLPRLPGNAVVDILLRRPPRTRSGGPLPHGQAAKHELITAALLDLDSSYLAVHGPPGTGKTFTSAAVIARLVNRHHWRIGVVAQAHAVVENLFRDVIAADVPADAVAKKPHGDNACWTELSEKEYPDFLDQHTGTGCVIGGTAWDFANPVRIPPGSLDLLVVEEAGQYSLANTIAVAPAAHNLLLLGDPQQLPQVSQGTHPEPVDTSALGWLVDGHHTLPAELGYFLDCSYRMHPAVCAAVSRLSYDNRLRSVDDVTAARHLDGQEPGVHVLLVDHDGNATDSPEEAQVIVAEIRRLLGAAWTDERGTVPLGQDHVLVVTPYNAQVVTMRRYLDAAGLTDVRVGTVDKFQGQQAPVVFISMVASSVDDVPRGISFLLNRNRLNVAVSRAKYAAVIVRSAALTEYLPSTPAGVVELGAFLALPDALPDALNTV

SEQ ID NO: 41154 - protein, 560 aa, Psychrobacter arcticus 273-4
MPNQRPLYIPFSGPALLETPLLNKGSAFSSEERDSFNLTGLLPHNIETIEEQSLRAYHQLRSFTTDIDKHIYLRNIQDTNETLFHHLIEQHIEEVMPLIYTPTVGQACEKFSQIYRRKRGLFISYPDRHKIDDMLQNATKQKVKVIVVTDGERILGLGDQGIGGMGIPIGKLALYTACGGISPAYCLPILLDVGTNNQQLLDDPMYMGWRNQRISGDEYNEFVDLFIQAVKRRWPEVLLQFEDFAQENATPLLNRYRDQLCCFNDDIQGTAAVSVGTLIAACLNKGQKLSQQKIAFLGAGSAGCGIAEHIIRQMQREGLTEEQARKQVFMVDRYGLLTDSMTELQKFQAPLVQKESAIESWDKSQKLGLAQVVKQAKITVLFGVSGQKGLFTREVIEALCVNTEHPIVLPLSNPTSRVEATPQEVTSWSRGKAIVATGSPFPNTTFEDQSFEISQCNNSYIFPGIGLGVLAAHATGISDNMLMSASQALADISMEYEKAPGAILPPIKFIREISEKIAYAVALQAIEDKLALPVTAENLERRLKANFWLPRYHNYRRTSF

SEQ ID NO: 41155 - protein, 150 aa, Zea mays
MSLRCSGLYLSRFRRTSPHLLASGDGKRTATIVGDVYIHPSAKVHPTSKIGPNVSISANARVGAGARLINCIILDGVEIMENAVVIHSIVGWKSSIGKWSRVQGEGDQNAKLGITILGEAVDVEDEVVIVNSIVLPNKTLNVSVQEEIIL

SEQ ID NO: 41156 - protein, 506 aa, Antirrhinum majus
MSTLVYSTLFILSTLLLTLLTRTRRKTRPPGPLALPLIGHLHLLGPKLHHTFHQFSQRYGPLIQLYLGSVPCVVASTPELAREFLKTHELDFSSRKHSTAIDIVTYDSSFAFAPYGPYWKFIKKLCTYELLGARNLSHFQPIRALEVNSFLRILYEKTEQKQSVNVTEELVKLTSNVISNMMLGIRCSGTEGEAEVARTVIREVTQIFGEFDVSEIVWFCKNLDLQGIRKRSEDIRRRYDALLEKIISDRERLRLRGGGGGGGGEVKDFLDMLLDVMESEKSEVEFTREHLKALILDFFTAGTDTTAITTEWAIAELISNPNVLKKAQEEMDKVIGSQRLLQESDAPNLPYLNAIIKETFRLHPPIPMLTRKSISDVVVNGYTIPAKTLLFVNLWSMGRNPNYWENPMEFRPERFLEKGTGSIDVKGQHFELLPFGTGRRGCPGMLLGMQELFSIIGAMVQCFDWKLPDGVKSVDMTERPGLTAPRANDLVCQLVPRIDPVVVSGP

SEQ ID NO: 41157 - protein, 388 aa, Arabidopsis thaliana
MMISDLPHDLESEILSRVPAKSLAKWKTTCKRWYALFRDPSFVKKNFDKAGGREMIVLMNSRVYSNSVNLQGINNRFDPSMEVTGKLIKLNDSKGVDISAIFHCDGLILCTTTESTGLVVWNPCTGEIRCIKPRIFYRCNDRYALGYGNSKSSCHSYKILRSCCYYVDQNLSLMAAEFEIYDFSTDSWRDLGDITRDMIVYSSGVSLKGNTYWVSGSKEKGFFMRYFDFSKEVFGRLPLPYQSFNANHTAALSAVGNEKIAVLQQKILAMSDEMRIWVTNKIDEAKDLSWSNFLLTVDYGKFNLPCLVNVTSFLLDEENKVAVCSDVDTKDGLRSRIYIVGKDFYKEVFKDTRGSDNNWPLLLCYVPSLVSIQENIPNKAEENEIKGG

SEQ ID NO: 41158 - protein, 396 aa, Arabidopsis thaliana
MRKTMVISDLPHEIESEILSRVPTKSLAKLHTTCKRWYALFRDPRFVKKNFGKSERRLMLHSNFGVYKITDDLHGILNSGDPSLEFTSKLSNLKISEDLTITKIFHCDGLILCSTKENTRLVVWNPCTGQTRWIKPSKRYRSDDSYCLGYVNSKSSYHNYKILRYCFYYNDQDACVSEFEIYDFSSESWRVLDDYCTREWGLFCHGMSLKGNTYFVAGEKETGFFMLYFDFKTERFERLPLPYQSFDSEDTAVLSIVGGEKLAVLHQNIQSFSNEMRIWVTNKIDEAKDLTWSNFFLAVDYDIFNLPSVNNVTSFLLDEENKVAVCCDRHIDDEDKTRIYIVGVDLYKEVYKERTKGAHFNWPLLISYLPSLVHIQEKYPKDKRKGNKRRLVKRIT

SEQ ID NO: 41159 - protein, 512 aa, Torenia hybrid cultivar
MDTVLITLYTALFVITTTFLLLLRRRGPPSPPGPLSLPIIGHLHLLGPRLHHTFHEFSLKYGPLIQLKLGSIPCVVASTPELAREFLKTNELAFSSRKHSTAIDIVTYDSSFAFSPYGPYWKYIKKLCTYELLGARNLGHFQPIRNLEVRSFLQLLMHKSFKGESVNVTDELVRLTSNVISHMMLSIRCSEDEGDAEAARTVIREVTQIFGEFDVTDIIWFCKKFDLQGIKKRSEDIQRRYDALLEKIISDRERSRRQNRDKHGGGNNEEAKDFLDMLLDVMESGDTEVKFTREHLKALILDFFTAGTDTTAIATEWAIAELINNPNVLKKAQEEISRIIGTKRIVQESDAPDLPYLQAIIKETFRLHPPIPMLSRKSTSDCTVNGYKIQAKSLLFVNIWSIGRNPNYWESPMEFRPERFLEKGRESIDVKGQHFELLPFGTGRRGCPGMLLAIQEVVSIIGTMVQCFDWKLADGSGNNVDMTERSGLTAPRAFDLVCRLYPRVDPATISGA

SEQ ID NO: 41160 - protein, 85 aa, Zea mays
HDHHHSHSHDDHHHHSHGDGGGHAAGGSWVGEDGRVWHSHDGLAPHSHEPIYSPGDFTKRAPPLASRDFADRAFTVGIGGPVGTG

SEQ ID NO: 41161 - protein, 722 aa, Psychrobacter arcticus 273-4
MIKKIVLIFAVLIGVIGFFYFDLNELLTLEGLKGSMDQFEQYKTQSPWLVIGGFFVVYILVTALSLPGAVILTLAAGALFGLVQGILVASFASSIGATLAFLTSRYLLRDTIKQRFPDRLASIDSGVKKEGGFYLFTLRLVPIFPFFLINLLMGLTAIKVRTFYWVSQIGMLAGTFVFVNAGTQLAKIEQLSGILSFNLLASFALLGLFPLIAKGILTILKKRRIYKNHTKPKKFDRNMIVIGAGAGGLVTSYIAATVKAKVTLIEAGEMGGDCLNYGCVPSKALVKSAKVVEQIRHGKRYGLNNTQPDFAFKNIMSRIHEVIADIAPNDSVERYTSLGVEVLKGYAKLIDPWTVEIALNDGGTQTLTARSIVIATGARPFVPDLPGLEETGYVTSDTLWDKFAKFDKVPSKLVVLGGGPIGCELAQSFARLGSAVTQIERGARLMKKEDVDVSVFAQEALTESGVNILTSQQAIRCETRNGKKYIIVAPKGGNDDQQETAIEYDELICAVGRSARLEGYGLDTLGIDTERTISTDEYLETLYPNIYAAGDIVGPYQFTHVAAHQAWYAAVNGLFGHLKKFKVDYRVIPWSTFIDPEVARVGLNEQEAINKGIDFEITRYDFKDLDRAVTESANHGFIKVITPKGKDKILGVTIVAEHAGDLMAEFVLAMKHNLGLNKILGTIHIYPTWAEGNKYAAGEWKRNHAPKKALQLLEKYHTWRRG

SEQ ID NO: 41162 - protein, 1072 aa, Clostridium thermocellum ATCC 27405
MPKRDDVKKVLVIGSGPIVIGQAAEFDYAGTQACRALKEENIEVVLVNSNPATIMTDTNIADRVYIEPLTVEVVKKIIIKEKPDSILPTLGGQTGLNLAMELAESGFLKEHGVKLLGTATEAIKMAEDRQAFKDTMERIGEPCIASKVVNTVEDALDFAKEIAYPVVVRPAYTLGGTGGGIAYNEEELKEIASNGLRLSRVHQVLIEKCIAGWKEIEYEVMRDSKGNVITVCNMENIDPVGVHTGDSIVVAPSQTLTDREYQMLRSSALKIISALGIEGGCNVQFALNPNSFEYAVIEVNPRVSRSSALASKATGYPIAKVATKIAIGYGLDEIKNAVTGKTFACFEPTLDYVVIKIPKWPFDKFVKAKRTLGTQMKATGEVMAISSSFEGALMKALRSLELGIFTLEQDIYKKFSAEEIRQKIKDVSDERILVIAEAIRRGVTVEEINNVTKIDLFFLNKIKNLVLMEEKLKTMKLSDFDEETLRTVKKMGFTDAVIAKYVGCDKKEVTAKRKELGICAVYKMVDTCAAEFEAMTPYYYSTYDECCEAKKSDKKKVLVIGSGPIRIGQGIEFDYCSVHSVWGLKQEGYETIIANNNPETVSTDFDTADRLYFEPLTPEDVENIVEKEKVDGAIVQFGGQTAIKLTKALVEMGVKVFGTEPKYIDAAEDREKFDRILEELGIPRPKGKTIFTLDEALEAANELGYPVLVRPSYVLGGQGMEIAYNDKDIVEFMEIINRVKQEHPILIDKYMMGKEIEVDAISDGEDILIPGIMEHLERAGVHSGDSISVYPTQTIGEKLKEKIVDYTQKLAKALRVVGLINIQYVYYNNELYVIEVNPRSSRTVPYISKVTGIPMVNIATRIMMGKKLKDFNYGTGLYKESEYVAVKVPVFSFEKLHDVDTSLGPEMKSTGEVLGIAKTFPEALYKGIIATGIKLPKKGGAILMTVRDTDKPELVQLAEEFEKLGFELYATGKTANMLNNQGIATNAVKKIGEGEPNLLNLIESGKISLIINTPTKGRQPERDGFKIRRKAVEMSIPCLTSLDTARAVLECIKLEKEEKDLEVIDLSVFDNQ

SEQ ID NO: 41163 - protein, 967 aa, Colwellia psychrerythraea 34H
MVDIYDPKAAQNQSTRSQNIIDFGTPEVYSDVQVTLTIDGQEISVPKGTSVLRAAAMLNITIPKLCASDNLESFGSCRLCAVEIEGRRGMPASCTTPVEHDMQVSTQNKKIARLRKNIMELYISDHPLDCLTCPSNGDCELQDMAGAVGLREVRYGFDGENHLDVAKDTSNPYFTFEPSKCIVCSRCVRACEEVQGTFALTIDGRGFDSKVSTGLDNDFLSSDCVSCGACVQACPTSTLMEKSVIDQGQPEHSVTTTCAYCGVGCSFEAHMKGEEVIRMVPAKDGQANHGHSCVKGRFAFGYATHQDRITSPMVRDSIDQPWQEVSWDEAISFAAKRLKEIQKKHGKDSIGGITSSRCTNEETYLVQKLIRAAFGNNNTDTCARVCHSPTGYGLKATLGESAGTQTFDSVMEADTIIVIGANPTDAHPVFGSLLKKRLRQGAHLIIADPRKIDLGNSPHVKLDHHLPLRPGTNVAFINAMAHVIVNEGLEDKAFIAERCETQAYQQWYSFISDVRHSPENTETITGVDADQLRQAARLYAKVDNGAIYYGLGVTEHSQGSSMVMGIANLALLTGNIGREGVGVNPLRGQNNVQGSCDMGSFPHELPGYQHVSNDALRSKFEQHWQVDIDNEPGLRIPNMFDAAIDGSFKGMYCQGEDIAQSDPNTHHVEAALTSLECLIVQDIFLNETAKFAHVFLPGSSFLEKDGTFTNAERRINRVRKVMAPLAEKADWQATMALSNALGYPMNYQHPSEIMDEIAQLTPTFSGVSYQKLDELGSIQWPCNDSNPLGTPTMHIDDFPIGKATFALTEYVATDERASRKFPLLLTTGRILSQYNVGAQTRRTENQVWHDKDQLEIHPHDAQERGIQGGDSLGISSRAGNTVLTAKITERMQPGVVYTTFHHPESGANVVTTDNSDWATNCPEYKVTAVQVEKVSSPSNWQLRNKEFSIKQNEFLPKKRSDEARVKL

SEQ ID NO: 41164 - protein, 324 aa, Methanosarcina acetivorans C2A
MMLMMLIDEIKKRSSHVDAAINELLPVTHPEELYKASRYLVDAGGKRLRPAVLILAAEAVGSDLKSVLPAAVAVELVHNFTLIHDDIMDKDNIRRGMPAVHVKWGEAGAILAGDTLYSKAFEILSKVENDPVRILKCMDVLSKTCTEICEGQWLDMDFEKRDRVTELEYLEMVEKKTSVLYAAAAKIGALLGGASDEVAESLSEYGRLIGIGFQMYDDVLDMVAPEEVLGKVRGSDLMEGKYTLIVIEAFGKGVTLDIFGKGEATVEETEAAVRTLTECGSIDYVKNLAISYINQGKAKLDVLRDCPEKDLLLQIADYMIAREY

SEQ ID NO: 41165 - protein, 2218 aa, marine gamma proteobacterium HTCC2143
MQMDTMDCNNAGGYHGTIQSRFSDQVNKTPNKLCLRTPATPERAGWALSYRDLDHWSDSLASRLLSVGVVAGDRVGLCAERSASAIAAMVAIAKISACYVPLSPEYPRSRLDLMIEDAAISVAFMASAAVDVMCGSGLKILPLEDSPSPGEEELESVLEPGQGEDPAYILYTSGSTGRPKGVVVPHCSILRLVSPKNTYCQFDDQRCFLQLAPLSFDAATFEIWGALLNGACCVVVPGRVMPSYERLAEILAEGITTLWLTSSLYNTIISDAPESLRSVKQLLIGGEALSVTHVRKGLDALPDTQIINGYGPTENTTFTVAYPIPRNFPGTLKKIPIGFPIHATYCEVFDSELKPVADGTKGELIAFGDGVALGYLNRPDLTAERFLELECRDGVTRRGYRTGDIVIRLENGCYDYLGRNDMQVKIDGHRIEPQEIEVFINQLEQVADARVLVKAGPQGQQRLVAYIVGVGELDPGAIRSCVADEFPAFMVPHFIVPLEKLPKNQNGKLDEACLPDPFVSKQSVAGASQQVANCWLKILGRSVGENDNFLDAGGTSLEALRLTELFEKEFERDLQATFVFEYPSVRRQAQFFAQDNSQPAAEIGSISRSGVGQQDIAVIGIACRFPGANNLEEYWDNLVNGRETISFFTEETLSSEVDEAERNHPNYVRARGIVEDCDQFDAAFFGISPAEAAIMDPQQRIMLQLAQHALEDAGCKPGDETLRTGVFAGMNWARYFQQYVLNNEEVKRKFGLFNASLANESDFLSSRISYKLNLTGPSVNVYTACSTGLVAISQACTSIERGDCEMALAGGVSITTPVNSGYMYQEGSMLSKDGHCRPFDAAATGTTFNDGAGFVVLKRLDLALRDGDNIYAVTKGFAVNNDGGNKASFTAPSVAGQVAVYNSALAKAAVSPESIGLIETHGTATPLGDPIEVTALNRSYGGGRRGESCVLGSVKSNIGHTIHAAGVASFIKIVMAVNRGLIPPTLHFENPNPKLELEKTPFYVNKKLLDWNSEGPRRAAVSSLGVGGTNAHIIVEQFKSPLQVPSESAGKDSATPHPGFSVLLSAKSKQALENQVANYQRFFETQPAGYSVADAAYTSRVARQHFPYRAAVTGTTAAELADKLADKKRFATGRAKNVTGSVQGFMFSGQGSQRQLMGHWLYEQNEDFRGMVDRGSKIVLQQQGFDPRSIITDGGKHQDINLDVNQTKIAQPLLFLFEYGLARYLQSCGFQPDFLIGHSIGEFAAAALAGIFSFDDAVKLVAARGALMQSMPPGKMLAVKAGPDEVDDLLATGLGLAAVNAPDRIVLSGPEDIIQAAMEKLTKAKIASSILHTSHAFHSEMMDPIIAGIEELAASIKKHPPTLPVFSTATGELMTDQQATDPAYWAMQLRQPVLFADAVTATREYYQGQAIALVEVGPGVALSSLLACQNAEAKNTVIPAATGSAVGEEFVQEFSQCINGLWASGFKVDWASHFSGINVQKTRLPGYAFQRDKHWLSLSKEDAATPQISAAPVNTASPQQLIAPIQEVTMSTEQHRQAMERKLRELLEDVTGSDLGDVEADDHFSEAGLDSLLLTQVATAIEQEFAIGLTFRHLVEDYTSIGELSDFVASEVAPEKSQVQVPAAGEGIPVSQGMPPQIPPAFVASTSDDAVQQLFQQQLQIMQLQLQVLGGAAPSVMPAIQPTVASENTAESTLVAKEDGADKKVARQTPGTRIVREKLGVELTRAQQLWIDEVMDSYQKKYAGSKKYTQTHRKYLADPRTVSGFNPEWKEIVFPIVTERSKGSKLWDIDGNELIDTSNGFGPIFFGHSPDFITDAVKQQLDLGIETGPQSPLAGEVARLFCELTGNERCTFASTGSEAVVGAIRLARTVTGRKKVAMFGGSYHGITDEVINRAGKDYQALPAAPGISRETTSNMLVLPWADPESLEVLKKLGPELAAVLVEPVQSRMPEFNDQNYLKEIRSITQDCGAAMILDEVVTGFRVAAGGIRERFDIDADLGTYGKVVGGGYPIGIIGGKAKFMDALDGGHWQYGDDSIPEAGVTFFAGTFVRHPLALTAAKAVLDRIKADGPSLYEGLEKKTSLMTAEAKSFIEQMKCEVSFESFTSLFYVSVPESAHWGHMLFLLMTLEGIHIQQYRPNFLTTEHNKEDVDKILIAFKKSLAKLISNGLIEGDMVVAKRFLNEKSRIPKGARLGKNAQAEPAYFLEDPDNNGKYIEVGRP

SEQ ID NO: 41166 - protein, 883 aa, Methanosarcina acetivorans C2A
MSKFVYFFGKDVTDGKSSMKDLLGGKGANLAEMANLGVPVPPGFTITTEVCVLYLNEKKYPEEVLSQVEEAIDKLEALNGKKLGDPEDPLLVSVRSGARVSMPGMMDTVLNLGLTDKSVIGLANKVNDERFAYDCYRRFIAMFGDVVLGVEFRKFDSLIGDKKKELGAKSDTELDSKALKELAERFKEVIKLEKGFEFPQDPKVQLQMAVDAVFDSWNNQRAITYRKLNNIGDGWGTAVNVQTMVYGNRGNTSGTGVAFTRNPSTGEKKFFGEYLINAQGEDVVAGIRTPDYIDTLGNKIPEAYAQLVDICQKLESHFKDMQDIEFTIQEGKLYMLQTRTGKRTAAAAVKIATDMVEEGLIDKETAVNRVNAEHIDLLLHPRIDPEAKLEIIATGLPASPGAAVGKVVFTAEAAEEMAEIGEKTILVRTETSPEDIGGMAAAQGVLTVRGGMTSHAAVVGRGMGKPCVVGCGEISIDIKSSLFMVNGFTIKEHDYITIDGSIGSVILGKTDLIDAEINEDLKKLLIWADEIRTLGVRTNADNPADAALARELGAEGIGLCRTEHMFFGEDRIPAVREMIMSEDEKARKKALKKLLPMQKEDFLGIFRSMEGLPVTIRLLDPPLHEFLPDKEELDEKLRELETSGDCGKIEDVKKVIQRVVSLKELNPMLGHRGCRLGITYPEIYNMQVRAIMEAACELTAEGLKVIPEIMIPLVGLVKELSLTKEEVCKTAETVMTEKGMKIDYKVGTMIELPRATIVADQIAREADFFSFGTNDLTQTTFGFSRDDVSKFVPIYQKAGILEHDPFAVLDQEGVGELMKIGIQKGRSVKPKLKMGICGEHGGEPRSITFAHGIGIDYVSCSPYRVPIARLVAAQSTMQMRNAK

SEQ ID NO: 41167 - protein, 349 aa, Polaromonas sp. JS666
MRALVCHAPLDLRFDTFVSDQPGPTELGVRIAYGGICGSDLHYFQHGGFGTVRIREPMVLGHEVSGAIESVGSAVTQFQVGQRIAVSPSRPCGTCRYCNLGLQNHCMEMRFYGSAMRFPHVQGAFREHLVIDASQAHLVADELPLAEAALAEPLSVGLHAITRAGSVFGKRVLVTGCGPIGLLLIAGLRRAGAAHIIAADIADVPLVCAATLGADETINLARHPGGLAPYALNKGMIEVMFEASGSDKALRGGLDVMAPRGVVVIVGLGGDISVPMNLLVAKELDVRGTFRFHQEFAVAVRFLNQRLIDGRPVITHTLKFDQAADAFKLAGDKGRALKVLIDFNAPAAA

SEQ ID NO: 41168 - protein, 239 aa, Brassica napus
  misc_feature (219)..(219): Xaa can be any naturally occurring amino acid
  unsure (1)..(239): unsure at all Xaa locations
RYDLSSGRMMLSGAATLKKELEDAGRLKFPNAIFGQGYGMTESGTVAKSLAFAKNPFKTKSGACGTVIRNAEMKVVDTITGVSLPRNKPGEICIRGDQLMKGYLNDPEATAVTIDKDGWLHTGDIGFVDDDDEVFIVDRLKELIKFKGYQVAPAELEALLISHTYIEDAAVVAMKDEVADEVPVAYVVRSEGSQLTEDDVKSYVNKQVVHYKRIKKVFXIEAIPKAGSGKILRKELRAK

SEQ ID NO: 41169 - protein, 272 aa, Polaromonas sp. JS666
MSIFMSTPTSTPTSTPMSTSNPFRLDGRLALITGSSAGIGFALARALGQAGATLVLNGRDAGRLEQAAGVLRSEGLQVHTRMFDVTQAEAVEAAVQDIESTLGAIEILVNNAGMQRRMPLHEFSTEQWHELMRTNVDSVFFMGRAVARKMIERRRGRIINVCSVQSELGRPNIAPYTASKGAVKMLTKGMAIDWGPHGINVNGLGPGYFRTELNEKLVADEQFNAWLIGRTPSRRWGNVEDLGGAAVFLASDASSFVNGHILYVDGGVTATL

SEQ ID NO: 41170 - protein, 583 aa, Acinetobacter sp. ADP1
MQQWARFAILGAMFVTAYLLILAWQKDYGHANTAVQPQAAAVVSHDVSADLPNSQSTAAASSDVPQANIAAQQTPAATSTAASQQLISIQTDLYHLWINPKGGDIVRIELLNHDQSKNSDQPFVMLESDAKRTYVAQSGLIGLNGPDSSRGGRPVFDVEKSAYTLTDAKETKDKDGKLVKTLTVPMVYKTTDGVEIIKRFTFKQGDYPIVVSYQVVNRSPQNWQGQMFGQIKRDNSEDPGKSDQGIFTLGTFLGGAWGTPEEHYNKLKFANFSDEKLNVEAKGGWVAMVQHYFVSAWIPGHFGDQAYTAKLESRKSADNMNIIGFTSPTINVPAGKTMTVDATFYSGPKIQSELKDLAVGLNQTVDYGWLWPIAKLLFIGLQFFHNIVGNWGWSIILLTVLVKLILWPLSSKSYRSMAKMRVIAPEMQRMKEEFGEDRMRFSQEMMALYKREQVNPLSGCLPLLLQMPIFLALYWVLMESVELRHAPWMLWIQDLSAMDPWFILPLLMGATMFIQQMLNPQPADPMQAKVFRIMPIIFTVFMLFFPAGLVLYWIVNNTITITQQWFINKSVAKARENKVETTS

SEQ ID NO: 41171 - protein, 208 aa, Oryza sativa (japonica cultivar-group)
MAVAIEAPFHVLAVDDSLPDRKLIERLLKTSSFQGLAFVCVVTTVDSGSKALEFLGLHDHEDSPISTQSDQQEVAVNLIITDYCMPGMTGYDLLKKIKESSYLRDIPVVIMSSDNIPSRINRCLEEGADEFFLKPVRLSDMSKLKPHILKSRCKEHYQQEQNLQSNSESNNSSNPTSENSSSSTSSNSHKRKAVDEEILPHTIRPRHS

SEQ ID NO: 41172 - protein, 184 aa, Polaromonas sp. JS666
MTEESGERTFVPRVMEPDIFVVMGVSGSGKSTVASQLATRLGLEFIEGDELHSAENVARMAAGVPLTDADREGWLKVLANRIREARLAGRGLVLSCSALKRSYRDVLRQGSPAVRFVYLHGERALLAERMAQRAGHYMPATLLDSQLATLEAPDASENALAFNITTPPDVIAAAVAMTVSHRTE

SEQ ID NO: 41173 - protein, 255 aa, Magnetococcus sp. MC-1
MRRALIAGNWKLNGTTQAATALATAVRDGVAANKPDCDVLVCPTFTVLSAVQGVVAGSGVDLGAQNMAVASSGAFTGEISGEMLKDVGCSYVILGHSERRTLFGETNEQVAQKVASAYRDGLTPILCVGETLEQREAEQTMQVLEQQLLACLPVLPADAAKQQQLVVAYEPVWAIGTGKVASTAQAQEAHAFIRGLLAKELGANVADAVRILYGGSMKPDNAKELLGQADVDGGLIGGAALKANDFLAIMDGLTA

SEQ ID NO: 41174 - protein, 397 aa, Zea mays
  misc_feature (304)..(304): Xaa can be any naturally occurring amino acid
  unsure (1)..(397): unsure at all Xaa locations
MDFSAGGSGSGGGGGGAGDGRAQAERWLEIAEKLLAASDLVGCKRFAERALEADPLLPGADEILAVADVLLASQSMGPSGHQDPLAILQLPPGVNPDQASVSRAFRRLALLLGPRNPHHGAEMALRLVNDAYAFLSDPSRRPPPPANPATGTPSSSHYAAAPAPDPREFWTACPFCCYVHQYPRDLVGRALKCPNEGCRRGFVASEIPTPPTVVPGTDMYHCAWGFFPLGFPNAADLGANWKPFYKAFPWNTAPSGQGADGRSHGNRGGRQAQNDSARGGSSRGRIKKTTARKKVGAGLRRRSXGGGVESGIDSSMLGQEGWAGDEDGGDGRTEEVRGININEAAQATDGTGRVNVSGAGGVEDMGNFHIDVDATEDILGNLHNLPFLRVDNLGRMI

SEQ ID NO: 41175 - protein, 396 aa, Magnetococcus sp. MC-1
MNKRTIRDIDIKGKRVFMRVDFNVPLNEDGTVRSDKRIQGALPTIRYAIEQGAKVILASHLGRPSGDKFEPEFSLKPAGEALAALLGQPVKLAPDCVGAEVEAMVAAMQDGDVVLLENVRFHKGETKADVELSKGFAKLADVVVNDAFGTAHRAHSSNVGITEFVRPAVAGFLMADEMDYFDKVLGAPERPVMAILGGAKISGKIDVIEALLDKMDKIIIGGGMSFTFFKAMGYEIGNSLCEDEMLPVAEKTLAKAKEKGVSLILPVDCVAADAFREDANTQICSVEALPAGWMGLDIGPESVKLFAKALEGVKTVIWNGPMGVFEMAPFASGTNHLAHLLAESDCLSVIGGGDTAAAVKQAGVAKQLSYISTGGGASLELMEGKQLPGITSLDDK

SEQ ID NO: 41176 - protein, 119 aa, Nocardia farcinica IFM 10152
MTKPVVEFQAGPPPTELVVKDIIVGEGKEAVPGGTVEVHYVGVEFDTGEEFDSSWSRGESITFPLRGLIQGWQDGIPGMKVGGRRQLTIPPELAYGPAGSGHKLSGKTLVFVIDLLNAN

SEQ ID NO: 41177 - protein, 700 aa, delta proteobacterium MLMS-1
MKVWPGTPYPLGATYDGTGTNFSLFSSIAEAVELCLFDADDNETRINLPEVTGYCWHGYLPEVEPGQRYGFRVHGPWQPEAGHRCNPAKLLLDPYVKAIAGDIAWDEALFPYRFADGPDSRDDRDSAPFMPRCVVHQPYFDWSGDRRPLRPWHKTVIYETHVKGFSKLHPEIPEELRGTYAGLAHPVAVAYLQELGITAVELLPIHQFIHDKHLIDKGLRNYWGYNSLAFFAPHHEYAADRRPAAAVAEFKQMVKSLHQAGIEVILDVVYNHTGEGNHLGPIISLKGIDNAHYYRTMADDPRYYMDYTGTGNSLNMRHPHVLQLLMDSLRYWVLEMHVDGFRFDLASTLARELHDVDKLSAFFDIIQQDPVISQVKLIAEPWDIGEGGYQVGNFPPGWSEWNGKYRDCLRDFWAGRDKSLGEFAYRFTGSSDLYANDSRLPFASINFITAHDGFTLRDLVSYDHKHNEANGENSLDGNDHEGSWNCGAEGPTDDPGILALRARQQRNFLATLLFSQGVPMLLGGDEFGRSQQGNNNAYCQDNEISWYDWENIDEELLAFSRRLLAYFHEHPVFRRRRWFQGRAIHGPEVTDIAWFNHLGEQMAEEHWGEDHAKSVGIFLNGRTIPNPNPKGEPVTDDSFYLLFNAHYEDLPCRLPAAAWGERWLLELDTARGWLAKPEPLAAGADFTVAARALVVMRLPN

SEQ ID NO: 41178 - protein, 413 aa, Arabidopsis thaliana
MRSEITRETKLLFDLPQDVIEEIFSKVPVTCLRRIRSTCKRLYALLKDRGFIRKHFAKSARQYHALMLKNFRFYSVSFNPNGTEMDVASLFNGERSLIDPYSSSEAIISQAFHCDGLLLCTTKENRLVVLNPFSGQTKWLQPQNRCKIDEAYVLGYDNSDLCHSYKILSFPDLYEQELETIKNAGRDLDVTPEGDLELKTDDFSSNSWRRNLGVTPHGGLGLKIYDFSSNSWKKLDVITPEGCLKSYGVSLKGNAYWVYMSKRRGVNDYSLLSFDFSTESFQHLCVPFHQEADCFGTMALSVVREEHLSLLYQSCETLKVEIWMTKEIDTTFVSWKKFLTVDLEPHLPHLLMFSCRMSFFIDEEKKVAVCCDRDNKVHVVGEDEYRVSSGFYFLDFEGITCCLTVFGYVPRLV

SEQ ID NO: 41179 - protein, 381 aa, Arabidopsis thaliana
MFTDLPRDLETEILSRVPATSLQKLKPTCKRWYTLFKDPEFLKKHVGRAEREVISLMSLRVYSLSVNLSGIHSSVEMTGMLNSLKDSEDVKISDITECNGLLLCTTDDSRLVVWNPYTGETRWIPYKSNSPYEMYQKFVLGYDNTNKSRYSYKILRCYHGLIDFGYEFEIYEFNSHSWRRFYDNSPNCSFESKGVTLKGNTYWFASDTEGRHIILRFDFATERFGRLSLLYQSGGYVDNVVETGVLSAVREEKLALLYERFDELNDSSEMKIWVTNTKIVEAKDLSWSDFLVVDSSKFMVTRMTNVMSFLVDEEKKMVVVCDTDIDQHMNRFYIVGEDIYKEVYKDIAQGWFSYWPLLISYAPSLVQIQQGKVIPGGKRKR

SEQ ID NO: 41180 - protein, 125 aa, Wolbachia endosymbiont of Drosophila melanogaster
MTNLLKKFNEQQMQVLAKEIPEFRPGDDLKVTFKVVDGTSERIQIFEGVCISKRNRGLHSSFAVRKVSHGESIVSQFFVYSPALVSVQVTRKGKVRRAKLYYLCKLFGKAARIKERTTYVKKKSK

SEQ ID NO: 41181 - protein, 273 aa, Triticum aestivum
  misc_feature (180)..(180): Xaa can be any naturally occurring amino acid
  misc_feature (198)..(198): Xaa can be any naturally occurring amino acid
  misc_feature (202)..(202): Xaa can be any naturally occurring amino acid
  misc_feature (213)..(213): Xaa can be any naturally occurring amino acid
  misc_feature (218)..(218): Xaa can be any naturally occurring amino acid
  unsure (1)..(273): unsure at all Xaa locations
MDPKLVEVTQLFDRFKAAFKASNFDVCSTLLSQLKVLLTKFPSLPPVFQQTPNAVEELKLAREIYEQAVILSVKMEDEDAFERDFCQLKPYYMDTCGIIPPSSEEYPIMGANLLRLLVQNRIAEFHTELELLPAKALDNAYIKHGVELEQSFMEGAYNRVLSARQTAPHETYIYFMDLLXKTVRDEIAGVQAKKGYDXLSIXDAKQMFKFNSXTRELXQYIAEGTTPKWECQGLAGSWSKKVEAPLLRNSGGAGSITKPLRPGNWRIICLAPF

SEQ ID NO: 41182 - protein, 219 aa, Prochlorococcus marinus str. AS9601
MTYSANFSIEDLRFDNYGLIPAIAQDWLDGSILMLAWMNKESLTMTLETKNVHYWSRSRSEIWRKGATSGSTQILKEIRFDCDNDALILLIEQNGSGACHTGEKSCFFNEIKINQSDKKEKKTTPFSNICSELFNTIIERSINPSEKSYTNHLLTKGSNTILKKIGEESAEFIMACKDNDKKSISNEAADLIYHLQVALMHKGVEWRDVLAILESRRKN

SEQ ID NO: 41183 - protein, 397 aa, Wolbachia endosymbiont of Drosophila melanogaster
MSDLAKRMSLIKPSPTIAVTDKANKLKNEGKKICVLAAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTVELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVVPGIAFGLENFIRISYATSQEQLEIGCDSITKACQELK

SEQ ID NO: 41184 - protein, 512 aa, Ustilago maydis 521
MWTMTRSRWMHTQSAQADASARKQRLVVLGTGWGGYAFLKSLSYASLRRFDVKVISPTTSFSFTPLLAQASCATLDFRSVVEPIHSNRWMEYHHAWCDAVDLKANRIELTSAFNPQFRLADPLLDANPASKDESNKDESKRVTYSLQYDYLVIGVGSYNATFGTKGVKENALFLKDVSDARAIRWRILGLFESANAKQRQYTHQGQVAISAEQEHQLRRLLSFVVVGGGPTGSEFAAELHDLINDELSRLYPNVCAYATVRLLDAGSTILSSFDARLAEYAINKFARDGIQVQLNAKIRRVERDAVVLDSAGGHQERIAAGMVIWSTGITTSPLIQAFRGVAKQDRTGKLLTNHTLNLVIHPSHPNPGANVLNPAADDSHMGSPSQPPTPLDNVFALGDCSASPDALPATAQVASQQGTYLAHLFNSHLASASPSSRSSQPKPFVFHDKGSMASIGSRSALIDSPVKKDSGTLAWLLWRSAYTIMAMSWRNRFLVPANWASNLLFGRDVGRF

SEQ ID NO: 41185 - protein, 292 aa, Clostridium thermocellum ATCC 27405
MRKPIFTGAGVAIITPFTENGVNYDKLGELIEFQIREGIDSIIICGTTGEASTMPDEEHKAVIKYTVEKVNKRVPVIAGTGSNDTIHAVELSKYAEEVGADAILSVTPYYNKTTQKGLYEHFKLIAESIKIPVVLYNVPGRTGLNIEPKTVKQLAEIENIVAIKECNINQVGEIISICPPDFTVYSGNDDMVVPLLALGGKGVISVMANIIPKKTHELVATFLDGNVEESRKIQLSLLNLIKALFIEVSPIPVKAAMNLMGMEVGKCRLPLTDMTEKNFEILKQTLKDYGLI

SEQ ID NO: 41186 - protein, 305 aa, Alkaliphilus metalliredigenes QYMF
MNEQLQKILDTNRHHIQGGQLPTYIPELSKANKEALGIYVADLDGNEYGVGDYEYPFTIQSISKVVTLLLALSDRGEKYVFDKVGMEPTGDPFNSMMKLEVVRPSKPFNPMINAGAIAVTSMIKGDSQKERLERILGFFRQLTENPNLQVNQSVYRSEKITGDRNRSMAYFMKDVGIMQNDIESDLDLYFNQCSIEVTCKDIAKIGRFLANGGVLFETGQQLIDEKYIKMAEAFMVTCGMYNASGEFAIKVGIPAKSGVGGGIMASVPKKMGIGVVGPSLDEKGNSIAGVRVLQKMAEDYGLSIF

SEQ ID NO: 41187 - protein, 226 aa, Paeonia suffruticosa
SQVTFSKRRGGLLKKAHEISVLCDAEVALIVFSTKGKLFEYSTDSSMEKILDRYEQYSIAERQLVEEPGSQGNWSLEYSKLRAKIELLQRNQRRFMGEDLDSLSPKDLQNMEQQLDVSLKNIRSRKNQLMYESISELQKKERAIQEQNNLLAKQIKEKEKTMAQQAQWEQQIHHGPNASAYLLSPHELTTLNMGGNYQGEPTEMRRNELDLTLEPIYTCHLGCFGA

SEQ ID NO: 41188 - protein, 147 aa, Brassica napus
  misc_feature (38)..(38): Xaa can be any naturally occurring amino acid
  misc_feature (64)..(64): Xaa can be any naturally occurring amino acid
  misc_feature (99)..(99): Xaa can be any naturally occurring amino acid
  misc_feature (115)..(115): Xaa can be any naturally occurring amino acid
  unsure (1)..(147): unsure at all Xaa locations
KKKQALIIKQENVRKSNRSWKSSPGLNWLDRRVAYMSXGRKIDITVSEHDKALARKNNLTTIGXILGRPPPMSSSATSSETSSTSQSPVPFSRSFLEEXGYYRKPSYMCLTQSIXAKKRRSTSILYLLVPESLFEKKQSMSYNEDVN

SEQ ID NO: 41189 - protein, 69 aa, Zea mays
FFSMGEEYVPEYFVKRVLLARLFRPLGGAEKFEIKWGTLFFSTRVQKPFVPFLVFFKRGGPKGWDAPWS

SEQ ID NO: 41190 - protein, 314 aa, Capsicum annuum
GINGFGRIGRNFLRCWHGRKDSPLDVIAINDTGGVKQASHLLKYDSTLGIFEADVKPVGTDGISVDGKVIQVVSNRNPSNLPWGDLGIDLVIEGTGVFVDREGAGKHIQAGAKKVLITAPGKGDIPTYVVGVNADLYNPDEPIISNASCTTNCLAPFVKILDQKFGIIKGTMTTTHSYTGDQRLLDASHRDLRRARAAALNIVPTSTGAAKAVALVLPSLKGKLNGIALRVPTPNVSVVDLVVQVSKKTFAEEVNAAFREAADKELNGILSVCDEPLVSVDFRCSDVSSTVDASLTMVMGDDMVKVIAWYDNEW

SEQ ID NO: 41191 - protein, 312 aa, Capsicum annuum
GINGFGRIGRNFLRCWHGRKDSPLEVIAINDSGGVKQASHLLKYDSTLGIFDADVKPVGTDGISVDGKVIKVVSDRNPINLPWKDLGVDLVIEGTGVFVDREGAGKHIQAGAKKVLITAPGKGDIPTYVVGVNADLYSPDEPIISNASCTTNCLAPFVKVLDEKFGIIKGTMTTTHSYTGDQRLLDASHRDLRRARAAALNIVPTSTGAAKAVALVLPSLKGKLNGIALRVPTPNVSVVDLVVQVSKKTFAEEVNAAFRESADKELAGILSVCDEPLVSVDFRCSDVSSTVDASLTMVMGDDMVKVIAWYDN

SEQ ID NO: 41192 - protein, 317 aa, Capsicum annuum
INGFGRIGRNFLRCWHGRKDSPLDVVVVNDSGGVKNASHLLKYDSMLGTFKADVKVVDNETISVDGKPIKVVSNRDPLKLPWAELGIDIVIEGTGVFVDGPGAGKHIQAGAKKVIITAPAKGADIPTYVVGVNEQEYTHEVANIVSNASCTTNCLAPFAKILDEEFGIVKGTMTTTHSYTGDQRLLDASHRDLRRARAAALNIVPTSTGAAKAVSLVLPQLKGKLNGIALRVPTPNVSVVDLVINVEKKGITAEDVNAAFRKSADGPLNGILAVCDVPLVSVDFRCSDVSTTIDSSLTMVMGDDMVKIVAWYDNEWN

SEQ ID NO: 41193 - protein, 473 aa, Bacillus cereus ATCC 10987
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFSKLSKSGVPIYALIVSTIVGCLSLLSGIYAEDTVYLWLLSIAGFGAILVWASIALSNLLARRAYIKQGGDVKDLKFKTPLYPFVPLLALVLNVTVIVAMAFIPEQRMALYCGIPFMIVCLLFYRATRNKGSNLEHIEKTKTTEIESL

SEQ ID NO: 41194 - protein, 489 aa, Burkholderia sp. 383
MSTVQETLALKDPSLFRQQAYVNGEWQGATNGETFEVRNPATGGLLGTVPAMGTAETRHAIEAANAAWPAWRKKTAKERAVVLRKWHDLMMEHADDLALILTTEQGKSLAEAKGEIGYAASFLEWFAEEGKRVYGDTIPTPASDKRIVVTKEAIGVCAAITPWNFPAAMITRKVGPALAAGCPIVVKPAEATPFSALAMAVLAERAGVPAGVFSVVTGDPKAIGGEMTSNPIVRKLSFTGSTPVGRLLMSQCAATVKKVSLELGGNAPFIVFDDADLDAAVQGAIASKYRNSGQTCVCTNRFYVHEAVYDQFAQKLAAAVGQLKVGRGTEPGVTQGPLINEAAVLKVEAHIEDALAKGATVVTGGKRHALGHGFFEPTVLTGVTPAMKVAKEETFGPLAPLFKFGSDDEVIRLANDTEFGLAAYFYSRDIGRVWKVAEALEYGMVGVNTGLISNEVAPFGGVKQSGLGREGSHYGIDDYVVIKYLCLAV

SEQ ID NO: 41195 - protein, 206 aa, Triticum aestivum
GEEIYVGPVGQHSCELIRYFESIEGVSKIKHGYNPSTWMLEVTSTVQEQITGVNFSEIYKNSELYRRNKSMIKELSSPPDGSSDLSFPTEYSQTFITQCLACLWKQSLSYWRNPPYTAVKYFYTIVIALLFGTMFWGVGRKRSNQQDLFNAMGSMYASVLFMGVQNSSSVQPVVSVERTVFYRERAAHMYSPLPYALGQVAIELPY

SEQ ID NO: 41196 - protein, 234 aa, Streptococcus thermophilus LMG 18311
MVIGTVIAASMGLVDFSPVAAAPVVHVPTSFYFGMPKFELSSIIMMCIIATVSMVESTGVYLALSDITKDPIDSTRLRNGYRAEGMAVLLGGLFNTFSYTGFSQNVGLVKLSGIKKRLPIYYTAGFLVLLGLLPKFGALAQIIPSPVLGGAMLVMFGFVSIQGMQILARVDFANNEHNFLIVAVSIAAGVGLNNSNLFNSLPTAFQMFFSNGIVVASLLAIVLNAILNHNKKEK

SEQ ID NO: 41197 - protein, 429 aa, Burkholderia sp. 383
MTVKNADLQARKNAATPRGVGVMCDFYAARAENAELWDVEGRRFIDFAAGIAVLNTGHRHPKIVKAISDQLNNFTHTAYQIVPYASYVELAEKINARAPGDFPKKTAFFTTGAEAVENAIKIARAATGRPGVIAFSGGFHGRTMMGMALTGKVAPYKLNFGPFPGDVFHAPYPNAVHGVTTADSIKAIEMLFKADIDPKRVAAIIFEPVQGEGGFYAAPAEFVRALRKICNEHGILLIADEVQTGFARTGKLFAMQHYDVLADLITMAKSLAGGMPLSGVVGRADVMDAAAPGGLGGTYAGNPLAVASAHAVLEIIDEEKLCERATQFGDVLKAKLNALQADVPQIADVRGPGAMIAVEFLKPGSGEPDAEFTKRVQTRALERGLLLLVCGVYSNVVRFLFPLTIPQAVFDEALVILEEVLKETVGVPA

SEQ ID NO: 41198 - protein, 367 aa, Psychrobacter arcticus 273-4
MATILTLAGDGIGPEIMTQAIDVLNAVNNKFALGLTLESGLIGGVAVDATGEPLPEETLQRARAADAVLLGAVGGPKWDGIERSKRPERGLLKIRSELGLFANLRVAKLYPQLVNASSIKPEIISGLDLLIVRELTGGIYFGEPRGIRTLENGEQQGYNTMVYSTSEINRIGKVAFELAQTRAQAAGTPAKVCSIDKANVLEVTELWKQTMIELQQAEYSDVALSHMYADNACMQLIKDPKQFDVMVTGNLFGDILSDEAAMLTGSIGMLPSASLDEAGKGMYEPCHGSAPDIAGQDIANPLATILSVAMMLRYTFKQEVAAQAIEQAVSDVLDDGLRTVDILDRNEAGLIQVGCQQMGQAVLAKLL

SEQ ID NO: 41199 - protein, 362 aa, Glycine max
  misc_feature (187)..(187): Xaa can be any naturally occurring amino acid
  misc_feature (251)..(251): Xaa can be any naturally occurring amino acid
  unsure (1)..(362): unsure at all Xaa locations
MAHRRCLLIRGNLMNRKCHPSFSYVLHSNEGKRECPDEKSSSAGISNSIQRRMFGNSVDGSMRFVSYSGQRMHSNRFLSPYSGYNFCRHMSTVNQGSDKIDIMTDIADVLKDTTVEAVTSQAPIVKEVAIAAADSALPVKALQYIIDAVHSYTGLNWWASIVLTTLLIRSATVPLLINQLKATSKLXKLMRPHLEEIKQEMEGLTMDPVAVAKGQQQMKKLFKEYGVSPFTPLKGLFIQGPIFVSFFLAIXTNMAEKVPSFKHGGASWFIDLSTPDALYVFPVLTALSFLITVECNMQEGMEGNPVAGTMKNVSRGLAVLTVPFTMGFPKAIFCYWVTSNLFSLVYGLGKALENFHFLFYFV

SEQ ID NO: 41200 - protein, 337 aa, Chaetomium globosum
MAIKVGINGFGRIGRIVFRNAVEHADVEIVAVNDPFIEPKYAEYMLKYDSTHGVFNGTIAVEGSDLVVNGKKVKFYTERDPAAIPWKDTGAEYIVESTGVFTTTEKAGAHLKGGAKRVIISAPSADAPMYVMGVNEKTYDGSAQVISNASCTTNCLAPLAKVVNDKFGIVEGLMTTVHSYTATQKTVDGPSAKDWRGGRGAAQNIIPSSTGAAKAVGKVIPELNGKLTGMSFRVPTSNVSVVDLTCRLQKEASYDEIKAALKEASEGDLKGILGYTEDEIVSSDLNGNPNSSIFDAKAGISLNKNFVKLVSWYDNEWGYSRRVLDLLAYVAKVDASK

SEQ ID NO: 41201 - protein, 386 aa, Alkaliphilus metalliredigenes QYMF
MPSLSKTILNLEESGIREIMNLALGMEDVIRLEIGEPQFDTPEHIIEATSQAARDGFTKYTANLGLLSLRETISNHVNNRFNLETSWENVAVSVGGVGAVSSLIRVLADAGDELLIPSIAWPNYKMAIDCIDATPVFYKLDPNNDFLPSIENLESLVTPKTKVLVINSPSNPLGVVIPQKLIKELVEFAKKHDLFLISDEVYEEIIFEGDHISTLPYDTDGRVIGVFSFSKTYAMTGYRLGYAIGNKEIIKEVGKFQEVNVMNACGIAQKAAEAALKGSQDCIREMVAVYKDNMEAATRLMDEYEIPYQQPTGAFYLWVNIGCKDATVFAKDFLVQHKVAIAPGNTFGPEGSPYIRISLASKKEDILEGIHRLAVMLGKSKLAVNA

SEQ ID NO: 41202 - protein, 146 aa, Polaromonas sp. JS666
MKDVAQILKSKADHKVYTVSPLAPVLDAVKLMAEKNLGALLVLDGEEFVGIISERDCTRKMLLADRLPRETPVRDIMSSPVQYVGPRHTNEECMALMTDKRLRHLPVIDNGKLIGLVSIGDLVKDIISEQGFIIQQLEHYIAGVKG

SEQ ID NO: 41203 - protein, 449 aa, Alkaliphilus metalliredigenes QYMF
MNDIIKGLEVIQKDDELISLGTRIAFYPLAIKEAKGAILMDYDGNEIIDFLSAACVSNVGHSHPRVVNAIIEQTKKFIHYNPAYAVHEQMGNLAEELIRITPGDFPKRVAFSLSGGDANDNAIKVARSYTKRTKVISYFRAYHGTTYGALSLSAVSLPMRRDLGPFVPDVYHIPYPDCYRCNRKSPDSGCNMDCMEKLKELFNTVVPAEEVAAIFLEPFQGDSGVIEPPAEYIEELVKVCKDNGILLVVDEVQSGFGRTGKWFASEHYNLEPDIIVLGKSIASGMPLAALVARKEILEGWGAPAGSYSTAGNPICCAAALATIDIIEEEGLVKKAEELGNYTIKRFEEMKEKHPLIGDIRGKGLMIGVDLVKDRGTKERAKDETAKVSYRCWEKGLFITFFSGNVLRIAPPLTISKKELDKALDIIEEALCDVEAGRVPDEILESVKGW

SEQ ID NO: 41204 - protein, 222 aa, Arabidopsis thaliana
MDSLAISPRKLRSDLYSYSYQDDSNTVPLVISVLSSLIERTLARNERISRSYGGFGKTRVFDCREIPDMTIQSYLERIFRYTKAGPSVYVVAYVYIDRFCQNNQGFRISLTNVHRLLITTIMIASKYVEDMNYKNSYFAKVGGLETEDLNNLELEFLFLMGFKLHVNVSVFESYCCHLEREVSIGGGYQIEKALRCAEEIKSRQIVQDPKHHHHHQFSRIML

SEQ ID NO: 41205 - protein, 181 aa, Misopates orontium
MAAKVSSDPLVIGRVIGDVVDHFTSSVKMSVIYNANNSVKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAIMSPPLVTRDGFNTRKFTQENELGLPVAAVFFNCQRETAARRR

SEQ ID NO: 41206 - protein, 118 aa, Deinococcus radiodurans R1
MDKPGPTSPQPTLFERIIAREIPSQVVYEDDDYIAIKDIAPKAPIHLLVIPKRVTTRVDEITDPLEMGRLWLKATEIAREQAPDYRLVVNCGAGGGQMVFHTHIHILAGWEGGPDSDT

SEQ ID NO: 41207 - protein, 162 aa, Cryptococcus neoformans var. neoformans
MSDVYFDIAINSQPAGRITFKLFDDVVPKTVQNFRELCTGQNGFGYAGSGFHRVIPQFMLQGGDFTNHNGTGGKSIYGNKFADENFKLRHDRPFLLSMANAGPNTNGSQFFITTVVTSWLDGKHVVFGEVSSGQDLVRKIESYGSGSGATKAKITIAASGTV

SEQ ID NO: 41208 - protein, 344 aa, Prochlorococcus marinus str. AS9601
MNFLACDLGGTKVLLGIFKKGTNNNSPKLIFKKKYISSDWDSFELILEDFIKKECKNITHPSSACFAVAGPLSKNNAKIVNLSWNISGNDLQNKFNFKNCELINDFAVQIYGIPFLKKNQYSTIQNGSNSENTNNDLHAIVGAGTGLGIARGIISGEKVKVLASEGGHVEYSPKSKLEWDLKIWLKNYLKVERISCERIISGTGLSRIAEWRLSKPDAQNHPLQKYLKKIKIFDAARKELPEKICNLSKEGDQVMIEVERIWLGAYASLLGDVALQELCFGGLWISGGTASKHFKNFKSDLFLKQFFDKGRLKDILKTIPIKVILDEEFGLFSAACRAKMLLKT

SEQ ID NO: 41209 - protein, 162 aa, Cryptococcus neoformans var. neoformans
MSQVYFDIAINNAPAGRITFKLFDDVVPKTARNFRELCTGQNGFGYAGSGFHRVIPQFMLQGGDFTNHNGTGGKSIYGNKFADENFKLRHDRPFLLSMANAGPNTNGSQFFITTVVTSWLDGKHVVFGEVSSGQDLVRKIESYGSGSGATKAKITIAASGTV

SEQ ID NO: 41210 - protein, 82 aa, Arabidopsis thaliana
  misc_feature (18)..(18): Xaa can be any naturally occurring amino acid
  unsure (1)..(82): unsure at all Xaa locations
MPISATMVGALLGLGTQXMYSNALRKLPYMRHPWEHVVGMGLGAVFANQLVKWDVKLKEDLDVMLAKARAANERRYFDEDRD

SEQ ID NO: 41211 - protein, 461 aa, Streptococcus thermophilus LMG 18311
MSIFRKKDVGLSQTEMKRHLTLRDVVLLGIGAMVGTGIFTITGTAASTLAGPALIISVLISAVCVGMSAIFFAEFASRYPSAGGVYGYLYASWGEYPAWMGGWLTMIVFMNAVSSVASGWGAYLKGLLASFGLQLPKAISGPFNPSQGTYIDLLPVLVLVLVTALLLMDSKQVLRLNSLLVVLKFSALAVFILVGLFHLNPDNWANFAPFGFGQIYGGKTGIMAGASLMFFGFLGFESISMTVDEIKEPQKNVPRGIILALIIVASLYAVVSLVLTGVVHYTKLNVDDAVAYALRYIGVSWAANYVSVVAIMTLITVCISMAYALSRMVYSLARDGFLPQTFQKVSKTHKVPHYATLLTGILSAISSGIFSLANMASLVNISTLAYLVLLAIALIILRKDKGLPQKDEFKVPFVPVLPILSIIVCLSFMSQYSWQTWSAFGIAVLIGSAIYAFYGYKHSKY

SEQ ID NO: 41212 - protein, 136 aa, Xylella fastidiosa 9a5c
MSKLNKSIIAEFESAQITRQVPQFSQGDTIVVNVKVKEGNRERLQAYEGVVIATKNAGLNSAFTVRKISHGYGVERVFQTHSPIIESIEIKRRGKVRAAKLYYLRGLEGKAARIKEDLAATAQEKLARKTVTAKAG

SEQ ID NO: 41213 - protein, 174 aa, Glycine max
MDASSFKIILGSSSVARRKILSEMGYLFTIMTADIDEKSIPEETPEDLVMALPGAKVVVYEGVIRGKPTSKEEARQFLKDYSGRHAATVGSVLVTNLKTGLRKGDSDRVEIYFNEIPDEIIEKLVDEGITLNVAGGLIIEHPLVLPFVKEVVGTTDSVMGLPKALTEKLLKEAL

SEQ ID NO: 41214 - protein, 265 aa, Triticum aestivum
  misc_feature (237)..(237): Xaa can be any naturally occurring amino acid
  unsure (1)..(265): unsure at all Xaa locations
TIEQVCTKKQAGTGPEFPGYRRPTRPLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPNSVKTFNDALDTTQTIIWNGPMGVFXFDKLAEGPESIAKKLAELTKEGVTTILG

SEQ ID NO: 41215 - protein, 358 aa, Deinococcus radiodurans R1
MRLTILGMTAHDSRPEQAKKLADIDWSTLGFSYIRTDLRYLAHWKDGEWDAGTLTEDNQIHLAEGSTALHYGQQCFEGLKAYRCADGSINLFRPDQNAARMRMSCRRLLMPELSDEQFIDACLQVVRANEHFLPPYGTGGSLYLRPFVIGVGDNIGVRTAPEFIFSVFCVPVGPYFKGGLTPTNFITSDYDRAAPHGTGAAKVGGNYAASLLPGYEAKKRDFADVIYLDPATHTTIEEAGAANFFAITQDGQKFVTPQSPSILPSITKYSLLWLAEHRLGLEVEEGDIRIDELGKFSEAGACGTAAVITPIGGIQHGDDFHVFYSESEPGPVTRRLYDELVGIQYGDKEAPEGWIVKV

SEQ ID NO: 41216 - protein, 115 aa, delta proteobacterium MLMS-1
MNAIEQLEQEQMRHDHPDFRPGDTLKVHFRIVEGTKERVQVFQGVVIRRRRGTMGASVTIRKVSHGVGVEKNFPLHSPKVEKIEVVSHGRVRRSRLYYLRNLRGKAARIRERDTN

SEQ ID NO: 41217 - protein, 199 aa, Cryptococcus neoformans var. neoformans JEC21
MAMQSIKCVVVGDGAVGKTCLLISYTTNSFPGEYVPTVFDNYSASVLVDGRPVSLGLWDTAGQEDYDRLRPLSYPQTDVFLVCFSIVSPPSFENVKTKWIPEIRHHAPTTPILLIGTKLDLRDDPVTLSRLKERRFQPIGFEMGVRCAREIGAVRYLEASSRTQKGLKNVFDEAIRAVLSPSARDAREKKKKKQQCLIL

SEQ ID NO: 41218 - protein, 229 aa, Haemophilus influenzae Rd KW20
MDKIKQLFANNYSWAQRMKEENSTYFKELADHQTPHYLWIGCSDSRVPAEKLTNLEPGELFVHRNVANQVIHTDFNCLSVVQYAVDVLKIEHIIICGHTNCGGIHAAMADKDLGLINNWLLHIRDIWFKHGHLLGKLSPEKRADMLTKINVAEQVYNLGRTSIVKSAWERGQKLSLHGWVYDVNDGFLVDQGVMATSRETLEISYRNAIARLSILDEENILKKDHLENT

SEQ ID NO: 41219 - protein, 575 aa, Cryptococcus neoformans var. neoformans JEC21
MSSAIEKEGSIRGRTSQEVVSAGYDPKKGGDGVDTVVTPAHAEKGSYEGEGIHVGEGTVHRQLKQRHMAMIALGGAIGTGLFVGSGSALASGGPVGVWLGYIFMASMVYAMMVALGEMAALYPVSGAFTHYASRFVDPSLGFALGFNYWYSYAITIPTEVVAASIVISYWDTTTNVAVYITVCLVLIWFINFWGARAYGEAEFWFSSIKVITIVGLIILGIVLMCGGGPNHDAIGFRYWRNPGPFAQITINNGDGVIPGRWGQFLAFWNVFVQAAFSFIGTEIIATTLGEAENPRKTVPRAIKRVFFRLLFFYVFGIFIISVLVPYTEPNLLNGTGTAAASPFVIAIENAGIKALPSIVNAVLLISAWSAGNSDLYASSRTLYALALERQMPRFFRRCTKRGLPIWCVVITGLFGFLSYMNTGGETAEKAFDWLYNLSAITGIITWWAILLSYLRFYYGLKKQGLSRDDFPYRAPFQPWLSWYGFIFFTLIILFNGFTVFLKGNWDASSFVAAYITLPIFAVCWIGWKLVKKTRVVPLAEIDFHSGRRELDELEALDAERFKAETKYQKIISILF

SEQ ID NO: 41220 - protein, 167 aa, Oryza sativa (japonica cultivar-group)
MAAANDGADAGDSKILLISSDGQHFQVTEAEASMSKLVSNMIEDDCTENGVPLPNVASNVLAKVLDYCKKHAAAAAAAAEDVAVKDQELKSFDASFIDVDNTMLFGLILAANYLNVPSLLDLACQHTADLIKGKTVQEIRDTFGIVNDFTPEEEEEIRKENEWAFEN

SEQ ID NO: 41221 - protein, 388 aa, Bacillus cereus ATCC 10987
MIKNPKVLILTAHYGNGHVQVAKTLEQTFRQKGIKDVIVCDLFGESHPVITDITKYLYLKSYTIGKELYRLFYYGVEKIYDKKIASWYANFGRKRLKLLLQAEKPDIVINTFPIIAVPELKKQTGISIPVYNVLTDFCVHKIWIHREVDRYFVATDHVKKVMVDIGVPAEQIVETGIPIRSSFELKINSDIIYNKYQLCKNKKILLIVAGAHGVLGSVKELCQSFMSVPDLQVVVVCGKNEALKQDLLGLQEKNPDALKVFGYVENIDELFRVTSCMITKPGGITLSEAAALQVPVILYKPVPGQENENAMYFERKGAAVVIRDDSEVFAKTEALLQDDMKLLQMKEAMKSIYRPEPADHIVDTILAENHVEPNHIPIKSPALAQSFT

SEQ ID NO: 41222 - protein, 563 aa, Xylella fastidiosa 9a5c
MCSIFGIFNLQPSDNLQRLRHQALECSQRQRHRGPDWSGVYVDVGAILVHERLAIVDPAGGAQPLLSEDGTLALAVNGEIYNHAVLKGTLQQPYVFQTHSDCEVINALYREETPTSFLNRLNGIFAFALWDKTTGRGLIARDPMGVVPLYWGHDQDGRLRVASEMKALIEHCPDVAQFPPGHWYDTTTGTLVKYYERSWKNYSAVEGVQVSLQELREAFERAVHRQLMTDVPYGVLLSGGLDSSLVAAVAARYARHRIETNDQSEAWWPRLHSFAIGLKDSPDLSAANVAAEALNTVHHGFEYTLQEGLDVLPEVIRHIETYDVTTIRASTPMFLLARRIKAMGVKMVLSGEGSDEIFGGYLYFHKAPNAREFHEELVRKLNALYYYDCLRANKAMMAWGVEPRVPFLDREFLDVAMRMDAQHKMVDKTSDGPQQMEKGILRAAFDGYLPPSILWRQKEQFSDGVGYGWIDGLKAHAETQVSDHALATAETRFQVNPPQTKEAYYYRSIFERFFPSPAAAETVPGGKSIACSSPAAIAWDASFATMADPSGRAVSGVHQQALL

SEQ ID NO: 41223 - protein, 266 aa, Triticum aestivum
MDRELEEANCKFAWLKLACAEDELDSCATLLSELKVLLTKFPSMPPSFERTPNAVAELRLARAIYEFAVIFSIKVKDQDAFERNFFQLKVFYMDTRGILPPSPEEYRILGLNLMRLLAENRVAEFHTELELLPPRALDHPCIKYAVELEQSFMEGTYNRLTDGRQAVPHETYLYFMDLLAETVRDEIADCSGQAYDHLPVDDTRKMLMFSSEQKLLEYISEIQHEWEVQNHSVLFHMAKVQPRVGIQAHQMIKRSLCYARELERIV

SEQ ID NO: 41224 - protein, 260 aa, Mycobacterium bovis AF2122/97
MLGSPIAHSRSPQLHLAAYRALGLHDWTYERIECGAAELPVVVGGFGPEWVGVSVTMPGKFAALRFADERTARADLVGSANTLVRTPHGWRADNTDIDGVAGALGAAAGHALVLGSGGTAPAAVVGLAELGVTDITVVARNSDKAARLVDLGTRVGVATRFCAFDSGGLADAVAAAEVLVSTIPAEVAAGYAGTLAAIPVLLDAIYDPWPTPLAAAVGSAGGRVISGLQMLLHQAFAQVEQFTGLPAPREAMTCALAALD

SEQ ID NO: 41225 - protein, 479 aa, Arabidopsis thaliana
MIPGLLVEIHRVYDFITEILEVTNLTYPCTGPCFANLDMLVTVDPANIHHIMSSNFANYPKGPEFKKLFDILGDGIFNADSELWKDLRKSAQSMMMNPEFQKFSLATSLKKLEKGLVPLLDHVAKEKLAVDLQDMFQRFTFDTTFVLATGYDPGCLSVEMPEVEFARALDDAEEAIFFRHVKPEIFWRLQGLLGLGDEKKMTKARSTLDRVCSKYIAIKRDEVSRGTNNVDSHSKDLLTSYMNLDTTKYKLLNPSDERFLRDTILTFMLAGRDTTGSGLTWFFWLLIKNPEVIAKIRQEINTALFQRSKVDDDASNNNDSDSFSPQELKKLVYLHGAICESLRLYPPVPFQHKSPTKPDVLPSGHKVDANSKILFCLYSLGRMKSVWGEDALEFKPERWISESGNSVHEPSYKFLSFNAGPRTCLGKEVAMMQMKSVAVKIIQNYEMKIVEGQQIEPAPSVILHMKHGLKVTVTKRCLV

SEQ ID NO: 41226 - protein, 164 aa, Triticum aestivum
MGALSWAADAVVVIYSLTVAITAPLVVAQGILPRRLFPAPLVAFKLWYAVKFDDYLTAEPPAFFRGLNWLELVFQWPLNVANVYGILAGRPWAATTSLMAGVSTLTSMAAILGDILGSGRATKKLLLVYVPYVAFAVIAILRGLASGSRSPAGSLASYAWKKII

SEQ ID NO: 41227 - protein, 475 aa, Oryza sativa
MATAPAPVSLSAAASTVPARLLVGRGAAAAPVARRRARMVVVRAKIREIFMPALSSTMTEGKIVSWSAAEGDRVAKGDAVVVVESDKADMDVETFHDGIVAAVLVPAGESAPVGAPIALLAESEDDLQAALAKAQELSKAQPQQAPPPSDAAAPPPPPPPPAAAPAAPAPVAAGTKGIATPQAKKLAKQHRVDLAKVAGTGPFGRITPADVEAAAGIEPKPKVVPAASAAPVPLSAPAIGAVPQAAELPPVPGATVVPFTGMQAAVSKNMVESLAVPAFRVGYPIVTDKLDELYEKVKSKGVTMTVLLAKAAAMALAQHPVVNASCRDGKSFTYNTNINIAVAVAIDGGLITPVLEDADKLDIYLLSQKWKELVKKARAKQLQPNEYSSGTFTLSNLGMFGVDRFDAILPPGQGGIMAVGASKPTVVADKDGFFSVKSKMLVNVTADHRIVYGADLAAFLQTFAKIIEDPESLTL

SEQ ID NO: 41228 - protein, 1000 aa, Blastopirellula marina DSM 3645
MISPDPQTIVVVGNGMVGHRFVENMIEMDIAQRYRIVTFCEEPRAAYDRVGLTSFFAHRDAEKLMLARLDWYKQHEVELHIGDRANRIDRAAQIVYSDRGAAIHYDHLVMATGSYPFVPDLPGVKHHGVFVYRTIEDLERIIEYGKKSKRCAVIGGGLLGLEAAKAAHDLDLETFVIEYNGRVMPRQLDEAGSKMLIEKITSLGLKVLLNKGTKEIRGDGHVQQILFTDGTTLDVDMIIISAGIRPRDELAKDSQLELGKRGGVVVNERLQSSDPNIYAIGEIASYAGMIYGLVAPGYDMAEIAAANFCGQERTFNGADMSTKLKLMGCDVASFGQYNLPAEEARPLVWEDPFKGIYKKLLFTPDGSRLLGGMLVGDASDYGTLLILSKSDAPLPCDPATLIGAGGSGDKSAIGGVADMPDSAQICSCNNVTKGRICEAIRDEGIDNVGDLKMCTKAGTGCGGCMPLVTDLLAAELKAAGKAANTDLCEHFAHTRQELYEIVQLKEIKSFNDLIAQHGRGHGCEICKPAVASILASLWNDQILEPEHQTLQDSNDRFLANIQRGGSYSVVPRVPGGEITPEKLIVLGEVAKKYKLYTKITGGQRVDLFGAQAYELPEIWEELVNAGFESGHAYGKSVRTVKSCVGSTWCRYGIGDSVGFAIAIEERYRGLRSPHKLKFAVSGCVRECAEAQCKDVGLIATENGYNLYVCGNGGTKPRHADLLIADIDEATAITYIDRFLIYYIRTADKLMRTATWMEKLEGGLEHLKAVVIDDKLGVAEELEKQMQYLVDTYKCEWKEVVNNPEKRKWFRQFANTDEHQLDIELIEQRDQARPADWPKENVALVELKGLNGETIDHNGQANLRSWVRVGAVADFPLDGGSAIKYGQTQIAVFNFASQGNWYACQNMCPHKNAFVLSRGMIGTAGETPKVACPLHKKTFSLESGECLTGEEYAVKTFPVKIEADGVYLELPPETVLDAELATDKHCIRGCDAVKALQLAEA

SEQ ID NO: 41229 - protein, 381 aa, Mycobacterium smegmatis str. MC2 155
MARDYYGLLGVSKGASDSEIKRAYRRLARELHPDVNPDEEAQHRFTEIQQAYEVLSDPEKRRIVDMGGDPMESVGGAPNGFGGFGGLGDVFEAFFGGGTTSRGPIGRVRPGSDSLLRMRLDLEECATGVTKEVTVETAVLCDLCHGKGTNGNSSPATCDTCGGRGEIQTVQRSLLGQVMTSRPCPVCGGVGEVIPDPCHRCGGDGRVRARRDISVKIPAGVGDGMRVRLAAQGEVGPGGGPAGDLYVEVHEKPHDVFVRDGDDLHCTISVPMVDAALGCTVTVDAILDGPTELTIPPGTQPGSVTTLRGHGMPHLRSGVRGDLHAHIDVVVPTRLENSDIELLRKFKENRTRDTASVRTAQGSAGSGGGLFSRLRETFTGR

SEQ ID NO: 41230 - protein, 343 aa, Arabidopsis thaliana
MKKKTTTSPILSPTPHSTQILSLPVDLLISILARVSRLDYPILSLVSKSFRSLIASPELYETRSLLGRTESCLYLCLGIPSDFNPRWFTLCRKPKPSGHVMAAISIPNSRPVHCSGLVAVGSDIYNIGGSIINEHSSSVSILDCRYHTWRDAPNMLVERNSHAANVIDGKIYVAGGSRDSNSSNWMEVFDIKTQTWEPVLNPIADGCDRRIRKSAVIEEAICLFGYKGVGVAYNPRIDKWEAIGEVNYLDLGWIGCWMKLKGLEGLPEFASYSYVRLADYGGKMAVLWDKLPTTGNNNMVIWCAVITLEKRHNENIWGRVEWFDAVLTVPEPYEFVCARSANV

SEQ ID NO: 41231 - protein, 385 aa, Oryza sativa (indica cultivar-group)
MADCMQEWPEPVVRVQALADSGLEAIPRCYVKPPCDRPAPEADDASSGASIPVVDLGNGGDDEGGQLAEAVAAACRGWGFFQVVNHGVRPELMRAAREAWHGFFRLPLQEKQKYANSPRTYEGYGSRLGVEKGAILDWGDYYFLVLSPDAAKSPAKYWPANPGICKEVSEEYGREVIKLCERLMRLLSASLGLDETRFQEAFGGADCGAGLRANYYPRCPQPDLTLGLSAHSDPGILTVLLADDHVRGLQVRRRDGHWVTVQPLPDAFIVNVGDQIEELISSCTVHGWNSWTDDVQILSNSMYKSVEHRVIVNAEEERISLALFYNPRGDVPVAPAPELVTPERPSLYYRPMTFDEYRVYVRKNGPKGKAQLEALKGQSITQNNE

SEQ ID NO: 41232 - protein, 399 aa, Arabidopsis thaliana
MSSTSRSSAANNRKDPPRKKNKETPSPVTREPTSIDSLPNDLLLNCFARVSRMYYPALSRVSKRFRSIVTSPEIYNTRSLLNRTEKCLYLCLRFPFDNNTHWFTLYQNPNRTVSDKVFLQIPSPQYPLTLSSNLVAVGSNIYRIGGTVGDDSCPLGFDREPSSKVSILDCRSHTWRDGPRMRLNRRSSTTSVVDGKIYVTGGTEDTDNPSHWIEVFDPKTQSWGTVTNPHIVKVWEEVCYRRAVKSIGHDGKLYLSGDKYVVYDPDEGKWNSVEEHWLIGYAIGSSNCVVDNILFYWDQGVFKWYDSKVSSWKQLKGLEGLPDDFSQREYCKLVDLGGKMAVLWDKWEYSGVCMIFCAEISLEKRDGDEIWGKVEWFDTVLEVGASCSLKSADALSASV

SEQ ID NO: 41233 - protein, 354 aa, Glycine max
  misc_feature (279)..(279): Xaa can be any naturally occurring amino acid
  unsure (1)..(354): unsure at all Xaa locations
SARERIQTLSLNQLKELPPQFIRPANERPENTKAIEGVIVPLISLSQSHHLLVKEIAEAASEWGFFVITDHGMSQTLIQRLQEVGKEFFALPQEEKEAYANDSSEGKFEGYGTKMTKNLEEKVEWVDYFFHLMAPPSKVNYDMWPKHPSSYREVTQEYNKEMLRVTNKVLELLSEGLGLERKVLKSRLGDEEIELEMKINMYPPCPQPHLALGVEPHTDMSALTILVPNEVPGLQVWKENSWVAVNYLQNALMVHVGDQLERKQRGKENGYADLAHWCXDYRDKVLSNGKYKSVLHRSLVNKERNRMSWAVFVAPPHQAVIGPLPSLINDQNPPKFSTKTYAEYRYRKFNKLSQ

SEQ ID NO: 41234 - protein, 419 aa, Erythrobacter sp. NAP1
MDHFTYQNGVMHAENVPLPRIADDVGTPVYVYSRATLERHARVFREALDAVPDKLIAFAVKSNPNLAVLKVLSREGYGADVVSVGEMRRALAAGMPPEKIVFSGVGKTRAELQAALEAGIGQFNIESEEEGLELAELAAEMGREAQCALRINPDVDAGTHDKISTGKADNKFGVPISQAGQIFGKLAGQEGVRLRGVAVHIGSQLGELAPLERAFTKLGELVTSLRGAGHTITHVDLGGGLGVPYRAGEELPSPAEYGAMVARVTKDWGVSLIFEPGRVIAGNAGVLLTRVVRVKRGIKDPFVIVDAAMNDLARPALYGAYHDFVAVQPRGSDMTANIVGPICETGDTFAMGRLTDKLESGDLAVFRTAGAYGATMASSYNSRGFVAEVLVDGDKFAVVADRIDAGAIMDAERVPEWLE

SEQ ID NO: 41235 - protein, 121 aa, Campylobacter lari RM2100
MREKTVFELIIEGKIPANKVLESEKFLAFHDINPKAPIHILIIPKEHFENFQELRPELMSEMTQFIQELATLLGLDKSGYRLITNCGKNSGQEVFHLHFHMLGGFELPKNKETQVNPESLF

SEQ ID NO: 41236 - protein, 675 aa, Oryza sativa
  misc_feature (561)..(561): Xaa can be any naturally occurring amino acid
  misc_feature (601)..(601): Xaa can be any naturally occurring amino acid
  misc_feature (625)..(625): Xaa can be any naturally occurring amino acid
  unsure (1)..(675): unsure at all Xaa locations
MATFARHRVLLCRLAAALLLAPVAAAQPWQFCGQGGNYSANGTYQSNLAGLSATLPKNASASRTLFAKDSLGAVPDIVYALALCRGDVANATACESCVATAFQDAQQLCPYDKDAFIVYDLCYLAFSNRNILAAAADDDGSPRFLMNTQNASAPAEVFDAAVATLLNATSSYAAENSSRRFATGEEAFDAAAATPTIYGLSQCTPDMSPDDCRSCLGRIIALIPRYLSRRKGGRAIGMRCNFRYEVGPFFAGGSMLRLPAPANSTPTAPTGGRKKNKSGTALAIALPLVVILLATVVICLSVQRWRKRSRSKQQSSYSIQMAEDIESTDSLFIDLSTLRAATGNFSESNRIGEGGFGSVYKGVLPSGEEIAVKRLSMSSGQGIEELKNELVLVAKLQQKNLVRLVGVCLQEHEKLLVYEYMPNRSIDTILFDLEKRKELDWGKRFRIINGIARALQYLHEDSQLRIIHRDLKASNVLLDSDYNPKISDFGLARLFEGDQTREVTSRVVGTYGYMAPEYAMRGHYSVKSDVFSFGILMIEIVTGRRSSGSYSFDQSYDLLSXVWEHWTMGTILEMMDPSLTSHAPRDQMLKCIHIGLLCVQXDNPADRPMMSTVNIMLSSNTVSLXQSPSKPSFFIPKSGTDSNIYSESYPQTSQPTHRSGMMSVNDVSVTELEPR

SEQ ID NO: 41237 - protein, 501 aa, Pyrobaculum aerophilum str. IM2
MESITSIEMYVADRNAEWLGVPRLVLMENAGAAVARNVLRKFPTAKRILVVCGTGDNGGDGYVAARHLHAAGRTVRVIALGEPREELARINYQAVTRLWGVEVKAAQLPLELLALQDWFMWAEVIVDAVLGTGIRGVLREPHATAIELMNISPAPKVAVDVPSGLDPDTGEVRDKAVRAALTVTFHKAKRGLLAPGAQRYVGELVVEPIGIPPEAELVVGPGDFAYLNFTRRADSKKGDHGRVLVIGGSLEYSGAPVYVALAALRAGVDLAVIAAPEPAAYAAKAISPDIIAIPLEGPRLSTKHVDKLASLAERFNVVAMGPGLGVEEETQEAVRELFRRLAGKRAMVIDADALKALRGVRASGAVVYTPHAGEFKALTGAEPPQSLSERMAVVREQAAALGGVILLKGRYDVISDGVRVKVNMTGTPAMTVGGTGDVLTGLVAAFLTKTSDPLEAAAVAAFVNGLAGEDAAAELGFHITASDLIERLPRVIRRYAFESIR

SEQ ID NO: 41238 - protein, 412 aa, Oryza sativa (japonica cultivar-group)
MSARKEAKGSAGGDRIGALPDEVLHRVLSFLPAQDAVRTCVLAPRWRHLWKSATGLRVGEDESNLGSVKEQQEFLDHLLVLRDSAPLETCVLRFNWYDDDDFEDIFRLNVWFRYAIHRKVRFLRLDVWQEEEFGNPVPIDEQPIVSQHLTRLQLYGIVLNDGLLDFSSCPSLEHLVFESCVFECAKISSNSVKHLSITFSNFPAGTSRVRIDIPSLVSLRLDRIYDRKPVLERMPSLVDAFVSVPSSSEDFCGESDSGDCGRDGCESCYGFTNKNCVLLEGLSEAKMLVLINEDESFIFKRDLKWCPTFSKLKTLILNGYWCVPDDSHMLARILEHSPALEKLVFQLGYQAYKRTNKIKGILNPMERSAGISEHLQIVEVQCNAIDGQVLKVLKYLSTFKIYFSLEEATIES

SEQ ID NO: 41239 - protein, 430 aa, Haemophilus ducreyi 35000HP
MQNLRYPIDSKPPFGLSVLLAVQHLLAALGGIIAVPLVIGNVLKLPTSDTIVLVNAALLVSGIVTIIQCRGIGPIGLRLPSVMGTSFTFVAAALAIGFSEYGVAGIMGSSLIGSLVMIIGSFFMPYVRKLFPPVVTGIVVMMIGLSLIPVAVDWFAGGQKGDPHYADPANLAMATFVLVLVVILVQWGKGIFSAAAIVIGMLVGYAVALALGWINFEAIQNAEAFAIPQPLHFGLAFPISGIIGMSIAYLVTIVESSGNFLALGNATQTEITGKHLRGGVLCDGLGSAFAAVMSTTPFSSFAQNIGVISLTGVASRYVVTVMGVLLVLAGVFPWLGAIIVSIPSPVLGGAGLMMFAMIIAAGIQMLDKVERSKRNGLIIAISIGCGLAVTTRPELLDKLPNFFKEVFGSGITVGSVLALLLNLILPEDKH

SEQ ID NO: 41240 - protein, 259 aa, delta proteobacterium MLMS-1
MTQPTPPTYRLCVSLAQPGLEELLSAAAQAAPLADVLEIRLDALAAESATMAVKRLTTELAGPLLFTNRPRWEGGAGDVPEERRLEPLLAALEAGAAYVDIELRAGARAHRQLLAAADRCRTAASDAADPGRETTAIPARSGQLIVSWHDFDTTPESTELAEIVRRQQDSGAAIGKLVTMAHNPGQVRRVLNLLELAETLNFPLIAFSMGAAGLISRLATCHLGGYMTYAAAGDGQATAPGQLPAVRLRQIEQLLTASK

SEQ ID NO: 41241 - protein, 273 aa, delta proteobacterium MLMS-1
MMKIDGQTEVYGIIGNPVRHSLSPLIHNAAFAACGLNKAYLPFPALDAAAAVAALRALEIAGVSVTIPHKQAVMAALDDIDPVAAAIGAVNTIVRQDGRLHGYNTDWLGANRALEAELALAGASILVLGAGGSARAIGFGLKEAGARLTLASRTPESGRQLAAQLGCPWLPLAEAGDRQADALVNATSVGMSPAADQSPLPAAALGNFPVVMDIVYSPLATRLLQEARAAGCRTIDGLQMLLHQGAAQFELWTDQQAPLEVMRESMLSGLNAT

SEQ ID NO: 41242 - protein, 537 aa, delta proteobacterium MLMS-1
MADLQEYFNDFNKLPAFSRLTELALQPVELRAAVDPARIADYRCRGGGVELIYFGQRVNGQVLEALGELAAQAGVLEQYDLMRQGAVLNQIAGYASENRQVLHCSNRDIFAESPRQPEATARTANELAKLREFLEDLEAGRLANPAGEPFETMLQVGIGGSDLGPRALYLALRAYAKPGRQVRFISNVDPDDAAAVLQELDLSRTLVKVVSKSGTTLETLANEELVRRAYQDAGLDPKDFFIAVTGQGSPMDNPEHYLRSFYMFDYIGGRYSATSMVGLVMLGFALGYEQVLEILRGAYEMDEAATQPDPTRNPPLLLALLGIWNRNFLGSQDVAILPYSQALSRFAAHLQQLDMESNGKGVSRAGEPLGWDSGPVVWGEPGTNGQHAFYQLLHQGTAVVPIEFIGFKESQYRRDLTVKGTTAQEKLLANLLAQSLALAVGQEEENPNRRFPGNRPSSILLADRLTPATMGALLALYEAKVVFQGFLWNINSFDQEGVQLGKRLADGLLAQYEARRRGTTPPQDPLGRALLALASSE

SEQ ID NO: 41243 - protein, 623 aa, Arabidopsis thaliana
MTSTYTRFDTVFLFSRFAGAKYSPLLPSPSFTLSTSGIHIRTKPNSRFHSIIASSSSSSVVAGTDSIEIKSLPTKPIEGQKTGTSGLRKKVKVFMEDNYLANWIQALFNSLPLEDYKNATLVLGGDGRYFNKEASQIIIKIAAGNGVGQILVGKEGILSTPAVSAVIRKRKANGGFIMSASHNPGGPEYDWGIKFNYSSGQPAPETITDKIYGNTLSISEIKVAEIPDIDLSQVGVTKYGNFSVEVIDPVSDYLELMEDVFDFDLIRGLLSRSDFGFMFDAMHAVTGAYAKPIFVDNLGAKPDSISNGVPLEDFGHGHPDPNLTYAKDLVDVMYRDNGPDFGAASDGDGDRNMVLGNKFFVTPSDSVAIIAANAQEAIPYFRAGPKGLARSMPTSGALDRVAEKLKLPFFEVPTGWKFFGNLMDAGKLSICGEESFGTVSDHIREKDGIWAVLAWLSILAHRNKDTKPGDKLVSVADVVKEYWATYGRNFFSRYDYEECESEGANKMIEYLREILSKSKAGDVYGNYVLQFADDFSYTDPVDGSVASKQGVRFVFTDGSRIIFRLSGTGSAGATVRIYIEQFEPDVSKHDVDAQIALKPLIDLALSVSKLKDFTGREKPTVIT

SEQ ID NO: 41244 - protein, 427 aa, Cryptococcus neoformans var. neoformans JEC21
MPVAPTVKSARTTSVYDRSCRASASPKSSRRLSSQTKAKIQAVAAPVSQARAVPQHRKVEEVMYFEEDYSEEIIAYMNSMDNSTLASAELMDMQPELQWFMRSYLIDFIIEVHQQFRLRPEVLYLAMNIVDRYISKRVVYKKHYQLVGCAALWIAAKFEDAKDKVPLVHELSEMCCKAYDESAFIQMEGHVLSTIGWVLGHPSAEAWLRVFTTGIRYEDQKVANMARFLMEITLFHREFIGIQSSIIAAGALMLARFICGKPYKPCFPNVPETVAARVSIAIDKRFSQELEKVSEIVIRKYAPTYYDRVSTVCREWYLSGRRYTYNPVMPSTPVSGLSTPGLAPSCSSSWAKRGSWVTGSPAGSCASSEAGDDTPVTPITPIYTHVIDPFSVAAKENIAPDAGKPMAKVIPRVHNVTAPRVMRRLSN

SEQ ID NO: 41245 - protein, 545 aa, Nocardia farcinica IFM 10152
MLSTMQDEPLSLATLLKYAATFQGESTVSTWTGDGVRTMTYRELGAEAARLANALSGLGIGVGDRVGTFMWNNNEHMVAYIGVPAMGAVLHALNIRLFPEQLVYVANHAEDKVVIVDGSLVPMFAQLLPNMKTVRHVIVANGDAATLQAPKGVQVHSYSELLAGQSDSYDFPVIDERSAAAMCYTSGTTGDPKGVVYSHRSNWLHAMQVVSPSGMGFSGADSVLAIVPLFHANAWGIPYAALMSGANVVMPDRFLQPGPLLEILANLKPTFAAAVPTIWGGVLAALAAQPQDISHLRTVVVGGAAVPPSMMHAFQERHGVRVLHAWGMTETSPLGSVAHAPAGVTGEEEWAYRYTQGRFPASVQARLVDDAGNVVPNDGESLGELEVKGPWITGSYYSPDGSPVDPDKFDNGWLRTGDVGKISPDGYLTLVDRSKDVIKSGGEWISSVDLENAVMGHPAVAEAAVIGVPDEKWDERPLVAIVLAEGATAEPTELRDFLADKFAKWQLPEHWTFISEVPKTSVGKFDKKQLRAQYANGELDVKTLA

SEQ ID NO: 41246 - protein, 474 aa, delta proteobacterium MLMS-1
MTNDNELIIIGAGLSGLAVAHFLGREGANRQITLLEAGLRPGGAIRSFTEAGFRAEWGPHGFLDNNPASRELLAATGLDKEAVKAPLKQNVRYLCQQGRLVALPQSLRALLTTPLLSWRGKLRLAGELFKKPLADGQSIGHWAAHRFGPEVLPLVDAAVTGTYAGDYQRLSIEAVMPGARRLEKEHGSLLRGLLKEGWQKKVQQRRQAKKAAGAGAGGDSRGGGLPAMTSFRDGMEHLATRLARDLNIIYDCPVEQIRPTATGWQLTCGERLFDTRQLVLALPVNQALQLLTDWQPPVSAIPEARIITVALGFRARDAQVPAGFGYLAPEREQRFTMGALFSSHMFPDRAPAGHHLLEALVGGRRHPERLELADDELTRQIHADLKELLPISAPPVFSRVLRAAGGIPQLEEHHLDLLKWREQLQDRQPGLQLTGFGWDGIGINDMIKAAQQCAQRLNAGDTPGEQTQVRPVYF

SEQ ID NO: 41247 - protein, 872 aa, Zea mays
MGDDVRGLRAAAVTTAAGVVPAKTPERARLHVAMLALQFGYAGFHVVSRLALNMGVSKLVFPVYRNLIALCLLAPFAYFLEKKDRPAMTPAFLLQFFLLALCGITANQGFYLLGLDNTSPTFASAIQNSVPAITFAMAAALGIERVRLRRRDGLAKAAGTVLCVAGATVITLFKGPAVFGPAPSVAAAVPVPMPAPGGGNNNNNNKSWALGCVYLMGHCLSWSGWLVLQAPVLKRYPARLSVTSYTCFFGLLQFLAVAAVFERDAAAWALGSGSELLTILYAGLVASGVAFAVQTWCIDRGGPVFVAVYQPVQTLLVAVMASLLLGEQFYLGGIMGAVFIIAGLYLVLWGKSQERALAAKQTAAAAAGSVCDDDAAASCLKQPLLPPPPATSEAGRDATNTYWILMTEMVSSMVVQETVSQILSGLVHSYEGKEDSNPNDNLERLEMAHIKLEAALETCSKWHVTDLSLLRWRKKLKRAAKECDDTLYKYKKMILEDEQMEQEVRNSYFPRRIAHATKSFIFSGFGRNSFESSRSAVRRFEWFADSASELLRFIELGGTPCCHMPFNSFAKHLFAGKELQHKIVHGNEYPSLLLWLVPFVTEEHGIEACLVFIKKDRNTLEDEFFFSVILQLSESTDIVGTAVKCLQLFPHHFQPTVDTIKKELTQLSTQDFSWVPYVDLWHRRHWDNLLRFSTQWFRPDPLCCKQHDQQHRLQYSNLGTVDASLDSIIEVNMQCQISLPEYNKQRAALSECKYSLRDYQKLKAGFLFTPHGPSENMLPADTSSTMALAPPIFRRGQYCEDTDNNITLEQLKEIMLPKAIDYFRQNTEATVYQILWKAIHGTAYIHFGKPTSRGARKRKLVQPKDQDVQHRT

SEQ ID NO: 41248 - protein, 434 aa, Bacillus cereus ATCC 10987
MVVKFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKTGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAEKHNIDITLNRLKGALTVYFTTNTIEDYDAAQDTDGEMFGKFFKLMLQEGINLAPSKYEAWFLTTEHTKEDIEYTIEAVGRAFAALANNK

SEQ ID NO: 41249 - protein, 233 aa, Glycine max
MNLKNMKVPNVRGGGGISALLKLGIVGGIGLYAAANSLYNVEGGHRAIVFNRLVGVKDKVYPEGTHFIIPWFERPVIYDVRARPHLVLVESTSGSRDLQMVKIGLRVLTRPLPNQLPTVYRTLGENYNERVLPSIIHETLKAVVAQYNASQLITQREAVSREIRKILTERAANFNIALDDVSITSLTFGKEFTAAIEAKQVAAQEAERAKFVVEKAEQDKRSAVIRAQVTINF

SEQ ID NO: 41250 - protein, 251 aa, Brassica napus
MAGGSGGGTSGASADLHSAARSGDLAAVQLIVSSNPLAVNSRDKHSRTPLHLAAWAGHNEVVSYLCKNKADVGAAAVDDMGAIHFASQKGHLEVVRTLLSAGVSLKSITRKGLTPLHYAAQGSHLDLVKYLVKKGANVRATTKAGKNPADVAGNPETQTFLEECEEQARKDKVKNSQKKTEEVKPESCDVEGADKGLKRKDSEDVNEEGELEEASSKAKKPKVVLRHLQESDDTAAVQEEETEEPTNGTST

SEQ ID NO: 41251 - protein, 595 aa, Oryza sativa
  misc_feature (63)..(63): Xaa can be any naturally occurring amino acid
  unsure (1)..(595): unsure at all Xaa locations
MEEAAEDRRLQVREEGGDQEPLLLLPQDANLYTGDGSVDIKGRPALKHATGNWRACFFILVWXTGDECCERLAYYGIAKNLVTYLKTNLHQGNLEAARNVTTWQGTCYLTPLIGALLADSYWGKYWTIAAFSAIYFIGLVALTLSASVPALQPPKCSGSICPEASLLQYGVFFSGLYMIALGTGGIKPCVSSFGADQFDDSDPADRVKKGSFFNWFYFCINIGAFVSGTVIVWIQDNSGWGIGFAIPTIFMALAIASFFVASNMYRFQKPGGSPLTRVCQVVVAAFRKWHTEVPHDTSLLYEVDGQTSAIEGSRKLEHTSELEFFDKAAIISSDDAKSDSFTNPWRLCTVTQVEELKILIRMFPIWATTIIFNPVYAHNSSMSIEQGMVLDKRVGSFIVPPASLSTFDVISVIIWIPFYGRVLVPIARKFTGREKGFSELQRIGIGLALSILAMLSAALVELRRLGIARSEGLIHEDVAVPMSILWQIPQYFLVGAAEVFAAIGQVEFFYNEAPDAMRSLCSAFALVTVSLGSYLSSIILTLVSYFTTQGGDPGWIPDNLNEGHLDRFFSLIAGINFVNLLVFTGCAMRYRYKKA

SEQ ID NO: 41252 - protein, 285 aa, Xylella fastidiosa 9a5c
MTTNDSWFTEHFQATGSAIGFRITGKLDEVQSPFQKIEIYNSTDWGKLMVIDGALMLTSRDNFLYHEMISHPALFTHTAPKCVVIIGGGDCGTLREVLKHPDIEQVTQCDIDEQVTRMAEKHFPELCTSNNDPRATLLFSDGVAYMTDCPTNSVDVIIVDSTDPVGPAKGLFNRTFYESCFRALKNDGLLVQQSESPLALLELIKEMRHEMSKAGFKAFKTLPFPQPCYPTGWWSVTLSSKQPNANFAFRQTDAQTKPFDTLYYNAHLHHGVLVPPPFIAHALGE

SEQ ID NO: 41253 - protein, 825 aa, Alkaliphilus metalliredigenes QYMF
MIRIKAIIMAGGKGTRLKPLTCNIPKPMVPILNKPTMEYTVELLRKHNIKDIAVTIAHLPTVITDYFHDGGKWDVNLSYYTEETPLGTGGSVKNAEEFIDDTFIVLSGDSLTDINIKKAIEFHKNKGSKATLILKNEQMPIEYGVVITNDNGRITRFLEKPSWGEVFSNTINTGMYILEPEVLDYFQPGENFDFSKDLFPKLLEDDIPMYGYVTEDYWCDVGALNSYTETHFDILSGKVNIGLEGHQIEDGIWVGEGTQIGSGVKITPPVYIGKNCVIHEGVKIDAYTTIGDHCNIENNTSLKRSIIWNHSTLGRNSRCRGSIVCNHVHIKEHVDLYENAVIGEGSILEGRVVVKPDIRLWPYKKVEENTVVNQNLVWGTKASKTIFGFKDICGHINIDINPEFASKLGTAFASTLEEESIVILSSDASNASQMIKNALIAGVHATGAGVINIGNVVMPVNRFAVTDLRGSGGIHVRMDYSDKKLIHIEFVDKIGANIQRNTEREIENVFNREDFKRCNVEQIKSTTNIENFNYYYINNGGRLLKNSSNIKRQNPSLIVSSKSDTIQQLATEFLESIGCDVKQDYNLKGDKRIQDYLVEMTPRIKKGKVNLAVIISEDGEDIILIDGAGRIIEQEKYDALIAMMILKEGKQKKLILPYTAPYIIEEMAHIYGVEVQRVKSNPASIMNAMLAVENGQSQGLSQYTLTYNAIWAIGGILDFLVEKNIKLEDLVDELPNFYYIKEEIPCDWKDKGRIIRQIIEENQHKSIEMFEGVKINDEKGWTLILPDSTKPLFNIYTEGSSQEYAKELSIFFSGKVKELLKNQEE

SEQ ID NO: 41254 - protein, 198 aa, Debaryomyces hansenii CBS767
MVPPPAEIRRKLVIVGDGACGKTCLLIVFSKGTFPEVYVPTVFENYVADVEVDGRKVELALWDTAGQEDYDRLRPLSYPDSNVILICFSIDSPDSLDNVLEKWISEVLHFCQGVPIILVGCKSDLRNDQNTIHQLSQQQQQPVSTSEGQAVAQKIGTSYYLECSARTGEGVREVFEAATRASLKTKEKKEKKKKCVVL

SEQ ID NO: 41255 - protein, 586 aa, Bacillus cereus G9241
MKQSVSAEQIELKSSLPGSKKVYVDGPREGMKVPMREIEQSDTNGVPNPPIRVYDTSGPYTDPAYKVELEKGIPTPRHSWILEREDVEAYEGREVKPEDDGVKVASKHTPVFPQMDRKPLRAKQGANVTQMHYARNGIITSEMEYVAIREGVEPEFVRKEIAEGRAILPANINHPEAEPMIIGRNFHVKVNANIGNSAVSSSIAEEVEKMTWATRWGADTIMDLSTGKNIHTTREWIIRNAPVPVGTVPIYQALEKVNGIAEDLTWEVYRDTLIEQAEQGVDYFTIHAGVLLRYIPITAKRTTGIVSRGGSIMAQWCLFHHKENFLYTHFEEICEIMKQYDVSFSLGDGLRPGSIADANDEAQFSELETLGELTKIAWKHDVQVMIEGPGHVPMHLIKENMEKELDICQGAPFYTLGPLTTDIAPGYDHITSAIGAAMIGWFGTAMLCYVTPKEHLGLPNKDDVREGVITYKIAAHAADLAKGHKTAHQRDDALSKARFEFRWRDQFNLSLDPERAMEYHDETLPAEGAKTAHFCSMCGPKFCSMRISHDIREYAKENDLETTEAIEKGMKEKAKEFKDTGSHLYQ

SEQ ID NO: 41256 - protein, 480 aa, Sphingomonas paucimobilis
MDSARIAPDQERDRMEFTRLNPMTGEVASSAPALKAGDIPAIARKAREGFTAWSVMGPNARRAVLMKAATALEARADAFVDAMMGEIGATKGWALFNLGLAASMVREAAALTTQINGEVIPSDKPGCLAMALREPVGVILGIAPWNAPIILGVRAIAVPLACGNSVILKASETCPRTHALIIEAFADAGFPEGVVNVVTNAPADAGEVVGALIDAPEVKRINFTGSTGVGKIIAKRAAEHLKPVLLELGGKAPLIVLEDADLDEAVKAAAFGAFMNQGQICMSTERIIVVDAVADEFAARFKAKVSAMPVGDPRQGSTPLGAVVDTKTVAHCLSLIEDALGKGAEQLTGGETTQNVLMPAHVIDRVTPDMKLFRDESFGPVVGIIRARDAEHAIELANDTEYGLSASVFTRDTAKGLSVARRIESGICHVNGPTVHDEAQMPFGGVKASGYGRFGGKAGIDSFTELRWITIETQPGHFPI

SEQ ID NO: 41257 - protein, 179 aa, Haemophilus ducreyi 35000HP
MNQLDLIKSSIKSIPNYPKVGIIFRDITSLLENPTAFKASIDAIVAEFKNKGITKVVGTESRGFIFGAPVALALGLPFVLVRKPHKLPRAVISQSYALEYGEDTLEMHLDSINQDDNVLVVDDLLATGGTIDATAKLIRQLGGQVKNAAFVIGLPDLGGKARLEQIGIKSFTLVEFDGH

SEQ ID NO: 41258 - protein, 370 aa, Deinococcus radiodurans R1
MTSPSSTATSSPTTTTAPTPARMRALSKQQPGEGIWMIETEVPTPGPNDLLIRIRKGSICGTDVHIYKWDDWASQTVPVPMVVGHEYVGVVAGMGSEVRGFEIGDRVSGEGHVTCGHCRNCRAGRRHLCRNTQGVGVNRPGSFAEYLVLPAFNAFKLPDDIPDDVAAIFDPFGNAVHTALSFDLVGEDVLITGAGPIGCMAAAVARHVGARNVVITDVNDYRLDLARQMGVTRAVNVAREDLWTVATQELDMHEGFDVGMEMSGSGPAFAQMVSVMNNGGKVALLGIPSGEVQIDWNAVIFKMLTIKGIYGREMFETWYKMAALIQSGLDLTPVITHHYGIGDFQQGFDAMLSGQSGKVILDWETEEQSA

SEQ ID NO: 41259 - protein, 224 aa, Medicago truncatula
MRATIYILPFLVFFFFFFALFIVLESSGDCSDFDHAQMATPLGGIQDSPSSENSLEIESLARFAVDQHNAKQNSLLEFARVVKAREQVVAGTLHHLTLEAIDAGEKKIYEAKVWVKPWMNFKELTEFKHAGDGHAPSFTTSDLGVIKDGHKPGWQSVPAHDPQVQDAANHAIKTIQQRSNSLVPYELHEVTDAKAEGSVLLRKKICYNLPDSVKCVISHQNPLF

SEQ ID NO: 41260 - protein, 356 aa, uncultured bacterium
IGAANNLLAAMIDNHIFQGNALNIDPRKITWKRCVDMNDRQLRSVVDGLGGKTNGMPREDGYDITVASEIMAVLCLASDISDLKERLSKIIIGYTYGKVAEQKPVTAGDLHAQGAMAALLKDALKPNLVQTLEGTPAIVHGGPFANIAHGCNSVTATKMCLKLADYTITEAGFGADLGAEKFLDIKCRMAGLKPNAVVVVATVRALKYNGGVPKAELNGENLEALEKGMPNLLKHVSNITNVYKLPCVVAINAFPTDTEAELKLVEEKCKELGVNVVLSEVWAKGGEGGVALAEEVVRLCEQPNDFTYAYDLEGSIEEKLNAIVQKIYGGSRVVLTANAQKQAKQLEALGFGNCPI

SEQ ID NO: 41261 - protein, 543 aa, Saccharomyces cerevisiae
MKNLKLINEHLAIVHGIHRIVTYLRSNIYQDSVKYFTESAIKMSKIVKRKEKKANDELTSLAEKIRAKALENQKKLIEAEKEGGSESDSEEDATAEKKKVLKSKSKSTVSTQNENTNEDESFESFSELNLVPELIQACKNLNYSKPTPIQSKAIPPALEGHDIIGLAQTGSGKTAAFAIPILNRLWHDQEPYYACILAPTRELAQQIKETFDSLGSLMGVRSTCIVGGMNMMDQARDLMRKPHIIIATPGRLMDHLENTKGFSLRKLKFLVMDEADRLLDMEFGPVLDRILKIIPTQERTTYLFSATMTSKIDKLQRASLTNPVKCAVSNKYQTVDTLVQTLMVVPGGLKNTYLIYLLNEFIGKTMIIFTRTKANAERLSGLCNLLEFSATALHGDLNQNQRMGSLDLFKAGKRSILVATDVAARGLDIPSVDIVVNYDIPVDSKSYIHRVGRTARAGRSGKSISLVSQYDLELILRIEEVLGKKLPKESVDKNIILTLRDSVDKANGEVVMEMNRRNKEKIARGKGRRGRMMTRENMDMGER

SEQ ID NO: 41262 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSIMRAALECCHKGWGTSVIVGVAASGQEISTRPFQLVTGRVWKGTAFGGFKSRTQVPWLVDKYMKKEIKVDEYITHNMNLADINDAFHLLHEGGCLRCVLAMQI

SEQ ID NO: 41263 - protein, 443 aa, Saccharomyces cerevisiae
MFVAPVSSQKLDTAIRKETTFVPMLAASFKRQPSQLVRGLGAVLRTPTRIGHVRTMATLKTTDKKAPEDIEGSDTVQIELPESSFESYMLEPPDLSYETSKATLLQMYKDMVIIRRMEMACDALYKAKKIRGFCHLSVGQEAIAVGIENAITKLDSIITSYRCHGFTFMRGASVKAVLAELMGRRAGVSYGKGGSMHLYAPGFYGGNGIVGAQVPLGAGLAFAHQYKNEDACSFTLYGDGASNQGQVFESFNMAKLWNLPVVFCCENNKYGMGTAASRSSAMTEYFKRGQYIPGLKVNGMDILAVYQASKFAKDWCLSGKGPLVLEYETYRYGGHSMSDPGTTYRTRDEIQHMRSKNDPIAGLKMHLIDLGIATEAEVKAYDKSARKYVDEQVELADAAPPPEAKLSILFEDVYVKGTETPTLRGRIPEDTWDFKKQGFASRD

SEQ ID NO: 41264 - protein, 338 aa, Cryptococcus neoformans var. neoformans JEC21
MAPAPTQTHAPDSQGYNSDAAAQAQAAEMSVILCTAGYDHTIRFWEAWSGICYRQITLSPQWKQVNRLAISPNKAYVAAAGNGTVRIWDIQSLSNTPIATLEGHTGNVVALAYSALGKWIVTGSEDGTVKVWDTRTAQTQRIYLHDCPVNDVVIHPNQGELISCDQSGSVKIWDLAENTCTHELVPDEDVPIRSVSISSDGNTLVAANDGGMVYVWRIIPVPNANANLVPVTSFRAHTKYITRCLLSPDTKYLATCSADHTVKIWSTAGIDYTLEKTLTGHQRWVWDAAFSADSAYLVTASSDHAARLWDLSLGETVRQYDGHHRAAVCCALNDINLA

SEQ ID NO: 41265 - protein, 632 aa, Solibacter usitatus Ellin6076
MCGIVAVYDAEGAGASAEVAAGLKTLRHRGPDAQHVWLSPDGAICLGHARLSIIDLAHGDQPLANEDESIHCVVNGEFYDFERIRRGLEGRGHRFRTHSDSEILLHLYEDLGVECLRELRGEFAFVLWDGRRRVLMAARDRFGIKPLFYSRTGERLLFASEVKALHAAGVPAAWDEQGFLETFSAMYASSPTLFRHVSAIPPGHYLLSRDLGCSLHKYWDFEFPAEGNLPERRDEECVAEFGAVLDEAVRLRLRADVPVGCYLSGGIDSCSVLALMAKHAPGRVRAFSLSFDHELYDEGPIAREMAQRTGAEFTMIPVSHAGMAADLSDALWHNESFFLNAGSAAKFALSRAVRDAGYKVVLTGEGSDEVLAGYAFFRQDMIRHASNNGGAAEAIERLRAANPASGGLMFTTKQVTPVAGYVDRLGYFPSFLEARKAGLEALRALLTIAYETDEVLTRLLNRVDIAGQLTGRHVLNQSLYLNNKTILPGYILSALGDRVEMAHSIEARLPFLDHHVVEYTRRIPVDLKIRGTVEKYILREAMKPMLTTTVYKRQKHPFLSPPALLKPDEPLHALLQDTLRGRALDRVPYLRRTEVAGFLDRAGGLDVAGKIAAEFPLMMMLSACLVAERFGL

SEQ ID NO: 41266 - protein, 557 aa, Shewanella sp. MR-7
MDQPWINHLPKDVPAEINVDQYSSLVDMFETAVAKYADQPAFINMGATLTYRKLEERSRAFAAYLQNELKLQKGDRVALMMPNLLQYPIALFGILRAGMVVVNVNPLYTPRELKHQLVDSGAKAIVVVSNFARTLEEVVEQTPVKSVIITSLGDQLSAPKRTLVNFVVKYIKKLVPKYDLPHALSMRETLSRGRRMQYVKPVITGDDLAFLQYTGGTTGVSKGAMLTHRNVVANVLQANGAYSPALRDGSEFVVTALPLYHIFALTVNCLLFLHKGSQNLLITNPRDIPGFVAELKKYPFTALTGVNTLFNALVNSSDFAELDFSRLKLSIGGGMAVQKAVADKWQSITKTRLLEGYGLTEASPLLTCCPYNLDGYNGSIGFPAPSTLIQVRDDAGNVLPQGETGELFGKGPQIMKGYWQRPEETAKVIDKDGWLATGDIGYMDEQGFFYIVDRKKDMILVSGFNVFPNEVEEVVALHPKVIEVAAVGVPNDASGELVKVFVVAKDKSLTADDIIKHCRAHLTGYKVPKLVEFRDELPKTNVGKILRRELRDEVKRA

SEQ ID NO: 41267 - protein, 434 aa, Mycobacterium bovis AF2122/97
MLGTPTSGFGSVVVAETRSYRDAKSNTEVRVNHAHLTNLTPDTDYVYAAVHDGTTPELGTARTAPSGRKPLRFTSFGDQSTPALGRLADGRYVSDNIGSPFAGDITIAIERIAPLFNLINGDLCYANLAQDRIRTWSDWFDNNTRSARYRPWMPAAGNHENEVGNGPIGYDAYQTYFAVPDSGSSPQLRGLWYSFTAGSVRVISLHNDDVCYQDGGNSYVRGYSGGEQRRWLQAELANARRDSEIDWVVVCMHQTAISTADDNNGADLGIRQEWLPLFDQYQVDLVVCGHEHHYERSHPLRGALGTDTRTPIPVDTRSDLIDSTRGTVHLVIGGGGTSKPTNALLFPQPRCQVITGVGDFDPAIRRKPSIFVLEDAPWSAFRDRDNPYGFVAFDVDPGQPGGTTSIKATYYAVTGPFGGLTVIDQFTLTKPRGG

SEQ ID NO: 41268 - protein, 156 aa, Haemophilus influenzae
NRTNTPVLVDGKDVMPEVNAVLAKMKDFCQRIISGEWKGYTGKAITDVVNIGIGGSDLGPYTVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 41269 - protein, 312 aa, Pseudoalteromonas tunicata D2
MIKNNNELPDLAKVATKTKGVVISGILGITALVVFFQSLYTVDEGHVGIIKRFGEATEQVNPGLHTKIPFVDTVEVLEIRTRKNVETLNASTHEQMPVTAEVSINWTVMREQAFDLFKSYGGLTQFETRILDPKLRSATKDALARYKAEELIQNRSQVIAQIEELLVEEMKEYPVKLDSAQLENLGLPQKYIQSIETKQTEKNLAAAEMHRLERQKLEAQQQVNTAFAQRDAAKAQADGKAYSIKAEAQAEAEAIKLKGLAEAESIQKKVEALKGSKEMVEYVKAQQWNGQMPTTVMGSEQSVLWNLEQKQK

SEQ ID NO: 41270 - protein, 823 aa, Candida albicans SC5314
MTEINDSTENITRIDRNDAKELKHWLAKANCQHHYSKFIENGITMDLLPELDTGSLKELGISKLGDRLRLEIAISNLKAENLKELISVDEIYQLLNLNPQPSGSLTNLNNNNNSLLDVSNSNEGTLTQLSQNNSSNNLPISSMNSSTNNINGNTINSSSGNVVGNSASSKDSSKTITFILQDGSTKRVNATGCFNAQAIKRRVLKKLGFKPDEIQFDTYVHSVPHGVENVLYGKTEPTITLLYDVELVTICYSPERLEKYRIMLVPKNEPPTPAAIETSKKIMSKYKKQVSGSKAELQEEVNQLHTKDVQAHRSTLRNFFGQRPPSELISSNLAEYFPDTRQKDLEQTVRNSVRHSVRLSRRFNLPAGAFSSSVYSLNKRQSILSNSTGFPSNRTMSISSGEQQSGVFNTSGGGSGGLRRAQRTIGDVMVNSITAIDEVVNSNDTFSVFNKPSTSFSNQPVQPLNNHDSRSIISSKSLSGGTALHRISISPNYNDNPAHDRHSTIELLNPSDSEGEDGEEDGEFGISDYAGLSSSSGENGPPENWLKGARIGSGSFGTVYLGMNPFTGELMAVKQIPLVNENGNNSDTENIQNSMQEQQREMMLLKELNHENIVRYFGSTTDENFLNIFLEYVPGGSVQSMLNSYGPFEEPLIRNFVRQVLIGLSYLHGEDIIHRDIKGANILIDIKGTVKIGDFGISKKVSAIDEEDEDFKKTGKRASLQGSVFWMAPEVVKQTTYTKKADIWSVGCLIVEMFTGRHPFPELSQMQALFKIGNHITPQIPEWCTNEAKEFLKKTFEINFEMRPDAIELLAEQFLNPLIMSKQ

SEQ ID NO: 41271 - protein, 122 aa, Chromobacterium violaceum ATCC 12472
MDLIQKLEQEEIARLGKTLPEFAPGDTVVVQVKVKEGNRERLQAYEGVVIAKRNRGLNSAFTVRKMSAGEGVERTFQTYSPLVASVEVKRRGDVRRAKLYYLRGRTGKSARIKEKLPARKQG

SEQ ID NO: 41272 - protein, 351 aa, Arabidopsis thaliana
MKKQYLKSGSGTRKEKDKAKRWFLDNGSIFLRELVADCNGKSIPIRSFSPEQILKATNNFDSSCFVSQDVYYKWYRGEIEDRSYMIKRFSEDEITGKRHRVKEVYNDIVLSARMSNHSNFLQPLGCCLEFPFPVLVFEFAEHGAMNQRGGVIVNGEESLLPWSVRLKIGKEIANAVTYLHTAFPKIIIHRDVKPMHVFLDKNWTAKLSDLSFSISLPEGKSRIEAEWVLGTFGYIDPLYHKTCFVTEYTDVYSFGICLLVIITGKPAIMTISDGDLQGILSLVRELCENGKLDEVIDPRLMKDITSGQRLQVEACVVLALRCCKERDEDRPKMIQVAKELKQIEASLKNSS

SEQ ID NO: 41273 - protein, 356 aa, uncultured bacterium
IGAANNLLAAMIDNHIFQGNALNIDPRKITWKRCVDMNDRQLRSVVDGLGGKTNGMPREDGYDITVASEIMAVLCLASDISDPKERLSKIIIGYTYGKVAEQKPVTAGDLHAQGAMAALLKDALKPNLVQTLEGTPAIVHGGPFANIAHGCNSVTATKMCLKLADYTITEAGFGADLGAEKFLDIKCRMAGLKPNAVVVVATVRALKYNGGVPKAELNGENLEALEKGMPNLLKHVSNITNVYKLPCVVAINAFPTDTEAELKLVEEKCKELGVNVVLSEVWAKGGEGGVALAEEVVRLCEQPNDFTYAYDLEGSIEEKLNAIVQKIYGGSRVVLTANAQKQAKQLEALGFGNCPI

SEQ ID NO: 41274 - protein, 356 aa, uncultured bacterium
IGAANNLLAAMIDNHIFQGNALNIDPRKITWKRCVDMNDRQLRSVVDGLGGRTNGMPREDGYDITVASEVMAVLCLASDITDLKERLSKIIIGYTYGKVSEQKPVTAGDLHAEGAMAALLKDALKPNLVQTLEGTPAIVHGGPFANIAHGCNSVTATKMCLKLADYTITEAGFGADLGAEKFLDIKCRMAGLKPNAVVVVATVRALKYNGGAPKAELNGENLEALEKGMPNLLKHVSNITNVYKLPCVVAINAFPTDTEAELKLVEEKCKELGVNVVLSEVWAKGGEGGVALAEEVVRLCEQPNDFTYAYDLEGSIEEKLNAIVQKIYGGSRVVLTANAQKQAKQLEALGFGNCPI

SEQ ID NO: 41275 - protein, 333 aa, Deinococcus radiodurans R1
  misc_feature (309)..(309): Xaa can be any naturally occurring amino acid
  unsure (1)..(333): unsure at all Xaa locations
MAKYRICLIEGDGIGHEVIPAAKRVLEAAGFDAEYVHAEAGYEYFLDHGTSVPEATYDAVENTDATLFGAATSPSGEKPAGFFGAIRHLRQKYNLYANVRPTKTRPVPHSYENVDLVIVRENTQGLYVEQERRYGDTAIADTVITREASDRIGKFAADLAMKRSKRLTVVHKSNVLPVTQGLFMNTILDHTKTVEGLSTSTMIVDNAAMQLVRNPQQFDVMVMTNMFGDILSDLAAGLVGGLGIAASGNVGDQFGIFESVHGSAPDIAGQGISNPTATILAAVIMLDHLGDHETARRLDNAINKVLAEXPRTRDLGGTAGTQEFTEAVIKALA

SEQ ID NO: 41276 - protein, 429 aa, Pyrobaculum aerophilum str. IM2
MPDGLAVWRVLRGAGVKLVKFVVVDIFGRPRAEVLPIEAAREAFLDGVAYDGSSIPAYTTVNKSDLVAVPDLNAVYVESWNGGKTAIVFTNTVDGGKPHPMDPRNVLRQAADYAKSRGYAPVVGAEVEFFLVRGVPPAPADSGVYFDGYLHGDSYAAVEEILGHLEASGIGLSKTHHEVAPGQYEVNIPAGDPVQVADQILVFKIMAKAVAKRRGLTATFMPKPFWGVNGSGMHVHVSFWKDGVNLFASRGEPTQELKWAVAGVLENALRNSAFVAPTVNSYKRLVPHHEAPTRVVWGLGNRSVMVRIPYYGGRINRLEYRHPDPSANPYLAFAVIILSALAGIEKKREPPPPVAEVAYELEEARETPPNLGEALKMARDGTPLPGQFLEAYLRLKEREWEEYITAEGSWETTWNKITKWEYEKYLEEA

SEQ ID NO: 41277 - protein, 295 aa, Blastopirellula marina DSM 3645
MSRKGSEFAGVWVAIVTPFKDGNVDYECLKQQVDFQIAAGVTGLCPVGTTGESPTLSHAEHERVISSVIETAAGRVKVMPGTGSNSTSEALRLTKWAAKEGADAALMVAPYYNKPTQRGFYEHFKAVAEAVDVPICVYNIPGRAGKNIEPETIAQLGELENIQMVKDATGSLDQTSQVLERTNLTVLSGDDSLTIPMMSVGGGGVISVVGNIVPQDMIAMVAAMNAGDLAEAQKRHFQLFGLCREMLGLATNPIPIKAAMKMLGRDTGELRLPMTPLEPSEEAQLRATLTKYGLL

SEQ ID NO: 41278 - protein, 216 aa, Gossypium hirsutum
MDFVVQDYDMVDSGSVSESGTDRPVNFSDEYVMLASSYPKRPAGRKKFRETRHPVYRGVRRRNPGKWVSEVREPNKKSRIWLGTFPKADMAARAHDVAAIALRGKSACLNFADSAWKLPVPASSDPKDIQKTVAEVAETFRTAEHSSGNSRNDAKRSENTEMEKGFYLDEEALFGTQRFWANMAAGMMMSPPRSGHDGGWEEHEVDDYVPLWSYSI

SEQ ID NO: 41279 - protein, 339 aa, Arabidopsis thaliana
FLVGIGVGLISYVVPVYIAEITPKHVRGAFTFSNQLLQNCGVAVVYYFGNFLSWRTLAIIGSIPCWIQVIGLFFIPESPRWLAKKGRDKECEEVLQKLRGRKYDIVPEACEIKISVEASKKNSNINIRSLFEKRYAHQLTIGIGLMLLQQLCGTAGISSYGSTLFKLAGFPARIGMMVLSLIVVPKSLMGLILVDRWGRRPLLMTSALGLCLSCITLAVAFGVKDVPGIGKITPIFCFIGILSFTMMFAIGMGALPWIIMSEIFPMDIKVLAGSLVTIANWFTGWIANYAFNFMLVWSPSGTFIISAIICGATIVFTWCLVPETRRLTLEEIQLSFVNV

SEQ ID NO: 41280 - protein, 1162 aa, Brucella suis 1330
MPKRTDIKSILIIGAGPIVIGQACEFDYSGTQACKALKEEGYRIILVNSNPATIMTDPDLADATYIEPITPEVVAKIIAKERPDAILPTMGGQTALNTALSLRRMGVLERYNVEMIGAKAEAIDKAEDRALFREAMKKIGLDTPGSMLANATEIKDEDRKRHEAKRAEVKAQFSGDELDKALDKLETEWQLGEVERKQRYMSHALAKAAQALDVVGLPAIIRPSFTLGGTGGGIAYNRQEFFEIIERGLDASPTTEVLIEESVLGWKEYEMEVVRDHADNCIIICSIENLDPMGVHTGDSITVAPALTLTDKEYQIMRNASIAVLREIGVETGGSNVQFAINPANGRMIVIEMNPRVSRSSALASKATGFPIAKVAAKLAVGYTLDELDNDITGGATPASFEPSIDYVVTKIPRFAFEKFPGSSPILTTAMKSVGEVMAIGRTFQESLQKALRGLETGLTGFDEIAIPNIEEGDEKNAIRAAIGTPTPDCLRMVAQAMRLGLSVEQVHDASKIDPWFLEQIESIVKTEERIREHGLPQDAENLRMLKAMGFSDARLASLTAKDAEDVAKLRADLDVHPVYKRIDTCAAEFASPTAYMYSTYETPFVGQPRSEAEVSDRKKVVILGGGPNRIGQGIEFDYCCCHAAFALGDADYEAIMVNCNPETVSTDYDTSDRLYFEPLTAEDVLEILRVEKQKGTLHGVIVQFGGQTPLKLANALEKAGIPILGTSPDAIDLAEDRDRFQKLLIKLDLNQPKNGIAYSVEQARLVAADLGFPLVVRPSYVLGGRAMQIIHDERGLQAYLLDTVPELVPEDIKAKYPNDKTGQINTLLGKNPLLFDTYLTEAIEVDVDCLCDGKDSLVAGIMEHIEEAGIHSGDSACSLPVHTLSPEIVAELERQTAALATALHVGGLMNVQFAIKDGEIFILEVNPRASRTVPFVAKTVGTPIAKVAARIMAGESLEAAFDAYGGKPQPTARPHIAVKEAVFPFARFPGVDTLLGPEMRSTGEVMGLDYDYALAFAKAQLGAGVELPREGTVFVSVRDEDKERVLGPVRKLASIGFKVMATGGTQKFLEANGVESTKINKVIEGRPHVEDAIRNRQIHLVFNTTDSASAVSDSKSIRRATLMQKLPYYTTMAGAESAAEAIAALKAGSLEVRPLQDYFRS

SEQ ID NO: 41281 - protein, 156 aa, Haemophilus influenzae
NRANTPVLVDGKDVMPEVNTVLAKMKDFCQRIISGKWKGYTGKAITDVVNIGIGGSDLGPYMVTEALRPYKNHLNMHFISNVDGTHIAETLKKINPETTLFLVASKTFTTQETMRNAQSARDWLLKAAKDESAVAKHFAALSTNAKDVEKFGIDTN

SEQ ID NO: 41282 - protein, 422 aa, Arabidopsis thaliana
MLRLSSKSVARFRCVSKQWASMFASPYFRKLFQTRSSAKPSLLFAIADYGIEEDYSMKFFSSPQLENPYEKSSPTLVAAAEFHVKFSPDKLIPINHSYDPRYFSIGYASGLIYIYGDRYVARPLICNPNTGRYVILPNRYTYRKAYSFFGFDPIGKQYKALSIAYPSDPGRHKILTLGDGDLTWRKIKCPVPRPGIKGDGICINGVLYFLAERNELESDYVIVCFDVRSEKFTYIDVERICRLINYKGKLAMIYWEDDVDIYEINHMAGKNLDKYLEENLDVDATNELHVWVLEDVEKQEWSKYAYTWTDDTFFRRHLSIAGATVSGEIVFSIRKYTSKQPFYVFYFNPESNTLQRVETQGFGEAFKAETCSVRTFVNHVENLDVNDLKQLKSGHPPLVQPENYCLSDSDSESDGQGDEKRG

SEQ ID NO: 41283 - protein, 163 aa, Triticum aestivum
MEYQGQQQHGRVDEYGNPVARHGVGTGMGTHGGVGTGAAAGGHFQPMRDEHQTGRGILHRSGSSSSSSSEDDGMGGRRKKGIKEKIKEKLPGGHGDQQHTGGTYGQQGTGMAGTGGTYGQQGHTGMTGTGAHGTGGAYGQHGTDTGEKKGIMDKIKEKLPGQH

SEQ ID NO: 41284 - protein, 883 aa, Zea mays
MAGRAWHPLLVLLLVAGVAAFAESKVYAPADRVLLNCGSTTDGLDSDGRRWAADTNDNTWLTDSGKSSVMMAADRADNGLPSPIPYMTARVFTVEAVYNFTVNPRDRHWVRLHFYPSSYNGLAADSFHFSVSTSTGITLLRNFSVYTYAKALTQAFIIREFSLPPTPAGFLALTFTPTPMGNESYAYVNGIEVISMPDIFVDPAIMVGFADQTVDIASSTLQTMYRLNVGGSYIPPSNDSGLTRHWYDDTPYVYGATQGVTYRAGPHFQIKYPSETAEYAAPPEVYLDTRSMGSDPRLNQNYNLTWTMAVDGNFTYVARLHFCELLLIRANQRAFDIYVNNKTAQADADVIGMTSEKGVPMYKDYAVYMAEEPDGQAMWVALHPSVALRPQFYDAILNGLEIFKLNDTAGNLAAPGPEPSRLLAKAELGAGEQNAPESQPHPHMARVMGGTASGAAVLGIVAAICVVWYHEKKSRETASNCGSHNSGWLPLFHSNTSGKSSGHIPANLAGMCRHFSFAEIKVATRNFSESLVIGVGGFGKVYRGVVDGDTKVAIKRSNPSSEQGVQEFQTEVEMLSKLRHRHLVSLIGFCEDAGEMILVYDYMEHGTLREHLYMGGKAPLSWRHRLDICIGAARGLHYLHTGAKYTIIHRDVKTTNILVDGDWVAKVSDFGLSKSGPTTVNQTHVSTMVKGSFGYLDPEYFRRQQLTDKSDVYSFGVVLFEVLLARPALDPALPREKVSLADYALSCQRNGTLLDVLDPTIKDQIAPECFKKVADTAEKCLAEQSIDRPPMGDVLWNLEFALQLQDTFEGGSCGRRTVGDDDGSGTGRPALEPSDSNGSTASFTTLRTLSTSRARETCVIMEETDDEVANSAAFSQLVRPSGR

SEQ ID NO: 41285 - protein, 71 aa, Malus x domestica
MDPSAMNNPELLNFINQEKERAMVNEMVGKLTNVCWDKCITGTPGSKFSSSESACLANCARRYLDMSMIIM

SEQ ID NO: 41286 - protein, 57 aa, Brassica rapa
  misc_feature (41)..(41): Xaa can be any naturally occurring amino acid
  unsure (1)..(57): unsure at all Xaa locations
MDPNLANNPQLIQFLSQEKERAMANEGVAKITSSCWDKCVXKPGSKFSSSETSCLSN

SEQ ID NO: 41287 - protein, 1562 aa, Candida albicans SC5314
MIIFRKSFFTFWLLLNSVLALVITQNRVDRGVLDVSVGNITINSGASWSIINNAISTLVGSLTVQPNAGLYITSTSPLLSLQVTLTSLLSTIQNNGIIAFNSSPSLTSSTYNLVGLSLVNTGEMYFSASGVLPSVMALTAASWSNSGLMAFYQNQRSSGIVSLGTPSGSITNNGQICLINEVYKQTTSINGSGCFTANRNSTIYIANVLLPVSTSQNFYLADSQSSIIVQAISTPQVFNVYGFGNGNMVGVTLPLIGNIWNPAYSYNPSTGILRLRNFFVYQDFNIGPGYNPSLFSIVTDNGAGLPSTILGSVSYSGPVPPRALPASCKIACKPVPTAPGTNPTEYTTTITTTNSAGKPLTETGVVDISTDSNGSWFSSTTIFPTSSSSSSSSSTVSSTAPSSSSTKPSSSSQPSSTPPPSSSSKASSTTPSSSSQSSSTTPSSSSKPSSTVPPTGSSQSSSTIPSSSTQPSSTAPSSLSSPSSSTTPSSSSQSSFSAQSSIGQTSSSTVSSSSSQPSSSQPSSSQSSSATTSSSSQFSSSAPPSSTQSSFTAESSNSQLSSTTPSSSTEASSTVPSSSSQLSSSVPLTNSVSLSSVSSSDNGSSSASSPSSSQSSIASTAESSSTFPSSSDQQSSSIQSPSSQESSVSSTPTSSLQSSTNTISSSQDSSSFSPTTSDNSSTNSASSLSTLSSSDTSVSNPSTSNVSSTDNTQSSVASATPTDSAISATSSDITTEFTTTWEVTNSDGSVSTESGIVSESGTSFTTITTFPPPTTSSDITTEFTTTWEVTNSDGSVSTESGIVSESGTSFTTITTFPPPTTSSDITTEFTTTWEVTNSDGSVSTESGIVSESGTSFTTITTFPPPTTSSDITTEFTTTWEVTNSDGSVSTESGIVSESGTSFTTITTFPPPTSSSVAADVTTEFTTTWEVTNSDGSVSTESGIVSESGTSFTTITTFELPVVCKRDDISCGPATSATNSDTAAQDPTSDATAIESEFTTTWTTTNSDGSVETNSGVVSQSGSSLTTITTFAPDATSEYTTSWTTTNSDGSVATNSGVVSQSGTSFTTITTFEPPVVCKRDDISCGPATSAMNSDTAAQQLTSGMTATETEFASTWVVTKSDGSVFTESGIVGQSGTSFTTLTTFAPTTSSGAVQTEYTSTWEVTNTDGSVSTKSGIIDQSGTYFTTLSTFAPTTISGAIETEFTSTWVATDTDGLVSTKSGIVSQSGTSIATLTIFPEPAGTVYPVTTLFTTEYVTTCPNGELSTATGVVVVSTDSKGIEQTVTSVVPSTVYTKETVTSIITHCIKNKCFESTTTLVSSVPCPTQVPGVFTSTDNGHGVPIASIDVTTGAATVSNTIKAQDSTGFTSAGNAITTAITATGAVTTSVGGQGSTDYSNAGNTIAAGSGSDSGSGSGSGSGSGSSSNTVGIVNPKVSSAASGITVAAASASAGQSWPYSSGGSGNGVLPSGANNVGSNQTPTVSGGNSNPSTVTGAAVGAGGVVSGSPSYSGNSLLISFVSSQSGAISSSTGVTIPIATENSGSKFSVGKSAFIAIILTTFIGFI

SEQ ID NO: 41288 - protein, 284 aa, Burkholderia sp. 383
MSRPSFLIGLIGQGIGGSLSPAMHEEEGFRQGFGYVYRRIDLDALGVTVDALPQLLDAAQRMGYNGLNITHPCKQRVIEHLDALSDDARALGAVNTVLFKDGKRIGHNTDWSGFAKSFRRGLPDASLERVVQLGAGGAGAAVAHAALQMGAAELTIFDVDGTRAAALAAELQQRFPAARVAPGGDLASAMRAATGLIHATPTGMAKHPGLPLPAELLHAGMWVADIVYFPLETELIHAARAAGCATLPGGGMAVYQAVDAFEIFTGRTPDAERMFDHFQSLVAR

SEQ ID NO: 41289 - protein, 356 aa, uncultured bacterium
IGAANNLLAAMIDNHIFQGNALNIDPRKITWKRCVDMNDRQLRSVVDGLGGRTNGMPREDGYDITAASEVMAVLCLASDITDLKERLSKIIIGYTYGKVSEQKPVTAGDLHAEGAMAALLKDALKPNLVQTLEGTPAIVHGGPFANIAHGCNSVTATKMCLKLADYTVTEAGFGADLGAEKFLDIKCRMAGLKPNAVVVVATVRALKYNGGVPKAELNGENLEALEKGMPNLLKHVSNITNVYKLPCVVAINAFPTDTEAELKLVEEKCKELGVNVVLSEVWAKGGEGGVALAEEVVRLCEQPNDFTYAYDLEGSIEEKLNAIVQKIYGGSRVVLTANAQKQAKQLEALGFGNCPI

SEQ ID NO: 41290 - protein, 505 aa, Zea mays
MASQAMVPLRQLFVDGEWRPPAQGRRLPVVNPTTEAHIGEIPAGTAEDVDAAVAAARAALKRNRGRDWARAPGAVRAKYLRAIAAKVIERKQELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWTLFGCFWTNGQICSATSRLLVHTKIAKKFNERMVAWAKNIKVSDPLEEGCRLGPVVSEGQYEKIKKFILNAKSEGATILTGGVRPAHLEKGFFIEPTIITDITTSMEIWREEVFGPVLCVKEFSTEDEAIELANDTQYGLAGAVISGDRERCQRLSEEIDAGIIWVNCSQPCFCQAPWGGNKRSGFGRELGEGGIDNYLSVKQVTEYISDEPWGWYRSPSKL

SEQ ID NO: 41291 - protein, 356 aa, uncultured bacterium
IGAANNLLAAMIDNHIFQGNALNIDPRKITWRRCVDMNDRQLRNVVDGLGGKTNGMPREDGYDITVASEIMAVLCLASDIKDLKERLSRIIIGYTYGKVAEQKPVTAGDLHAEGAMTALLKDALKPNLVQTLEHVPAIVHGGPFANIAHGCNSVTATKMALKLADYAITEAGFGADLGAEKFLDIKCRMADLHPSAVVIVATVRALKYNGGVPKADLNNENLEALEKGIPNLLKHVSNIKNVYKLPCVVAINAFPTDTKAELDFVEAKCKELGVNVALSEVWAKGGEGGIKLAEEVLRLVEEPNDFSYAYELEGSIEDKLNQIVQKVYGGKKVVLTANAQKQAKQLEALGFGNCPI

SEQ ID NO: 41292 - protein, 323 aa, Oryza sativa (indica cultivar-group)
MATETTPMTRTISRHPSQGRRCADRLILINLTIIAYFVFRVGRQGSQLCLPNTALDDIDVEGDGHEDPSPVACQVSNTVQIRLQRQCAVNLAPLEAILFDIDGTLCDSDPIHFCAFRELLQQVGFNNGVPISEEFYSANISGGHNDDLARALFPDLDHDKAMKFMDDKEALYRRLAPEQLVAVEGLHDLCRWIKDHKLKRAAVTNAPRSNAELMLSLLGLTEFFPVLVIGSECDRAKPFPDPYLKALELIGASPDHTFIFEDSASGIRAGVAANVPVVGLTTRNPEKVLQDAGASLLIKDFQDPKLLSILEEIEPTVAAVEQV

SEQ ID NO: 41293 - protein, 635 aa, Lotus japonicus
MCGICCVIGVPAGAESIRSTVLDRAKRIRHRGPDWTGVYAKGKNIIVHERLSIVDVETGNQPLKSADGKQVLVCNGEIYNHLQLRQSLKAPVQFATNSDSECILHLYNERGVGFVNSLNGIFGFVLIDEAKDTFIVARDHEGIIPLYYGWDETGALWVASELKALHDVCVRFEEFPPGHVLHGKVGSAGKLEKWYQPVWHDEAYVPAATAACDIKGLRESLEAAVERQMMTDVPYGVLLSGGLDSSVISAVAVRVAAKRAAAKADSKHTELGHVDPKSVVHSFSVGLKGSPDLKAAREVAAFIGTEHHEFVFTVDDGINALRDVIYHLETFDTTTIRASTAMYLMSRKIKALGVKMVLSGEGSDEVFGGYLYFHKAPDRVEFHKETVRKLKALNKFDCLRANKSTMAWGLEARVPFLDKEFLDFAMTLDPTHKMCGKHAGGRIEKWIVRKAFEGYLPPAILWRQKEQFSDGVGYSWIDSLKAFADAKVSDAQLAAAAFKFPENTPLTKESYLYRSIFETHYPEPAARACVPGGPSVACSTPAAIAWDAAFQKMADPSGRAVAGVHADAYAVAADDKTPDTSADAKHGTAAEHKASGATRAPFIAAANGIKCSAEAALPHALPKPVALASGKAEAE

SEQ ID NO: 41294 - protein, 356 aa, uncultured bacterium
IGAANNLLAAMIDNHIIQGNALNIDPRKITWKRCVDMNDRQLRNVVDGLGGRTNGMPREDGYDITVASEIMAVLCLASDISDLKERLSKIIIGYTYGKVSEQKPVTAGDLHAEGAMTALLKDALKPNLVQTLEHVPAIVHGGPFANIAHGCNSVTATKMCMKLADYTITEAGFGADLGAEKFLDIKCRMAGLHPSAVVIVATVRALKYNGGVPKADLNNENLEALEKGLPNLLKHVSNIKNVYKLPCVVAINAFPTDTKAELDLVEAKCKELGVNVALSEVWAKGGEGGIKLAEEVLRLVEEPNDFTYSYELEGSIEDKLNQIVQKIYGGKRVVLTANAQKQAKQLEALGFGNCPI

SEQ ID NO: 41295 - protein, 237 aa, Kluyveromyces lactis NRRL Y-1140
MSRNVNKANSVLVRYQELQAAETGGYQDFSRLKRPTRINKVTKLDEALRWRNELVKEIGQRVTQIHDPSLNESQITEINDELNKLFQEKGRWDFHIRNKLKGPDLKKRKQLNTTGGTLIDGKRYFGRALELPEVQKLLRESKEQREKERSGKEKKAELQRKIKRWESTLKDDYFVGNNSDELLEYEKKRTGSLRSTIHSSDRDPSFVIPNFDVPSLKDVELWLVQRRKNELKKQLGL

SEQ ID NO: 41296 - protein, 899 aa, Oryza sativa (indica cultivar-group)
MALEISMEGIEARARELGVDLSTVDLDSVTLPAGEDFGILSDDEDLLRIDDPMELEMGFANVVVVDNLPVVPPEKFEKLENVIRKIYSQIGAIKEGGLWMPVNPETKKTYGYCFIEYNTPQEAELAREKTNGYKLDKSHIFAVNMFDDFDKYMKVPDEWMPAEIKPYTPGENLQKWLADEKARDQFVIRAGTFTEVYWNDARQKMPELVFQKQYWTDSFIQWSPLGTYLATVHRQGSQVWGGDDKFERLMRFAHAQVKLIDFSPGEKYLVTYSSHEPSNPRDTHRVVLNIFDVRTGKVMRDFKGSADEFSASGNISVSGVSWPIFRWGGGKDDKYFARLGKNVISVYETETFSLLDKKSLKVENVVDFCWSPTDPIIALFVPELGGGNQPARVSLVQIPGKEELRQKNLFSVSDCKMYWQNSGEYLAVQVDRYTKTKKSTYTGFELFRIKERDIPIEVLELDNKNDKIIAFAWEPKGHRFAVIHGDGPKPDISFYSMKTSNNISRVSKLTTLKGKQANALFWSPGGRFIVFAGLKGFNGQLEFYNVDELETMATGEHFMATDIMWDPTGRYLASAVTSVHEMENGFQIWSFSGKQLYKVSKDHFFQFLWRPRPPSLLTPEKEDEIAKNLRKYSKKYEQEDQDAFNQLSEQERKRRKQLQEEWEGWVAKWKQLHEEERPYRMELRDGEASDDEEEYDTKEVEIEEEIIRRFSNPSSCRLGIFLCLGEFQVQASRRCKMQSDAVARSPRQTVRVGGRRPTADPSRGSSEAYGFVGSIAAVAAAAAYLAWAYLPEPWLRFLGVTYYPARHWALAMPSLLLEAAAQGMVLYMASNFLLAPAPTLLGHYLRGTCSDIFCLLPDEFAREPAACGTATGEEKPIEDISDISIDKINNLMFGNASSS

SEQ ID NO: 41297 - protein, 356 aa, uncultured bacterium
IGAANNLLAAMLDNHIYQGNELNIDPRKITWRRCVDMNDRQLRFIVDGMGGKTNGMPREDGYDITVASEIMAVLCLARDITDLKERLGRIIVGYTYGKVSEQKPVTAHDLHAEGAMCALLKDALKPNLVQTLEHVPAIVHGGPFANIAHGCNSVIATKMAMKLGDYAITEAGFGADLGAEKFLDIKCRMADLHPSAVVIVATVRALKYNGGVAKADLNNENLEALEKGLPNLLKHVSNIKNVYKLPCVVAINAFPTDTKAELDLVEQKCKELGVNVALSEVWAKGGEGGIALAKEVIRLVEEPNDFTFSYELEGSIEDKLNQIVQKVYGGKKVVLTANAQKQAAQLEALGYGNCPI

SEQ ID NO: 41298 - protein, 345 aa, Oryza sativa (japonica cultivar-group)
MAAVVTNRRVILKRYVTGLPSEDDMEVVTAKTTLAVPAGSEAVMVKNLYVSCDPYMRGRMTRHEVPSYVPDYVPGEVITNCGVMKVVSSGHPDFKDGDLVWGVTGWEEYTLVNNPKPYLHKINYPEFPLSYYTGVLGIAGLTAYGGFFEVSKPKKGDYVFVSAASGAVGQIVGQLAKITGCYVVGSAGSDEKVKLLKTKFGFHDAFNYKKELDLEGALKRCFPDGIDIYFDNVGGAMLDAVLPNMRIGGKITICGMISQYNLERPDGVRNLFYLFAKSLRMEGFLVSNYIAIYHRYEKEMAGYLREGKVVYVEDIVEGLEAAPAALIGLFTGRNVGKQLVTIARE

SEQ ID NO: 41299 - protein, 356 aa, uncultured bacterium
IGAANNLLAAMIDNHIFQGNALNIDPRKITWRRCVDMNDRQLRNVVDGLGGRTNGMPREDGYDITVASEIMAVLCLASDISDLKERLSRIIIGYTYGKVSEQKPVTAGDLHAEGAMTALLKDALKPNLVQTLEHVPAIVHGGPFANIAHGCNSVTATKMAMKLADYAITEAGFGADLGAEKFLDIKCRMADLHPSAVVIVATVRALKYNGGVAKADLNNENLEALEKGIPNLLKHVSNIKNVYKLPCVVAINAFPTDTKAELDFVEAKCKELGVNVALSEVWAKGGEGGIKLAEEVLRLVEEPNDFTYAYELEGSIEDKLNQIVQKVYGGKKVVLTANAQKQAKQLEALGFGNCPI

SEQ ID NO: 41300 - protein, 337 aa, Oryza sativa (japonica cultivar-group)
MALVAVSNKRVILKRYLTACEIGQLGDEMEVVTAEAVPLSVPAGSSAVLVKNLYISCDPYLRNRMIRHEVPTYISDFVPGEVVTSHGVMKVISSGHLDFKAGDLVWGMTGWEEYTLINNPESLFKINYPEFPLSNYTGVLGSHHTQIKYITGSCNKSQILKKKPQRRRSAGCCRLLSAPAGHRRAAARRRAALRPPRRRPPPRLPAALHAARRAGRRPAVRPRAPPPRWPPPRRPRRPAALRAACRAGRRPAAPAAAPSAAPPRGPPRRVPRRPPPRRAAPRAGCRHVGRAARRPARPIQKEERKEERAGKEERDKAGVREEERKREFVVWTRKEDK

SEQ ID NO: 41301 - protein, 204 aa, Oryza sativa (japonica cultivar-group)
MGLYSGMHGLTAYVGFFEMSKPKKACGAIGQIVGQLAKIKGCYVVGSAGSDDKVNLLKTKFGFDDAFNYKKETDLEAALKRCFPEGIDIDFENVGGAMLDAVLPNMRLGGRITMCGMISQYHLERPEGVRNLMYIITKRLRMEGFVIFDSIAVYRQFEEEMAGYLREGKVTYLEDIVQGLDAAPAALIGIYNGLNVGKQLVAIA

SEQ ID NO: 41302 - protein, 142 aa, Oryza sativa (japonica cultivar-group)
MTTLGKRHRNNSSMRRTTSMSGFAVAEEEEQQGRQPPARAARGGGGGGSAAPSPGWGAMQRRHSGDFAVAETAAFLKACGICNRRLGPGRDTFIYMGEVAFCSHECRQQQMNLDELNEKKCFQREGGGGSDKSGNSGAVAAA

SEQ ID NO: 41303 - protein, 449 aa, Aspergillus nidulans FGSC A4
MAGSKVVEKGSVDGAPAAKLHITELPMTWSNWYQHVNWLNCFFVLFIPLVGCIGAIWTPLRLHTAIFAIIYYFNAGLGITAGYHRLWAHCCYKATLPLQIYLALAGAGAGQGSIRWWSRGHRAHHRYTDTEKDPYSVRKGFWYSHIGWIIMKQNYKKVGRSDASDLDADPVVIWQHKNYINTALFMTLIFPTLVCGLGWGDWRGGFIYGGILRVFFIQQATNCVNSLAHWIGEQPFDDRNSPRDHVITALVTLGEGYHNFHHEFPSDYRNAIEWWQYDPTKWMIWIWKQVGLAYDLKQFRANEIEKGRLQQMQKKVDARRAALDWGVPLKELPVFSWDEFIAESANRALVAIGGVIHDVSDFIKEHPGGKTFISSAVGKDATAMFNGGVYQHSNAAHNLLAMKRVGVVRGGGEVEIWKDAKQPSKVSFPEMVRAGEQITRRTVPVLDRS

SEQ ID NO: 41304 - protein, 400 aa, Brucella suis 1330
MAFLADALSRVKPSATIAVSQKARELKAKGKDVIVLGAGEPDFDTPENIKQAAIAAINRGETKYTPVSGIPQLRQAIVSKFKRENGLDYKPEQTIVGTGGKQILFNAFMATLNPGDEVIIPAPYWVSYPEMVAINGGTPVFIDTKIEDNFKLTAADLEKAITPKTKWLIFNSPSNPTGAAYTQAELKSLTDVLVRHPHVWILTDDMYEHLVYGDFVFTTPAQVEPSLYDRTLTMNGVSKAYAMTGWRIGYAAGPIELIKAMDMIQGQQTSGACSIAQWAAVEALNGTQDFIPANKKIFQARRDLVVSMLNQATGLQCPTPEGAFYVYPSCAGLIGKKTEAGKVIETDKDFVTELLETEGVAVVHGSAFGLGPNFRISYATSDELLEKACIRIQRFCASLR

SEQ ID NO: 41305 - protein, 156 aa, Haemophilus influenzae
NRANTPVLVDGKDVMPEINAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKNESAVAKHFAALSTNAKDVEKFGIDTN

SEQ ID NO: 41306 - protein, 659 aa, Haemophilus influenzae Rd KW20
MFKIYNNGNPIPMGYSQAVENNVQITNFALFSAAAIGVELCLFDEQNQETRLPMVRTENVWHLAVTGVKTGTEYAFRIHGEFANPQKLILDPYAKAVNGKPDLSSEESRSWFLLSDNRDNAHLAPRAVVISEEFDWENDTSPNTPWAETIVYELHVKGFSQLNEKIPAALRGTYTGLAHPVNLAYLKELGVTAVELLPVNFHINEPHLQARGLQNYWGYNPLAMFAVEPKYAATNNPLAEFKTMVKAFHKAGIEVILDVVFNHSAESEQTYPTFSQRGIDDQTYYWRNDQGRYINWTGCGNMLNLSSDVGRKWVVDCLRYWVEQCHIDGFRFDLATVLGRDTPDFNSSAQLFTDIKNEPSLQNIKLIAEPWDIGHYGYQVGNFPSYFAEWNDRFRDDLCRFWLWKSGEIGAFAERFAGSSDLFKKNDRLPHTTLNFITAHDGFTLKDLVSYNQKHNETNGEENRDGRNENYSYNHGVEGSTESLSEPQKSAVENNRTFAQSGLLMSLLLANGTPMLLAGDEFGNTQYGNNNAYCQDNEITWLKWANFNEELFELTKQTIALRKQIGSLNKDQWWSDENVQWLNIVGEPMTVEDWQNQQTKALQVVLDNRWLLLINAKAEGQMFHLPNRKWKPQIGTHNVTLEAQQAELSSMGFCMLNDE

SEQ ID NO: 41307 - protein, 444 aa, Haemophilus influenzae Rd KW20
MTNNNKTMEILMKSGDLNKYDLVKNALVLVLAGGRGSRLHELTDKRAKPALYFGGNRRIIDFALSNCINSDLNRIGVVTQYAAHSLLLHLQTGWSFLPQERGEFVDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEQEVNTPQTSHDFGKDVLPKCLEEGALYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVDMEEDKKRFRISSTGKVILVTSKMLKILEGHEIGEEGHLD

SEQ ID NO: 41308 - protein, 1427 aa, Burkholderia thailandensis E264
MTSASVKTVCPYCGVGCGMVLHVEGGEVVKVSGDAEHPANFGRLCTKGSSAHVALRNAGRLERAFVRDARERDPAPVPIADAIAETARRLRATLDAHGPDALAFYVSGQMSLEAQYLVNKLAKGYVRTPHIESNSRLCMASAGSGYKLSLGADGPPGSYQDFDCADLFFVIGSNMADCHPILFLRMMDRVKAGAKLVVVDPRRTATADKADLFLKIRPGTDLALLNGLLHLLHANGQTDADFIAAHTEGWAAMPDFLGDYTPEKVAAITGLTEADIRLAAQWIGDAREWTSCWTMGLNQSTHGTWNTNAICNLHLATGKICRPGSGPFSLTGQPNAMGGREMGYMGPGLPGQRSALDGDDRRFAEDVWGLPAGTIRADAGGGTVDLFARMAAGGVKACWIICTNPAATVANRKNVIAGLQAADVVIVQDAFLDTETNRYADILLPGALWAEAEGVMINSERNLTLMRRAVEPPGDAWPDWRIVAAVAREMGYGDAFDYGSAAEVFDEIRRFANPKTGYDLRGASHAALRDAPLQWPCPPHDGRDRHPIRYLNDGVSQARATLADGRVPPLAFPTPTGKARFFARPHVAPAEMPTPEFPIVLNTGRLQHQWHTMTKTGKVAMLNKLNPRPFVEIHPDDAAALSIAAKDAVEIRSARGRAVLPAVVTDRVRPGACFAPMHWNDVYGDDLCVNAVTNDAVDPVSLQPELKFCAVALARVDAMGNADVDADDETDDRVRASRAALHETGSHEADAHEADAHAAPDAHGASRAEADASEEHHMSDIDTFAALLGIPAAASAPQLTDAQRVYAAGFVSGLRSAEGRRAAGVPMLPASAPFDANTRLWVDGLLAGLFSRAPGGAAARVDARAAAQPAAIAAADASSAPSGVRIVRTRPKVVLLWASQTGNVESLTERYATQLMDSGFEIRVACMADYPAASLAKAQYALLMTSTFGDGDAPDNGQEFWAALNAADAARADGLRYAVLAFGDRNYDQFCGHGRRLDARLAALGATRLAERVDCDAEFQPAADAWLDRAIARIKEEDAALHAVPADGMIPSGAIPTKTRPAASRLVANLRLNAPGAAKDTRYVSLSTDGAAIEYEAGDALGVWPTNCPELVDELLTLTRLTPDAPVTVAGVGELRLADALAKHFDITRPHPDALAFVAARSRSGDALARLLGDDRKTDLKHWLWGQQLADVLHEFPLELSAVELVGMLKRLQPRLYSIASSPNAHRGEIHLTVSAVRYGNGRRQRKGVASTFLADRAADAPVPVFVQKSAHFRPPASGDAPIVMVGPGTGVAPFRGFLHERRARGAKGRNWLFFGEQHADTDFYYRDELAQMRADGFLTRLDVAFSRDQAEKVYVQDRMLEQGAALWAWLEEGAHFYVCGDASRMAKDVDAALKTIVARHGGMTDEQAADYVARLAKDKRYARDVY

SEQ ID NO: 41309 - protein, 572 aa, Arabidopsis thaliana
MGKPARWLKSVLLGKKPSKSSGSKDKERIVNGKEVVVISKIEESDVVSDLSSIGNAAVYTSGIVETQNLKHEDVSDDEIQVSEVQPTDSQDVASVPDDSLSESEKIQQEIAAVTVQAAYRGYLARRAFKILKGIIRLQALIRGHMVRRQAVSTLCCVMGIVRLQALARGREIRHSDIGVEVQRKCHLHHQPLENKANSVVDTHSYLGINKLTGNAFAQKLLASSPNVLPLSLDNDSSNSIWLENWSASCFWKPVPQPKKASLRKSQKKFASNPQIVEAEFARPKKSVRKVPSSNLDNSSVAQTSSELEKPKRSFRKVSTSQSVEPLPSMDNPQVDLEKVKRGLRKVHNPVVENSIQPQLVPQIAVEKPNGSLEESVNAFDEEKEDEVAETVVQQPEELIQTHTPLGTNESLDSTLVNQIEESEENVMAEEKEDVKEERTPKQNHKENSAGKENQKSGKKASSVTATQTAEFQESGNGNQTSSPGIPSYMQATKSAKAKLRLQGSSSPRQLGTTEKASRRYSLPSSGNSAKITSHSPKTRVSNSSGKSGNKTEKTLLSSREGNGKATPVEWKR

SEQ ID NO: 41310 - protein, 450 aa, Hebeloma cylindrosporum
MVKPFEPEFQQALDELTTSLQPFLDANPQYKKALEIVQVPERVLQFRVVWEDDQGVAQVNHGFRVQYNSALGPYKGGLRLHPSVNLSILKFLGFEQTFKNALTGLSMGGGKGGSDFDPKGKSDSEIRRFCFSFMGELFRHIGSDTDVPAGDIGTGGREIGFLFGAYKKLRNEFTGMLTGKGLTWGGSFIRPEATGYGLIYFVEHMIAKACPEYSLDKPSTLVAISGSGNVAQFTALKVIELGATVLSLSDSKGSLISDKGYTKEFIRKVADLKLKGGSLASLANEEGYTYHAGARPWTLIPTIHIALPGATQNEVSAEEAEALLKAGVRIVAEGSNMGCTADAIDIFESSRKAGPGGVWYAPGKASNCGGVAVSGLEMAQNSQRLAWTTQEVDSKLKDIMAECYGICLTAGTKWSGEELTDEVLPSLLSGANVAGFIKVADAMKAQGDWW

SEQ ID NO: 41311 - protein, 306 aa, Arabidopsis thaliana
MPLNLGNDGDGSSRIILTEPRGSTAEVLLFGGQVISWKNERREELLYMSSKAQYKPPKAIRGGIPVCFPQFGNFGGLERHGFARNKFWSHDEDPSPLPPANKQSSVDLILKSTEDDLKTWPHSFELRIRISISPGKLTLIPRVRNIDSKAFSFMFALRNYLYVSDISEVRVEGLETLDYLDNLIGKERFTEQADAITFDGEVDRVYLNTPTKIAVIDHERKRTIELRKEGMPNAVVWNPWDKKAKTITDMGDEDYKTMLCVDSGVIEPLVLLKPREKWKGRQELSIVSSSYCSGQLDPRKVLYGDI

SEQ ID NO: 41312 - protein, 222 aa, Brassica napus
  misc_feature (193)..(193): Xaa can be any naturally occurring amino acid
  misc_feature (201)..(201): Xaa can be any naturally occurring amino acid
  misc_feature (214)..(214): Xaa can be any naturally occurring amino acid
  unsure (1)..(222): unsure at all Xaa locations
TWGQFKSCLWKQWWTYWRSPDYNLVRFIFTLATSLLIGTIFWQIGGNRSNAADLTMVIGALYAAVIFVGINNCSTVQPMVAVERTVFYRERAAGMYSAMPYAISQVTCELPYVLIQTTYYSLIVYAMVEFEWTAAKFFWFLFVSYFSFLYWTYYGMMTVSLTPNQQVASIFASAFYGIFNLFSGFFIPRPKIXPKWWIWVXTWICPGAWTVYGXLIVSQYGD

SEQ ID NO: 41313 - protein, 233 aa, Arabidopsis thaliana; identical to SEQ ID NO: 1364

SEQ ID NO: 41314 - protein, 451 aa, Gibberella fujikuroi
MSHLPQEPEFEQAYGELASALENSSLFNEHPEYRTALAVAAIPERVIQFRVVWNDDKGNLQVNRGYRVQFNGALGPYKGGLRFHPSVNLSILKFLGFEQIFKNALTGLNMGGGKGGADFDPKGKSDAEIRRFCQAFMTELSKHIGAETDVPAGDIGVGGREIGYLFGAYRKFANRWEGVLTGKGLSWGGSLIRPEATGYGLVYYVEYMLKHANRGTFEGKRVALSGSGNVAQYAALKIIELGGSVVSLSDSKGALVAKEGSSFTPEQIHNIAALKIKHQALTTFEHDGQFTWIEGARPWVHVGKVDIALPSATQNEVSKEEAQALVDAGAFIVAEGSNMGCTAEAIDVFEAHRKEKGAEALWYAPGKASNCGGVAVSGLEMAQNSQRIQWTEKEVDDRLKAIMKDAFVAGLETAQKYVEAKEGELPSLIAGSNIAGFIKVAEAMHDQGDWF

SEQ ID NO: 41315 - protein, 606 aa, Campylobacter lari RM2100
MGLADIMSVLSTHLVHNPKDPTWLNRDRLVFSGGHASALLYSFLHLSGYDVSLDDLKNFRQLHSKTPGHPEIFTPGVEIATGPLGQGVANAVGFAMAAKKASLLLGEDIINHKVYCLCGDGDLQEGISYEACSLAGLHKLDNLIIIYDSNNISIEGDVAIAFNENVKERFRAQNFEVLEIDGHDFEQIDLALKTAKQSQKPCLIIAHTKIAKGALELEGSHHSHGAPLGEELIKKAKEALGFDPQKTFEIPEDVKIRFGAAVELGDLAQAKWNQKVQNLDESKKALLKELLEPDFSKINFPDFKGKDLATRDSNGMILNAIAKALPGFLGGSADLGPSNKTELKDMGDFPNGKNIHYGIREHAMAAISNAFARYGLFLPYCATFFIFSEYLKPAARIAALMKIKHFFIFTHDSIGVGEDGPTHQPIEQLSTFRAMPNSLTFRVADGVENVKAWQIALKTNMPSVFVLSRQKLSALNEPVFGDVLNGAYLLEENENANFTLLASGSEVALCVKAAKILKEKGVSVNVVSMPCYELFIKQEKSYKDRILQGKVIGVEAANSNELYRFCDELYGIESFGESGKDKDVFEHFGFSEEKLSSYILSLCNEK

SEQ ID NO: 41316 - protein, 269 aa, Haemophilus ducreyi 35000HP
MKNLTGIFSALLVAFNEDGSINERGLRQIVRYNIDKMKVDGLYVGGSTGENFMLSTSEKKEIFRIVKDEVRDQIALIAQVGSVNVQEAVELGKYSTELGYDCLSAVTPFYYKFSFPEIKHYYDTIIAETGNKMIVYSIPFLTGVNIGVEQFGALYQNPNIIGVKFTAGDFYLLERIKKAYPNHLIWAGFDEMMVPAVALGVDGAIGSTFNVNGLRARQIFDAVKSGKLAQALQIQHVTNDLIEGILANGLYLTIKELLKLEGVEAGVLS

SEQ ID NO: 41317 - protein, 285 aa, Prochlorococcus marinus str. NATL1A
MTVSFEKKKKPYPHWEYSNPEFDSSIRIVPERGGLITEWRSEGKELLYFDLERFLDKDKSVRGGIPILFPICGDLSEGYSNGGKKYFLKQHGFARDLPWSINLLKDKLGIRLKLTDTKDSRSYFPFFFTLWMDVCLKEKSLQISIKIHNQSQDSMPFSFGLHPYFQVSNTQKIKIDGLPEKCIDQTNMKVTNVSDQIRILDKGVDFLSYPSSSVKMFDFLSRNVIELIHQEPMDTTVIWTDPPRQMVCLEPWTSPRNSLVTGDRKLEIKPEEYIDLSTTFQHNSF

SEQ ID NO: 41318 - protein, 457 aa, Tuber borchii
MSNLAPEPEFQQAYNELVHSLRDQNSSRLPQILRLLCLSSPPERVIQFRVTWEDDKGNFQVNRGYRVQFNSALGPYKGGLRFHPTVNLSILKFLGFEQTFKNALTGLNMGGGKGGSDFDPKGKSDNEIRRFCYSFMRELSKHIGQFTDVPAGDIGVGGREIGYLFGAYESYKNQFEGVLTGKGITWGGSLIRPEATGYGLVYYVAHMISYASGGKETFAGKRVAISGSGNVAQYAALKVLELGGKVITLSDSKGALIATGEEGFNETDIELIAKLKLDRGYLTQLHAAEDSFKSRFKYLPGERPWCHVDKVDVALPSATQNEVSEQEAKELIASGCKFLAEGSNMGSTQEAINVYEEDRKSRKADGLWYGPAKAANCGGVAVSGLEMAQNSQRLTWTSEQVDKELAGIMERCFWNCLNPAKEYFDIAEGELPSLVAGANIAGYVKVVNAMKAQGDWW

SEQ ID NO: 41319 - protein, 356 aa, uncultured bacterium
IGAANNLLAAMIDNHIFQGNALNIDPRKITWKRCVDMNDRQLRSVVDGLGGRTNGMPREDGYDIAVASEVMAVLCLASDITDLKERLSKIIIGYTYGKVSEQKPVTAGDLHAEGAMAALLKDALKPNLVQTLEGTPAIVHGGPFANIAHGCNSVTATKMCLKLADYTITEAGFGADLGAEKFLDIKCRMAGLKPNAVVVVATVRALKYNGGVPKAELNGENLEALEKGMPNLLKHVSNITNVYKLPCVVAINAFPTDTEAELKLVEEKCKELGVNVVLSEVWAKGGEGGVALAEEVVRLCEQPNDFTYAYDLEGSIEEKLNAIVQKIYGGSRVVLTANAQKQAKQLEALGFGNCPI

SEQ ID NO: 41320 - protein, 454 aa, Neurospora sitophila
MSNLPSEPEFEQAYKELAYTLENSSLFQKHPEYRTALAVASIPERVIQFRVVWEDDNGNVQVNRGYRVQFNSALGPYKGGLRLHPSVNLSILKFLGFEQIFKNALTGLSMGGGKGGADFDPKGKSDAEIRRFCCAFMAELHKHIGADTDVPAGDIGVGGREIGYMFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAIMAIKEARQSLTTFQHAGHVKWIEGARPWLHVGKVDIALPCATQNEVSKEEAEGLLAAGCKFVAEGSNMGCTLEAIEVFENNRKEKKGEAVWYAPGKAANCGGVAVSGLEMAQNSQRLNWTQAEVDEKLKDIMKNAFFNGLNTAKTYAEAAEGELPSLVAGSNIAGFVKVPQAMHDQGDWWSKN

SEQ ID NO: 41321 - protein, 435 aa, Deinococcus radiodurans R1
MHFGGRVPLFLSCCRLHLSGVPMKPRVLGMILAGGQGSRLAPLTQKRSKPAVPFGSKYRIIDFAINNFINSGMFSVYVLTQYKAQSLTEHIQRGWRFGTFLSDYFITLVPAQMYRFEELGDAWYRGTADAVYQNMHLIDNFEADYVAIFSGDHIYKMNVEHMLEKHIETRADVTIAAYPMPQSQAHQFGVMQVDERWRVTEFHEKVPDPPTIPGQADLSLTSMGNYIFSRRALEELLEASISGQETGYDFGHNVIPRALSDGYHVQAYDFHKNPIPGQERPNTYWRDVGTLDAYFEANMDLVSVNPEFDIYNPEWPLRTSSEFSPPAKFVHESEGRKGQAFNSIMAGGAIISGGTVRDSVLGRNVRTHSYSLVESCVLFDDVQVGRHSHLRRVIVDKDVVIPPGTTIGLNREHDEQRGFTVTEHGVVVVPKGYVF

SEQ ID NO: 41322 - protein, 454 aa, Neurospora intermedia
MSNLPSEPEFEQAYKELAYTLENSSLFQKHPEYRTALTVASIPERVIQFRVVWEDDNGNVQVNRGYRVQFNSALGPYKGGLRLHPSVNLSILKFLGFEQIFKNALTGLSMGGGKGGADFDPKGKSDAEIRRFCCAFMAELHKHIGADTDVPAGDIGVGGREIGYMFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAVMAIKEARQSLTSFQHAGHLKWIEGARPWLHVGKVDIALPCATQNEVSKEEAEGLLAAGCKFVAEGSNMGCTLEAIEVFENHRKEKKGEAVWYAPGKAANCGGVAVSGLEMAQNSQRLNWTQAEVDEKLKDIMKNAFFNGLNTAKIYVEAAEGELPSLVAGSNIAGFVKVAQAMHDQGDWWSKN

SEQ ID NO: 41323 - protein, 356 aa, uncultured bacterium
IGAANNLLAAMIDNHIFQGNALNIDPRKITWRRCVDMNDRQLRNVVDGLGGRTNGMPREDGYDTTVASEIMAVLCLASDIKDLKERLSRIIIGYTYGKVSEQKPVTAGDLHAEGAMTALLKDALKPNLVQTLEHVPAIVHGGPFANIAHGCNSVTATKMAMKLADYAITEAGFGADLGAEKFLDIKCRMADLHPSAVVIVATVRALKYNGGVAKADLNNENLEALEKGIPNLLKHVSNIKNVYKLPCVVAINAFPTDTKAELDFVEAKCKELGVNVALSEVWAKGGEGGIKLAEEVLRLVEEPNDFTYAYELEGSIEDKLNQIVQKVYGGKRVVLTANAQKQAKQLEALGFGNCPI

SEQ ID NO: 41324 - protein, 461 aa, Penicillium chrysogenum
MMQNLPFEPEFEQAYKELASTLENSTLFQKKPEYRKALQVVSVPERVIQFRVVWEDDKGQVQINRGYRVQFNSALGPYKGGLRFHPTVNLSILKFLGFEQIFKNALTGLNMGGGKGGSDFDPKGKTDNEIRRFCVSFMTELCKHIGADTDVPAGDIGVTGREVGFMFGQYKKIRNQWEGVLTGKGGSWGGSLIRPEATGYGVVYYVEHMIQHASGGKESFAGKRVAISGSGNVAQYAALKVIELGGSVISLSDSQGALVLNGEEGSFTAEEINTIAEIKVQRKQIAELATQDAFSSKFKYIPGARPWTNIAGRIDVALPSATQNEVSGDEAKALIAAGCKFIAEGSNMGSTQEAIDVFEAHRDANPGAAAIWYAPGKAANAGGVAVSGLEMAQNSARVNWSREEVDSRLKKIMEDCFNNGLSTAKEYVTPAEGVLPSLVAGSNIAGFTKVAEAMKEHGDWW

SEQ ID NO: 41325 - protein, 356 aa, uncultured bacterium
IGAANNLLAAMIDNHIFQGNALNIDPRKITWRRCVDMNDRQLRNVVDGLGGRTNGMPREDGYDITVASEIMAVLCLASDIKDLKERLSRIIIGYTYGKVSEQKPVTAGDLHAEGAMTALLKDALKPNLVQTLEHVPAIVHGGPFANIAHGCNSVTATKMAMKLADYAITEAGFGADLGAEKFLDIKCRMADLHPSAVVIVATVRALKYNGGVAKADLNNENLEALEKGIPNLLKHVSNIKNVYKLPCVVAINAFPTDTKAELDFVEAKCKELGVNVALSEVWAKGGEGGIKLAEEVLRLVEEPNDFTYAYELEGSIEDKLNQIVQKVYGGKRVVLTANAQKQAKQLEALGFGNCPI

SEQ ID NO: 41326 - protein, 346 aa, Oryza sativa (japonica cultivar-group)
MAATVVSNKRVILKRYVTGLVSEDDMEVVTVEAPPLAVPAGSKTVVVKNLYISCDPYMRNRMTYHEEPSYVPDFVLGEVLVNFGVMKVISSGHQDFKAGDLVWGITGWEEYTVINNPETLFKINHPELPLSYYTGILGMPGLTAYGGFFEVAKPKKGEYVFISSAFGAVGQIVGQLAKITGCYVVGSAGSDEKVNLLKTKFGFDDAFNYKKELDLEAALKRCFPDGIDIYFENVGGAMLDAVLPNMRVAGRIAACGMISQYNLEQPEGVYNMICIVTKRLRMQGFLVFDFYDMYYQIEEQIAGYLKEGKVAYTEDVVEGLDAAPAALVKLFTSSSIGKQLVAVARE

SEQ ID NO: 41327 - protein, 503 aa, Oryza sativa
  misc_feature (364)..(364): Xaa can be any naturally occurring amino acid
  unsure (1)..(503): unsure at all Xaa locations
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGXRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWYKSPSKL

SEQ ID NO: 41328 - protein, 534 aa, Pyrobaculum aerophilum str. IM2
MSWEEVYKKNLIEKIKRDKHPFKLLEELETLARRHYSDIPEEEFIRLYWLGVVHDRPRTGYLMLRLRIPGGILKPHQLRRIGELSYKYGKNYAEITVRQDIQLHWIELKYLPEVLAQLKDVGILTIGTEGDTVRNITTCPLAGLTVNELFDVRDDVYKIDKAFLLDPIYADLPRKFKITITACPYMCSVPEIQDLALIGVTKDGKYGYTVLIGGGLSLAPRVGRHMPVFVPREMVIEFVKAVLDVWREEPRYRLSRVRARIKFMIDDLGVDKFRELVENRLGQRLEDYPSKPESLGKTDHIGVERLKDGTYAVGVAIPAGIVTGEFLIKLADLAEAVGVKEVRLTQRQNLILAGVPEDKVEIVKEFCQKWGYAVEQTPLVAMSVACTGDPYCNYSISDTKGLLLELIKSLKERFGEIQDLPPIHIVGCPHACAWYWIGNIGLMATTAKMPDGRFVKAYDVLVGGDYGKRTAIGKVLFKKVPADKIKDCITYLVEYYINKRAPGEDFPTFIARIDLRELADYISGKLGVQLALGK

SEQ ID NO: 41329 - protein, 584 aa, Deinococcus radiodurans R1
MTSIPAVPAAPSGSLPRPWLTSYEPGVPQDLAPSSRTLYRLLEDAATRYPNREALQFLGQGTTFRELLKRVRRFAKALQRSGVQQGDRVAIMLPNCPQFVVAFYGTLLAGAVVVNTSPLYTAAELEHQLSDSGSETLVILDSLYPRYAEVADKVPVKRVLVSRIQDELPFPKNLLFPIKALKEGTLASDSFKRNPRAVPMRFVTKLQDPDPVSVPITADDVALLQYTGGTTGVPKGAMLTHRNLVANAEQCRSWMVGLQEGREITMAAIPFFHVYGMTVAMNLSMLIGATLVLVPNARDIKMVLDEISRTRATIFPGVPTLYNAINNHPDTAAHDLTTIRACISGSAPLMQDTARTFREITQGANLVEGYGLTETSPVTHVNPITGEQKEGSIGLPLPGVDALIMDDAGQPVPTGEVGELWVAGPMVMKGYWNMPDETAKVLREYAGKTWLLTGDMATMDEQGFFRIVDRKKELIIAGGHNIYPREVEEVLTSHPAVLEAAAVGLPDPYRGETVHAVVALKPGMQATEKEIIAYCRTLLSAYKAPRSVEFRDELPKTAVGKTLRRQLAAEARERLKKEKAEKSA

SEQ ID NO: 41330 - protein, 398 aa, Mycobacterium avium 104
MAPGMTPYLKWLLRARPADYALAVSLAGASLPVVGRHLEPLAGLTAMGMWGARHAPEVISAATRDMFAPGGGDARRRDRESTQQVSLAALRGLVSAAELESQWPVAQRTPPIWDGVRRHRHLYRRAVHYGHHPAQVLDVWRRKDLPAQPAPVLIFVPGGAWVHGKSMGQGSALMSRLAEQGWVCLAIDYRVAPHHRWPRHIVDVKTAIAWARANVDKFGGDRNFVAIAGCSAGGHLSALAGLTPDDPQYRGMLPEGADTSVDAVVGIYGRYDWEDRSTPERVRFVDFLERVVVRKSIARHPEVFRDASPIARVHRNAPPFLVIHGSKDSVIPVEQARSFVERLRAVSHSTVGYLELPGAGHGYDLIDGERAGAAAHVCSLFLDQVHRSKTRIGAKEVI

SEQ ID NO: 41331 - protein, 352 aa, uncultured bacterium
ITSAHMLLSAMVDNHVQQGNALNIDPRRIVWKRVVDMNDRELRNIVVGLGGKAHGVPRQDGFDITVASEVMAILCLASSLHDLKERLSKIIVAYDYNGKPVTAGQIKAHGAMAALLKDAVKPNLVQTLENVPAIIHGGPFANIAHGCNSVMATKTAMKLADYTITEAGFGADLGAEKFFDIKCRYAGLKPDAVVLVATVRALKMHGGVPKTDLTAPNVDAVKKGIVNLEKHIENIKKFGLPLVVAINIFAQDTPEELEAVRAHCAAHGVNVALSDVFAKGGAGGVELAKEVVALAESGKADFAPIYASELTLKEKITTVAREIYGAGDVVYAKEAETALKDFESLGYGNLPI

SEQ ID NO: 41332 - protein, 415 aa, Kluyveromyces lactis NRRL Y-1140
MKVGELLESSGAGGSRSIIAYTNDKNAGFETEMDSILPSDDLKQGSLHSKNSHGNDVKIVPDEDEVITRRTVVKGHSNPEESVVISCGTPEIVGNGSFGVVFRTKVKETGEDVVIKKVLQDRRFKNRELEIMKLISHPNLIDLKYYFLEQSDQELYLNLIVDYMPMSLYQRLKEFISLHQPMDRYEIKIYMFQLFKSLNYLHQVVNVCHRDIKPQNILVDPDTLLLKICDLGSAKQLKPNEPNVSYICSRYYRAPELIFGATNYTTKIDIWSAGCVMAELLLGQPIFPGESKIDQLVEIIKVLGTPTREEICSMNENYSEHKFPQIRPIPLNRIFKKETQETIDLLYHIMKYDPNIRYSALQCMFNSTYFTDIVSNTGSDSNLSLIDSLPLLHFEESELQGLSSNDIYRLTGKLI

SEQ ID NO: 41333 - protein, 355 aa, Triticum aestivum
MENRDGSSLPDFLELQRTRVLCKADAPTHTEGFQYSGAFAAMGVDTSVSVEKFCKNFKIEINRLTDEDMEFDMIGVDASIANAFRRILIAEVPTMAIEKVFMVDNTSVIADEVLSHRLGLIPLDADPRLFDYISDDVPNERNTIVYKLHVSCEKGSQRLTVKSGQLEWLPEGSQLTMASPAQSGDNQRTYTSFGQSQQNTSERPLGVKYNDITIARLGPGQAIELEAHAVKGVGKVHAKWSPVATAWYRMLPEVVLLKEIKNGDAEELVKRCPVNVFDIEDLGKGEKRAVVAKPRSCTLCRECVRLADDQVELRRVRDHFIFTIESTGALPPEVLFTEAVKILEEKCERVISELS

SEQ ID NO: 41334 - protein, 730 aa, Blastopirellula marina DSM 3645
MVGDIILARDGHLTRQLLLEPAKFGLGKTRQSESPDATTTSVCGFCSTGCGLEIHLKEGRSVNLTPSTDWPVNLGMACPKGWEALNVLQSSDRATRPLRRGASGELEPTSWDEALHYFCQQMKGVQSRHGNDAVAFLSTGQIATEEMAFLGSLAKFGMGMQHGDGNTRQCMATAATAYKESFGFDAPPFSYADFEESDTLIFVGSNICIAHPILWERVLRNRHQPEIIAIDPRLTETAQAATSHLKIQPKSDLTLLYAVANYLIQKDWIDREFIAAHTNDFEPFAQHVQSYTIERAMELTGLSEQAIVELAEKIHRGQRVSFWWTMGVNQSHEGVRTAQAIINLALMTGNIGRPGTGANSITGQCNAMGSRLFSNTTNLLGGHSFTNEADRQKVAGILEIPIERIPTENSWAYDQIIEGIRQEKIKGLWVIATNPAHSWIHQNDLQEIFQKLDFLVVQDMYSNTETAQLADLVLPAAAWGEKEGTFINSERRYGLHKKVSPAPGEALADFQIFRAVADYWGCGEMFSKWTEPERVFETMQQLSEGQPCDISGIAGYAELDDRRGVQWPCATGETDRSVERRLFETGRFYHADEKAKFIFEDSRRPGETADDEFPFVLLTGRGAAAQWHTQTRTAKSSVLRKLYPNVLQVDLHPADAKALGIAPHELIHVESRRGIVQAHANLTAAVGRGQVFMPMHWDTVNQLTFAEFDPYSRQPSYKNAAVRLRRRQDV

SEQ ID NO: 41335 - protein, 356 aa, Triticum aestivum
  misc_feature (25)..(25): Xaa can be any naturally occurring amino acid
  misc_feature (172)..(172): Xaa can be any naturally occurring amino acid
  unsure (1)..(356): unsure at all Xaa locations
MAGSDEVNRNACKTVVPLHTWVLIXNFKVSYHMLRRPDGTFERDLAEYMDRRVPANPRPVEGVSSFDHVIDHSVGLEARIYRAVAGNAAAAAEGAAALTLPILEFLGGATSPEPLPVIIFFHGGSFAHSASSTTIYDNLWRQFVKLSKGVVVSRHYRRAPEHRYPCAYDDGXWAALKWAQAQPFLRSGSDARLRVFLAGDSSGGNIAHHVAVRAAEEGIKIHGNILLNAMFGGVERTESERRLDGKYFVTLQDRDWYWKAYLPEDADRDHPACNPFGPNGRRLRGLPFAKSLIIVSGLDLTCDRQLGYAEGLREDGHDVKLVHREKATIGFYLLSNTNHYHEVMEEIAEFVRANLL

SEQ ID NO: 41336 - protein, 179 aa, Glycine max
MKRMIALGFEGSANKIGVGVVTLDGTILSNPRHTYITPPGQGFLPRETAQHHLQHVLPLIKSALETAQITPHDIDCLCYTKGPGMGAPLQVSAIVVRVLSLLWKKPIVAVNHCVAHIEMGRIVTGADDPVVLYVSGGNTQVIAYSEGRYRIFGETIDIAVGELLGSLCRGLTLSNDPSP

SEQ ID NO: 41337 - protein, 297 aa, Vigna unguiculata subsp. sesquipedalis
QCGSQAGGALCPGGLCCSQFGWCGSTDDYCGKGCQSQCGGQPAPSDLSALIPRATFDQMLKHRNDGACPARGFYTYDAFIAAARAFPSFGNTGDTATRKREIAAFLGQTSHETTGGWPSAPDGPYAWGYCFVREQNPSAYCSPTPQFPCASGQQYYGRGPIQISWNYNYGQCGNAIGVDLINNPDLVATDPVVSFKSAIWFWMTPQSPKPSSHDVITSQWTPSAADVAAGRLPGYGTVTNIINGGLECGRGQDSRVEDRIGFFKRYCDLFGVGYGNNLDCYSQAPFGNSLLNLHPIV

SEQ ID NO: 41338 - protein, 233 aa, Brassica napus
MDAVVHACPLSITRLRAPPSLSSPTLIPPRFLSIHSTFSPTLSSLSKSRGPSASSAGATLMAKSSSPRSGVYTVGEFMTKKDDLHVVKPTTTVDEALEILVENRITGFPVIDQDWKLVGLVSDYDLLALDSISGSGSTENAMFPEVDSTWKTFNAVQKLLSKTNGKLVGDLMTPAPVVVEENTNLEDAAKILLETKYRRLPVVDSDGKLVGIITRGNVVRAALQIKRTGDRNA

SEQ ID NO: 41339 - protein, 427 aa, Dechloromonas aromatica RCB
MNAPLLPSYISAQNIGPWHIFLQQVEQVAPLLDKSLWPWVETLRRPKRSLIVDVPIRLDSGEVAHFEGYRVHHNTSRGPGKGGVRFHQDVTLSEVMALAGWMTIKNAVVNVPFGGAKGGVRVDPRQLSISELEGLTRRYTSEISSMIGPDKDIPAPDMNTNAQVMAWMMDTYSMGEGRTVTGVVTGKPLSLGGSLGRQDATGRGVFVTAREAARKLNLPIEGARVAVQGFGNVGEASARIFAQAGARIVAVQDVSATLYCEAGLDIAALKRYLAENKTLLGAPGCEVIDNAAFWAVPCDFMVPAALESQINRYNAGQITARIVVEGANGPTTPEADVILAERGITVVPDVLANAGGVTVSYFEWVQDFSSFFWSEDEIYQRLERIMSEAFNAIWQLAEARQMSLRSAAFVIGCTRVLEARATRGLYP

SEQ ID NO: 41340 - protein, 139 aa, Brassica napus
VDSADEPHSHHHHQLAKALTVPHLIAIGVGATIGAGVYILVGTVAREHSGPSLALSFLIAGIAAALSAFCYAELSSRCPSAGSAYHYSYICVGEGVAWLIGWALILEYTIGGSAVARGISPNLALIYGGEDGLPSFLAR

SEQ ID NO: 41341 - protein, 531 aa, Arabidopsis thaliana
MEALSSLTFKGSLPEAIFEAKGKKKLFVVYISGEDEESDKLNRLTWTDASVADSLSKYCILVHIQAGSVDATNFSAIYPYSSVPCIAAIGFSGTQVWRTEGFITAEDLASSLEKAWLGLHIQETTASIFSAALASQNSETPVSSASSVVLPPGSVPLDAAVASPSTASSVQPSETKSTVTSASTTENNDGTVAVKGKESAEPSNLCDTTKNQPAPSVDGTKANVEHEATETPLRVQAEKEPIRPTAPGTNDNTSRVRSSVDRKRKQGTVINEEDSGVGVSGRDINLTKSVDTKETMKPKDEGGEEEDGEKSKKASDVHLNIRLPDGSSLQEKFSVTSILRMVKDYVNSNQTIGLGAYDLAVPYPRKVYTDQDLDKSLSELRLFDRQALVVVPRKRATVYQRGTSYSESNNNTNPNSGGYFAYVRRVLSYANPFSYFGGGTANASSSVPERQTRPNTEVRNNLGQVGTSFQDPSEGRSNVRNRRPTTSRIGSNIHTLNHNEDEAPFGDGNAFWNGNSTQYGGGSGGDSNDRR

SEQ ID NO: 41342 - protein, 286 aa, Pseudoalteromonas tunicata D2
MTNLDQTTWFTEVSDRDGSAFSLRINKKLEEKQSPFQKVEMYETTDFGNLMIIDGCTMVTTRENFFYHEMISHPALYSHTNPKNVVIIGGGDCGTLREVLKHPAVETVHQIDIDAVVTEMALKYFPELCESNNDPRATVMFDDGIKFMADAAPESIDIIIVDGTDPVGPGEGLFNHAFYTSCLKALRSGGILVQQSESPLMHMPLLVEMRDAMQDVGFADLQTLPFPQPIYPSGLWSVTLARKDENFAGFREHDANSANFDTEYYNTGIHLGALATPNFMKRAFNK

SEQ ID NO: 41343 - protein, 280 aa, Triticum aestivum
  misc_feature (36)..(36): Xaa can be any naturally occurring amino acid
  unsure (1)..(280): unsure at all Xaa locations
NKFVQKSRPVPVRNSRDIVDPRVRRHAPTGRAYALXVLYGHHDEAVRRQITREIAILRTAEHPSIVRCHGMYEQAGELQILLEYMDGGSLDGRRIASEAFLADVARQVLSGIAYLHRRHIVHRDIKPSNLLIDSGRRVKIADFGVGRILNQTMDPCNSSVGTIAYMSPERINTDLNDGNYNGYAGDIWSFGLSILEFYLGRFPLGENLGKQGDWAALMCAICYSESPAAPPTASPELRSFISCCLQKNPAKRPSAAQLLQHRFIASPPQQQPQALAAPPC

SEQ ID NO: 41344 - protein, 352 aa, uncultured bacterium
ITSAHMLLSAMVDNHVQQGNALNIDPRRIVWKRVVDMNDRELRNIVVGLGGKAHGVPRQDGFDITVASEVMAILCLASSLHDLKERLSKIIVAYDYNGKPVTAGQIKAHGAMAALLKDAVKPNLVQTLENVPAIIHGGPFANIAHGCNSVMATKTAMKLADYTITEAGFGADLGAEKFFDIKCRYAGLKPDAVVLVATVRALKMHGGVPKTDLTAPNVDAVKKGIVNLEKHIENIKKFGLPLVVAINIFAQDTPEELEAVRAHCAAHGVNVALSDVFAKGGAGGVELAKEVVALAESGKADFAPIYASELTLKEKIATVAREIYGAGDVVYAKEAETALKDFESLGYGNLPI

SEQ ID NO: 41345 - protein, 352 aa, uncultured bacterium
ITSAHMLLSAMVDNHVQQGNALNIDPRRIVWKRVVDMNDRELRNIVVGLGGKAHGVPRQDGFDITVASEVMAILCLASSLHDLKERLSKIIVAYDYNGKPVTAGQIRAHGAMAALLKDAVKPNLVQTLENVPAIIHGGPFANIAHGCNSVMATKTAMKLADYTITEAGFGADLGAEKFFDIKCRYAGLKPDAVVLVATVRALKMHGGVPKTDLTAPNVDAVKKGIVNLEKHIENIKKFGLPLVVAINIFAQDTPEELEAVRAHCAAHGVNVALSDVFAKGGAGGVELAKEVVALAESGKADFAPIYASELTLKEKIATVAREIYGAGDVVYAKEAETALKDFESLGYGNLPI

SEQ ID NO: 41346 - protein, 217 aa, Burkholderia xenovorans LB400
MNAPHHPAHSTVRTKKLPPLRVGVGGPVGSGKTTLLEMLCKAMREQYDLVAITNDIYTKEDQRLLTVAGALPAERIMGVETGGCPHTAIREDASINLEAVDRMLTRFPDADIVFIESGGDNLAATFSPELSDLTIYVIDVAGGEKIPRKGGPGITKSDLLVINKTDLAPMVGANLEVMAADAKKMRGERPFVMCNLKALDGLDVVVKFIEKKGLLKV

SEQ ID NO: 41347 - protein, 543 aa, Oryza sativa (indica cultivar-group)
MASAAEAVEELTRLYRELPPRPAVEEVEAAEAVLASADAEEAARLDEVAREEASASASSSAAAPGRADGELLAVLREARRNAVRLRALQQRKEAAYVVELERRFKVFDDLIQRASRVVSSSSDAAEAGGGTTGDGYVGVGADSVDLEMELRKKEAAVAAAAAVAEMERGSKGLAALGLESKPISSLRRDVSAGTDMEKLSLIQVASLIESSAKKGITELSLRGKLVDQIEWLPVSLGKLQDVTELDLSENRIMALPSTIGSLRYLTKLDLHSNQLINLPDAFGELSNLIDLDLHANQLKSLPSSFGNLTSLANLDLSSNMLKALPDCLGKLANLRRLIVETNELEELPYTIGSCTSLVELRLDFNQLKALPEAIGKLEKLEILTLHYNRIKGLPTTVGSLSRLRELDVSFNEVEVIPENICFATSLVKLNLSRNFADLRALPKSIGNLEMLEELDISSNQIRVLPDSFRCLSRLRVFHADETPLEFPPREVVKLGAQAVVKYMNDLNAARGTNQKKTDRGSFWTWLFSLFGCCEKNQEVGLPV

SEQ ID NO: 41348 - protein, 913 aa, Oryza sativa (japonica cultivar-group)
MVLPPRLLLFFLLLIGVHASVSHGSPSLPPTYDPSICSNLDGSKQTPFIQLNGENYTILEIIYDSRTIVLADTDALRGSCPRVRHNVTFGQAYPWLQYTGSRDNLTFFFGCKLNLPPPIDPGLVSLADKHQINCKDFSNWPDSGDSFVFTSGELEAPVESELARCCSQVIVVPVNGSVLNSSNQSALPSGGYGQVLKMGFDLAWNSSKDEQCYKCEQSKGHCSYSQNRAFLGCLCSDGKVSTKDCRNNGASNSSALTMLLSLCLRLLPLLLVLVAASHGDASGDTYDTSMCLQKPTTCGNVSISYPFYFATKTKDINGSSNSYCGYPGLAIDCDDGKPILQLNGTEKYKVNYINYGSITNVSLADLEVVDDSSGCPRVDHNVTIPQISWLFFSGISVDYLVFFLRCSFTTFAPKPANFNPIACGSFINLTRPSFVFPDELVPPGNWSQLCEETFEVPVLKYQLMEMDSNGNAWNNSGYAQVLRQGFQLSVNESRRPPNCSQCEESQGRCGYSQAGEFIGCLCPNGRVRSLRCDPSDLAGYAVMDKTRYSILMPFSVPNFLHANIIAGTSSVLLLCLLSFACLFGLKKSRYRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHGSKRVLIYEYMPNGSLERYAFRNNSEGEHSLTWEKLFDVVVGIARGLEYLHRGCNTRIVHFDIKPHNILLDQEFCPKISDFGMAKLCSNKESIISIAGARGTIGYIAPEVYSKQFGAISSKSDVYSYGMMILEMVGARERNIDANSESSSHYFPQWIYEHLDEYCINSSEIDGETTELVRKMVVVALWCIQVVPTNRPTMTRVVEMLEGSTSGLELPPKVLLSW

SEQ ID NO: 41349 - protein, 352 aa, uncultured bacterium
ITSANNLLAALLDNHIQQGNALGIDPRQIQWKRCVDMNDRVLRNIVVGLGAKGDGMVREDHFVITVASEIMAILCLADNMEDLKNRLGKIIVAYNFAGEPVTAEQLHAVGSMAALPKEALKPNLIQTLEHTGALVHGGPFANIAHGCNSVRATKTALKLADVVVTEAGFGADLGAEKFLDIKCRKAGLKPDAVVLVATVRALKYNGGVPKDQLSAENLEALEKGIVNLEKHIENLQKFGVPVVVTLNSFISDTEAEYAYIKKFCEDRGCEFALSEVWAKGGEGGIALAEKVMETLENKPTQYHVLYPDEMSLKDKINTIAKEIYGADGASFAPAAAKALKRIEDMGFGNLPV

SEQ ID NO: 41350 - protein, 670 aa, Prochlorococcus marinus str. NATL1A
MVALTTSLDTLCINSIRMLAVDAINKSKSGHPGLPMGCAPMGYALWDKHLRHNPKNPKWFNRDRFVLSAGHGCMLLYALLHLTGYDSVTIEDIKEFRQWGAKTPGHPETFETPGVEVTAGPLGAGISNAVGLAIAEAHLAAKFNKPDSTVVDHYTYVIMGDGCNQEGISSEACSLAGHLKLGKLIALYDDNHITIDGRTDVSFTEDVLKRYEAYGWHVQEIPEGNTDVEGISQAIEKAKSVTDKPSIIKVTTTIGYGSPNKSDTAGIHGAPLGEEEAELTRKQLGWSYKPFEVPQDAYDQYRQAIQKGAQLEEEWNQSLAKYKEKYPNEATQFERMLRGELPEGWDKDLPTYTSDDKGVATRKHSQICLGALGPNIPELIGGSADLTHSNYTDIKGETGSFQYESPEKRYLHFGVREHAMAAILNGIAYHDSGLIPYGGTFLVFADYMRGSMRLSALSELGVIYVLTHDSIGVGEDGPTHQPIETIPSLRAMPNMMVFRPGDGNETSGAYKVAIKNRKRPSSLCLSRQGMANQQNSSVDKVALGGYVLEECDGTPELILIGTGTELDLCVQAAKKLTKEGRKVRVVSMPCVELFEEQSDSYKEEVLPSNIRKRLVVEAAESFGWHKYIGLDGDSVTMNSFGASAPGGLCMEKFGFTVENVLEKSKSLLNK

SEQ ID NO: 41351 - protein, 658 aa, Oryza sativa (japonica cultivar-group)
MAHLPLLLLSFLVLIGVHASVSHGSPPLPSTYDPSICSKSSECGGVNISYPFYLSNATDYYTRFSCGYTDLKISCSRDRDGRNETPTILLGGDNYTVLDIIYDSHTIVLADTDALRGGSCPRVRHNITFAQADEWLQYTGPRDNLTFFFGCKLNLPPPIDPGLVSLADKHQINCKDFSNWPDSGDSFVFTSAELEAPVESELARRCRQVIVVPVNGDILNSSNQSALPSGGYGQVLNKGFDLAWNSRKDEQCYQCEQSQGHCSYSQNRVFLDCLCSDGKVGNQDCRNSGASNSSTLRYSSLKGRMKLYIIAGISSVLLLCLLSFPCLFSLKKYRHRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHRSKRALIYEYMPNGSLERYAFRNNSKGELSLTWEKLFDVAVGIARGLEYLHRGCSTRIVHFDIKPHNILLDQEFCPKISDFGMAKLCANKESIVSIAGARGTIGYIAPEVYSKQFGAISSKSDVYSYGMMILEMVGARERNIEANSESSSHYFPQWIYEHLDEYCISSSEIDGETTELVRKMVVVALWCIQVVPTNRPTMTRVVEMLEGSTSGLELPPKVLLSW

SEQ ID NO: 41352 - protein, 352 aa, uncultured bacterium
ITSANNLLAALLDNHIQQGNALGIDPRQILWKRCLDMNDRVLRNVVVGLGAKADGMVREDHFVITVASEIMAILCLANDMDDLKERLGKIIVAYNFAGEPVTAADLHAVGSMAALLKDALKPNMIQTLEHTGALVHGGPFANIAHGCNSVRATKTALKLCDIVVTEAGFGADLGAEKFMDIKCRKAGIHPDAVVLVATVRALKYNGGVPKDQLSEENLDALKRGIVNLEKHIENIQKFGVPVVVTLNSFITDTEAEYAYIKKFCEERGCEFALAEVWAKGGEGGIALAEKVLNTLENKKGNFKPIYTDEMPLKEKIKTISSEIYGADGVSYAPAASRALKRIEEMGFGDLPV

SEQ ID NO: 41353 - protein, 466 aa, Prochlorococcus marinus str. NATL1A
MRNSWVASRKGKTNVSQMHFARKGEITEEMRYVAKRENLPESLVMEEVARGRMIIPANINHINLEPMAIGIASTCKVNANIGASPNASDISEELKKLDLAVKYGADTLMDLSTGGVNLDEVRTEIINASPIPIGTVPVYQALESVHGSISRLNEDDFLHIIEKHCQQGVDYQTIHAGLLIEHLPKVKGRITGIVSRGGGILAQWMLYHYKQNPLFTRFDDICEIFKRYDCTFSLGDSLRPGCLHDASDEAQLAELKTLGELTRRAWKHDVQVMVEGPGHVPMDQIEFNVRKQMEECSEAPFYVLGPLVTDISPGYDHISSAIGAAMAGWYGTAMLCYVTPKEHLGLPNPEDVREGLIAYKIAAHAADVARHRSGARDRDDELSKARKEFDWNKQFELSLDPEKAKQYHDETLPEEIFKKAEFCSMCGPNHCPMNTKITDEDLDQLNDQIQSKGAAELTPVKLNKEN

SEQ ID NO: 41354 - protein, 380 aa, Coccidioides immitis RS
MADTVGKTITCKAAVAWEAAKPLSIEDIEVAPPKAHEVRIQIYYTGVCHTDAYTLSGKDPEGAFPVVLGHEGAGIVESVGEGVTSVKPGDHVVALYTPECRECKFCKSGKTNLCGKIRATQGKGVMPDGTSRFKCRGKDLLHFMGTSTFSQYTVVADISVVAVTDKAPMDRTCLLGCGITTGYGAAVVTAKVEEGSTVAVFGAGCVGLSVIQGAVKNKAGKIIVVDVNDSKESWSRKFGATDFVNPTKLGNKSIQEHLIEMTDGGCDYTFDCTGNVGVMRAALEACHKGWGQSIVIGVAAAGQEISTRPFQLVTGRVWKGCAFGGIKGRSQLPDLVDDYLKGDLKVDEFITHREPLANINAAFEQMKAGDCIRCVVDTRT

SEQ ID NO: 41355 - protein, 531 aa, Mycobacterium avium 104
MLSLTAQLAHHPTQANEQPYLSRRQNWVNQLERHALMQPNATALRFLGKGLTWGELHGRVRALADALSRRGVGFGDRVMVLMLNRPEFMESVLAINMLGAIAVPLNFRLTAAEIAFLVQDCQARVVITEAVLAPVATGVRDIESLLDTVVVAGGSSDDAVLGYDDLIDETGAAHQPVDIPNDAAALIMYTSGTTGRPKGAVLTHTNLTGQTMTGLYTNGADINNDVGFIGVPFFHIAGIGNMLTGLLLGIPTVIYPLGAFEPGQLLDVLAAEKVTGIFLVPAQWQAVCAEQRARPRDLKLRVISWGAAPAPDALLREMSAMFPGTQILAAFGQTEMSPVTCMLLGEDAIRKRGSVGKVIPTVAARVVDENMNDVPVGEVGEIVYRAPTLMSGYWNNPEATAEAFAGGWFHSGDLVRMDEDGYVWVVDRKKDMIISGGENIYCAEVENVLASHPDIVEVAVIGRAHEKWGEVPIAVAAVANDNLALEDLDEFLTERLARYKHPKALEIVDALPRNPAGKVLKTELRIRYGGG

SEQ ID NO: 41356 - protein, 486 aa, Streptococcus pyogenes MGAS10394
MKFTIITNYDTLSRKSFTIEGDNMTIFRKKKKYSNKTEMQRHFKVIDLVFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 41357 - protein, 449 aa, Mycobacterium avium 104
MARLEQTRRLVTEIPGPASLELSKRRAAAVSHAVNVSVPVFVARAGGGIVEDVDGNRLIDLGSGIAVTTIGNSAPRVVDAVRAQVAEFTHTCFMVTPYESYVAVAETLNRITPGAGEKRSVLFNSGAEAVENAVKVARAYTRKPAVVAFDHAYHGRTNLAMALTAKSMPYKGGFGPFAPEIYRAPLSYPYRDGLLDKELATDGEKAAARAINIIDGQIGADSLAAVIIEPIQGEGGFIVPAEGFLPTLLDWCRRNDVLFIADEVQTGFARSGAMFACEHEGPNGLEPDLICTAKAIADGLPLSAVTGRAQIMDAPHVGGLGGTFGGNPLACAAALATIETIESDGLIERARQLERLITEPLLRLQARDDRIGDVRGRGAMIAIELVKSGTAEPDKDLTQRLSVAAHAAGVIVLTCGMFGNIIRLLPPLTISDELLAEGIDILGGLLADL

SEQ ID NO: 41358 - protein, 256 aa, Pseudomonas fluorescens PfO-1
MHPYFSLQGRTALVTGGTRGIGKMIAKAYVEAGARVYVCSRDAEACHQTAEELSALGTCLGIAANLATEEGVKELAARLGEQITHLDILVNNAGTTWGAPLESYPVKGWEKVMQLNVTSVFSCIQQFLPLLRKSGSAANPARIINIGSVAGISSFGEQAYAYGPSKAALHQLSRILARELVSQHINVNVIAPGRFPSKMTQHIGSDQQALADDTALIPMKRWGREEEMAALAISLASTAGAYMTGNIIPLDGGFSL

SEQ ID NO: 41359 - protein, 329 aa, Roseovarius nubinhibens ISM
MSENESPAPHLPGWNHIPDVPVAVSPFFSWPPEPRRMVRWVRLRWFALAENVILVGIALVSWAWFQPSMEAARTLSLDWVAAIWLRNMVLMCLVAGGLHWFFYMRHGQGKRLKYDARPLMTKGRQFNFGGQVRDNMFWSLTSGVGFWTGYEVLMFWAMANGWAPHLSWAGSPVWFVLLFPLTPVWISFHFYWIHRALHWGPLYRLAHGLHHRNVNVGPWSGLSMHPVEHLMFFSSVLIHVIVPAHPLHILFHMQHQALTAATSHTGYESLLVKDRQALALGTFHHQMHHRYFEVNYGNLEVPWDKWFGSFHDGTAEAHERLKSRRGRAG

SEQ ID NO: 41360 - protein, 281 aa, Dechloromonas aromatica RCB
MKPSIEDIEFHGIEALRLNGPRGVSAIVSKQGAQLLSWVSADGRERLFLSDKAVFDGSVAIRGGVPVCFPQFSSLGDLPKHGFLRTRSWSVSTRRTGDDYALVTLECADDESTRSLWPHSFLAELTVMLEADRIDLELAVTNTGSAPFDFTGALHSYLRVVQVEDVTLEGLHGHDYQDAVEGDRVVRETGTELIIEKEVDRAYRDVRRPQHLKAGNLSLGIQAQGFPDVVVWNPWADRCAELKDMPTDGWRHMLCVEAAATRPVSLPAGEEWYGRQTLVVV

SEQ ID NO: 41361 - protein, 486 aa, Xylella fastidiosa 9a5c
MMHHNVHQSEILADPCDLQRAERWLQRDLRVLWHPCTQMREHPDTLPLVPIVRGEGAWLVGHDGRRYLDAVSSWWTNLFGHADPRISAAIAAQARTLEQVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEVLFKRYSGQICALILEPLLQCAGGMRMHHPVYLHRVRELCDAHGALLICDEIATGFGRTGTLFACEQACPVILTDTDDKQLGIMPDLLCLSKGLTGGFLPLAAVLTTQQLYEEFLDDSRERAFLHSHSYTGNPLACIAALTTLDIFENDCIIERNQVTAARMTQLAASLSGHPHVADVRQAGMVVAFELTRDGNKRTPFPLQARLGLHVYRAALARGVILRPLGDVVYWMPPYCVDEEQLHLLAETTRVAIDEAIACV

SEQ ID NO: 41362 - protein, 454 aa, Oryza sativa (indica cultivar-group)
MTDAAAGGNQYCRFDSQLLTMFTSSLYLAALASSLGAATVTRVAGRKWSMFAGGLVFLAGCALNGAAANVAMLIVGRVLLGVGIGFANQSVPVYLSEMAPARMRGMLNNGFQMMITTGVLAANLINYGTARIAGGWGWRLSLALAAVPAAVMTAGALFLPETPNSLLERGRRGEARRMLQRVRGEGVDVEDEYNDLVAAGEASHAVASPWRDILRRRNRPPLVMAVAIPLFQQLTGINVIMFYAPVLFRTLGFGGGASLMSAVITGGVNMAATLVSVLAVDRVGRRALFLEGGAQMVASQAAVGALIGARLGWSGTAAIPAGYAAAVVAAMCVYVAAFAWSWGPLAWLVPSEVMPLEVRPAGQSITVAVNMAMTFAVAQAFLPLLCRLRFVLFFFFAGWVAAMTAFVALFVPETKGVPIEDMAAVWSDHWYWKRFVDGDGDGARRRGDIEMGHK

SEQ ID NO: 41363 - protein, 1060 aa, Arabidopsis thaliana
MQSHQNRSRLSLILRSRFIPSFSSPLSLFVVLAAVPLPIYFSGLLSGRNNKPLSVMRLNSNLASSMVESNISCTTFNILAPIYKRVDQKNHSTRESDFRTLWLARNQRILDLLLHQRSSVICLQEVWVGNEELVNMYHHQLSSSGYTIYQLARTNSRGDGLLTAIHKDHFKVVNYRELLFNDFGDRVAQLLHVKTVIPFPLNGKQDVQQEVIIVNTHLLFPHDSSLSIVRLHQVYKILEYLEAYQKENKLNHMPIILCGDWNGSKRGHVYKFLRSQGFISSYDDAHQYTDSDAHRWVSHRNHRGNICGVDFIWLCNPSDSRKPLRTSWVEAVFSIIKYQLHKASIAEDDAFTFLGAKNHSDSLTYSDFCLALQKVNLTGIPHGLSFEETKELWVRADLDGNGVFDYEELKKIWNMTMVNQPGNCKESVMESKKEEGEDEAIGLKVNKAILFPQEAEKGLWPENYNISDHACLTDVAGQIVNFMKIEKGEEERSETANTTERLLLGRFFYWESVNVLKFIRDLRVSNQIFDSSKSPTRVYKVHAFRSLIRELSRNICKKMAMAPVIKLVLGSVAFAIFWILAVFPSVPFLPIGRTAGSLFGAMLMVIFQVITPEQAYAAIDLPILGLLFGTMVVSIYLERADMFKYLGTLLSWKSRGPKDLLCRVCLVSAVSSALFTNDTSCVVLTEFVLKIARQKNLPPHPFLLALATSANIGSSATPIGNPQNLVIAVQSKIPFWEFLLGVFPAMIVGITVNAMLLLGMYWRLLSDHKEDEEEVQNADSEVVAQEDVQSHRFSPATFSPVSSEDSNLRMDAAETLRNRAGSAGESELISCNSNASREQHNDAESQGESNNTNNMFQTKRWRRVLWKSSVYFITLGMLISLLMGLNMSWTAITAALALVVLDFKDARPSLEKVSYSLLIFFCGMFITVDGFNKTGIPTALWDLMEPYAKIDQAKGIAVLAVVILVLSNVASNVPTVLLLGARVAASAMGREEEKKAWLLLAWVSTVAGNLTLLGSAANLIVCEQARRAVSHGYTLTFTKHFKFGLPSTLIVTAIGLFLIK

SEQ ID NO: 41364 - protein, 446 aa, Xylella fastidiosa 9a5c
MNFETLGLLPSLLRALSEQGYEIPTPIQQQAIPLALAGHDLLAAAQTGTGKTAAFGLPVLQRLMAASSNVGAGKPRALVLTPTRELATQVYDSLRGYAKYQRVSSAVIYGGVGMGNQLDVLRRGVDLLIACPGRLIDHIERRSVDLSGVGILVLDEADRMLDMGFLPSIKRILGKLPRQNRQTLLFSATFAEPIKQLALEFMCRPREVMVASHNTVAETITHRVHPVDVSRKRELLLHLLAQDSREQTLVFVRTKHGSDKLATFLEKYGIKTAAIHGNKTQGQRLRALNSFKAGRVTVLVATDIAARGIDIDQLPKVINYDLPMVAEDYVHRIGRTGRNGVQGEAISLVTQEDAKLLRQIVRLLDRDMDIRDVPDFEPQVPIRWGNSAPGKSKQPAGQHPPRKSQHRRAFGKASVQTAHALTKQSGVQHSNGSRNRDGMFPVHQRG

SEQ ID NO: 41365 - protein, 795 aa, Chromobacterium violaceum ATCC 12472
MADNYVIWFEKLRMTDVEEVGGKNASLGEMISQLAGSGVRVPGGFATTAQAYRDFLQHNGLADKINAALAKLDIDDVSELARVGKEIRQWIIDTPFPAKLDADIKEAWDKMVADAGGADISVAVRSSATAEDLPDASFAGQQETFLNIRGLDNVKDAMKHVFASLYNDRAISYRVHKGFAHDVVALSAGVQRMVRSDMGAAGVMFTIDTESGFEDVVFITASYGLGETVVQGAVNPDEFYVHKPTLKAGRPAVLRKTMGSKLIKMEFTDASQAGRSVKTVDVEPALRKAFSISDAEVAELAQYALIIEKHYGRPMDIEWGRDGVDGKLYILQARPETVKSQEDRKDTLRRYRLNSKSEILCEGRAIGQKIGQGVVRTIKDASEMDRVKPGDVLVTDMTDPDWEPVMKRAAAIVTNRGGRTCHAAIIARELGIPAVVGCGDATDVLKEGMQVTVSCAEGDTGNIYDGLLDVEVIDLELDKMPKAPVKIMMNVGNPELAFDFAQLPNEGVGLARMEFVINRQIGIHPKALLEFDKLSPELKETISDRIAGYASPVDFYVDKIAEGVSTLAAAFYPKKVIVRMSDFKSNEYANLIGGQLYEPHEENPMIGFRGAARYVAESFRDCFELECRAIKKVRDVMGLTNVEVMIPFVRTLAEAEKVVEILAENGLKRGENGLRLIMMCELPTNAVLAEKFLQHFDGFSIGSNDMTQLTLGVDRDSGGPIASTFDERNEAVKAMLHMSIQACRKLGKYVGICGQGPSDHPDFAKWLVEEGIETVSLNPDTVVETWLYLAKELNS

SEQ ID NO: 41366 - protein, 176 aa, Triticum aestivum
  misc_feature (45)..(45): Xaa can be any naturally occurring amino acid
  unsure (1)..(176): unsure at all Xaa locations
HYRTSLYKKAGWYRSGIPGISSTHASGLFQKGSARTAIHEILEKXQGTRDDEGTANELSFQMWTNQMQDTLTSKKKGDSAFRQKDFTTAIDCYSQFIEVGTMVSPTIYARRCLSYLMNDMAEQALSDAMQALVISPTWPTAFYLQAAALLSLDMENEAQDALKDGCAQETSSSSGR

SEQ ID NO: 41367 - protein, 265 aa, Brassica napus
MATNSAWKLDDHPKLPKGKTIALIVLDGWGESAPDEYNCIHTAPTPTMDSLKNGRPDTWTLIKAHGTAVGLPSEDDMGNSEVGHNALGAGRIFAQGAKLCDIALASGKIFDGEGFKYVSESFEKNTLHFVGLLSDGGVHSRLDQLQLLIKGSAERGAKRIRVHILTDGRDVLDGSSVGFVEILEADLAKLRENGVDAQIASGGGRMYVTLDRYENDWGVVKRGWDAQVLGEAPHKFKNAVEAVKTLRKEPGANDQYLPPFVIVDD

SEQ ID NO: 41368 - protein, 259 aa, Chlamydomonas reinhardtii
MAVDREECVYMAKLAEQAERYDEMVEEMKKVAKLVHDQELSVEERNLLSVAYKNVIGARRASWRIISSIEQKEEAKGNEEHVQRIRKYRTVVEEELSKICASILQLLDDHLIPTASTGESKVFYLKMKGDYHRYLAEFKTGADRKEAAEHTLLAYKAAQDIALVDLPPTHPIRLGLALNFSVFYYEILNSPERACHLAKQAFDEAIAELDSLGEESYKDSTLIMQLLRDNLTLWTSDMQDPAAGDDREGADMKVEDAEP

SEQ ID NO: 41369 - protein, 248 aa, Zea mays
MSSAVEAISCPKVDVPAGPEPGEPAKEAAPPAEHCDTAPNGKCAPRCHGEEDDEEEDEEEEEEKAPKAIDLGPMVSIKEQLEKDKDDESLRRWKEQLLGGVDFNSVGETLEPDVKIMSLSILSPGRPDIVLPLPVEPNGKGVWFTLKEGSPYRLKFTFSVSNNIVSGLRYTNTVWKTGLKVDRAKEMLGTFSPQLEPYTYVTPEDTTPSGMFARGSYSARTKFLDDDRKCYLEINYTFDIRREWPSTS

SEQ ID NO: 41370 - protein, 252 aa, Geobacillus stearothermophilus
RKPIIAGNWKMNGTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGALVGGASLEPASFLQLVEAGRHE

SEQ ID NO: 41371 - protein, 306 aa, Arabidopsis thaliana
MAIARTGVYVDDYLEYASTFPAELQRLLNTVRELDERSQSLINQTRQQTKYCLGLASQSSKKGNGNHYNNGGLDEEETIEKMRKEIESSQENALSLCTEKVLLARQAYDLIDSHVKRLDEDLNNFAEDLKQEGKIPPDEPSVLPPLPIVPKAEKRKSFYGTPQPKKIDYRDRDWDRDRDFELMPPSRKHRKDLMPIEEQPIDPNEPTYCVCHQVSFGDMIACDNENVSLLSQHLIIYFLMYSCYDETFCSCFDSAKEVNGFTIHALASHLRPDSKGNGTAPPADSSHSHTNIICTCEKVLLYYHQN

SEQ ID NO: 41372 - protein, 115 aa, Schizosaccharomyces pombe
PRLHKLHHKWIICTPYASHAFKSADGFLQSLPYHLFPFFFPLHKLTYLALFTFVNFWSIMIHDGKYISNNPIINGAAHHNGHHIYFNYNYGQFTTLFDRLGNSFRAPDEAWFDKD

SEQ ID NO: 41373 - protein, 73 aa, Glycine max
ESVVDWDFMEELLFCYLNLNEKKSHKFILSAFVDLITVMRRNSETPSNNPQSVRTVRSHRGTRNVTLEFGSSS

SEQ ID NO: 41374 - protein, 417 aa, Alteromonadales bacterium TW-7
MDFFNYKNNQLFAEDVGIAAIAQQYGTPCYVYSRATFERHYLAFANATKNHKSLVCYAVKANSNIAVLNILARLGSGFDIVSKGELARVIKAGGDAGKVVFSGVAKTADEIAYALKLGIKCFNVESASELERISEVACELNLVAPISIRVNPDIDAKTHPYISTGLKENKFGIDIQTAVSVYQQAAALPGLNVIGVDCHIGSQLTEVKPFLEALDKLLALIDELKSVGIELSHLDIGGGLGVPYDNEQPPHPSEYAEQVTARLENYRHLELIFEPGRAIAANAGVLITQVEFIKQNQSKFFAIVDAGMNDMLRPSLYQAWQKIIPVSVRDDDTPTHNFDIVGPVCETGDFLGKDRELALKQGDLLAQRSAGAYGFTMSSNYNSRPRVAEIMVDGEQHHLIRERETIESLYQGEKILP

SEQ ID NO: 41375 - protein, 523 aa, Kluyveromyces lactis NRRL Y-1140
MSKRTASDEGLENVDDRIVHSKTEAGEVPSANAVNANEQDVEMGEFEDPYGDDFESDGEIIEIDDEEDNEEELDGNIENDEFLEKKQQQAQELVEKDQNAEQEQSEQLWLPHLSKPLGPDEVLEADPTVYEMLHTVNVPWPCMTLDVIPDTLGSGRRNYPQSLLMATATQASKKNQNELMVLKMSQLAKTLVKEDEDENEGEDEDEDGTDPVIENENISLKDTTNRLKVSPFANAAQEVLCSTMSENGEVYIFDLASQVKAFETPGYQIPKQAKRPIHTVRNHGSVEGYANDWSPIIKTGAMLSGDCSGQVFLTQRHTSKWITDKQAFTVANNKSIEDLQWSRTESTVFASCGIDGYIRIWDTRSKKHKPAISVKASNTDVNVISWSEKIGYLLASGDDDGTWGVWDLRQFTPQNASTASPVAQYQFHKGAITSISFNPLDESIIAVASEDNTVTLWDLSVEADDEEIKQQAAETKELQQIPPQLLFVHWQKEVKDVKWHKQIPGCLVSTGTDGLNVWKTISV

SEQ ID NO: 41376 - protein, 574 aa, Bifidobacterium longum DJO10A
  misc_feature (311)..(328): Xaa can be any naturally occurring amino acid
  unsure (1)..(574): unsure at all Xaa locations
MAIVAHVDHGKTTLVNAMLQQSHVFSEREEVPDRVMDSNDLEREKGITILAKNTAVEYTGPLAAKYGHPEGITLNIIDTPGHADFGGEVERGISMVDGVVLLVDASEGPLPQTRFVLRKALEAKLPVILCVNKVDRPDARIEEVVGETSDLLLGLADDVQHEGIDLDLDQLLEMPVIYCAAKAGYASVNQPADGGLPDNDNLEPLFETIISTIPAPEYEEGAPLQAHVANIDSSDFLGRLGLVRIYNGTLEKGKTYGLSRVDGSLENFRVSELLRTQGLERIPVESAGPGDIVAVAGVNDIMIGETIVDPXXXXXXXXXXXXXXXXXXVLAEQMRREGYELTVGRPQVVTKKIDGVINEPMENTTIDVPEEYMGTVTQLMADRKGRMDGMTNHGSGWVRLQFTVPSRGLIGFRTALLSATRGTGISSSISAGYAPWAGAITIRQNGSMVSDRKGIATPYAMQRLQARGNFFVEPQSPVYEGQVVGVNNKPDELDVNITLAKHMTNMRSSTADVLETLTPPIKMSLEESLDFANEDECVEVTPESIRVRKIILGREDWYKWRAKQRRQNAAQQGK

SEQ ID NO: 41377 - protein, 708 aa, Coccidioides immitis RS
MPAISISTFAQSQQHLLLLEHEAEIASSALASSAGSTNSSLSFVSPATRRALQAAGHALTALVLVNCRTGMGGREVGEFGVDAALKSAKGKKTGEGALPTGNGDGARESLPAHGIRVGDVVRVEPIVSGARGGSGSKAGKGKVGKDDADVTKGLEGVVTKIGERSVWVAFDERGRPGKQDDDGAAGLWGQKLWLVKLANDITYRRMKQTMVRMEKMAESEHSSFMRVLFGHTTPSPPDWSSASSLDFIDPSLNDSQKEAIRFALASREIALIHGPPGTGKTHTLIELILQLLRRNLRILVCGPSNISVDNIVERLAPHKIPLVRIGHPARLLSSVVDHSLEALTQTSDAAAIVKDVRREIDEKQASIRKTRSGRERREIYKDLKELRKEFREREARCVDHLVTESKVVLATLHGAGGHQLKNQKFDVVLIDEASQALEAQCWVPLLSASKAILAGDHLQLPPTIKSTTTNTPSGSSRKLKSSNAIQSGADDLTISSLSITSLETTLFDRLLSLHGPTIKRMLTTQYRMHEKIMSFPSCELYESKLIAADHVKARLLKDLPCDIQDTDDTCEPLVFYDTQGGEFPERIEDGELLLADSKSNDLEAAVVARHVQNLIAAGLREEDIAVITPYNAQVALLAQLLRERHPGLEIGSVDGFQGREKEAVVVSLVRSNAEREVGFLGEKRRLNVAMTRPRKHLCVCGDSETISR

SEQ ID NO: 41378 - protein, 472 aa, Neisseria gonorrhoeae
MSIKNVVKLIEESEARFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLRRGGVFSKDWIDSYIAFKEEDVRRIRMAPHPLEFEMYYRL

SEQ ID NO: 41379 - protein, 217 aa, Oryza sativa (japonica cultivar-group)
MASTELASDVYALPCGDDGTTALSTPVVVSVLASLLERHIARNERDQAAAADGEAARRARAFDSGTVLDMSLHAFLERFSRYANVSPQVYVVAYAYLDRLRRGDGVRVVSANAQRLLTTAILVASKFVEDRNYKNSYFAAVGGLTAAELSSLELDFLFLMQFRLNVSVSVFQSYCRHLEREVSYGGGYQVERCLKKALVCSGEAQAQQRQAASAAAQ

SEQ ID NO: 41380 - protein, 499 aa, Oryza sativa (indica cultivar-group)
MAMGAASWAPIPAPARAAAAFYPGRDLAAARRRRGAAAAARRPFVFTPRAVSDSRSSQTCLDPDASTSVLGIILGGGAGTRLYPLTKKRAKPAVPLGANYRLIDIPVSNCLNSNVSKIYVLTQFNSASLNRHLSRAYGNNISGYKNEGFVEVLAAQQSPENPNWFQGTADAVRQYLWLFEEHNVMEFLILAGDHLYRMDYQKFIQAHRETDADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISDGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 41381 - protein, 751 aa, Zea mays
  misc_feature (49)..(49): Xaa can be any naturally occurring amino acid
  unsure (1)..(751): unsure at all Xaa locations
MDGSELENPTSRSSSQKSSRRSSSRRSQKSAGQHSLTGAQEKRSKSKSXRQKHLVIDDKEAKKGKKHDHKIDVADERSNFLGYEVYAGKLILQKKNRSASDNNQLPSNGKADAIDARLTSKALIWGSSVLLLEDVVSVSYNSGVKHFTLHAYSTKKSLFRKTCRVQKDFCFIASTLDEAILWVTCFAEQSIYVNLLPRLGASSINQDSENPLSESLFDQPPIKCKSPQRVLVILNPRSGHGRSSKVFHEKAEPIFKLAGFQMEVVKTTHAGHAKSLVSTFDFSACPDGIVCVGGDGIVNEVLNGLLIRSDRAEAVSIPVGIIPAGSDNSLVWTVLGVRDPISASLLIVKGGFTALDILAVEWVQSGQIHFGSTVSYYGFVSDVRELSEKYQKKFGPLRYFVAGILKFLCLPSYFYELEYLPSPKEMAVNGKGTDQDKAHLSNVYTDVMHSRSKKEGIPRASSLSSIDSIMTPSRMSLGDVDTSGSTVASTEPSDYVRGLDPKAKRLSLGRSNIVSEPEEVLHPQPHHGSFWPRTRSKARADRNSVGITSTNDTRSSWAAPSMHDKEDISSTISDPGPIWDCEPKWDTGPKWDSELTWEPDHPIELPGPQEDMGIGAPMELVPNLDEKWVVRKGHFLGVLVCNHSCMTVQSLSSQVVAPKAIHDDNSLDLLLVGGKGRWKLLRFFILLQFGRHLSLPYVEYVKVKSVKLKPGANTHNGCGIDGELCRVKGQVLCSLLPEQCRLIGRRCRQSI

SEQ ID NO: 41382 - protein, 246 aa, Oryza sativa (japonica cultivar-group)
MQEDNISKKAKLRKSIQLFLSRNLKKIPPIHIPSSAIPAKITSNRLLSTCRFPRTPSLHGGGGGGGDHRTTDDDDGSNGRDQAATLSDVDRFLFDNFRSLYIHDGDNHQQRRQPPPSPGKFTQPAAAETSSSRSESVAEDARGTSSGDEDDNNSSTAIMLFSVDPYTDFRRSMQNIIEMHHGEEPQPLDWDFLEELLFYYLQLNEQSVHKYILKAFADLTAGAHVSCPARGKPQWADKSVRSRKHY

SEQ ID NO: 41383 - protein, 736 aa, Acidobacteria bacterium Ellin345
MATTKAEPKPATASTKAVNKTYEGLTREDLLRAYRLMYLSRRIDDREILLKRQQRVFFQISGAGHEAMLVAAGLLLKPGYDWFFPYYRDRALCLALGMTAEEMLLGAVGAAADPNSGGRQMPSHWGHKGLNIVTGSSPTGSQILHAVGCAEAGRLFNAHPDSAAKAEGDYREFKDVVFHGDEVSYVSCGDGTTSQGEFWEALSSASNNKLPVLFVVEDNGYAISTPVEVNTPGGNISKVVSGFPNFHFEECDGTEVLESYRAFKRAIDYIRAGKGPAFVHGHVIRPYSHSLSDDEKLYRPEAERKDEANRDPITKFYKWLVAESLATDKELKDLQTDVDTEVQDSSDRAVEAPIPALDSYSQHLYSSTLDPASAAFETRPQFPVHVEGETAVAPAKTMADLINACLKDEMKRDPRIVIFGEDVADCSREEYLKQKQVKGKGGVFKLTSGLQMEYGADRVFNSPLAEANIVGRATGMAVRGLKPVVEIQFFDYIWPAMHQLRNELPVVRWRSNGAFSSPAVIRVAIGGYLTGGAIYHSQCGESIFTHTPGMRVIFPSNALDANGLLRTAIRCDDPVLFLEHKRLYRETFGRSPYPGPDYMVPFGKAKIVKAGHDITVVTYGAVVPRALQAAQKIERENGVSVELIDLRTLNPYDFEAIAESIHKTNRVIVAHEDTLSWGYGAEIAARIADELFDELDAPVKRVAAKDTFVAYQPALEDVILPQSDDLFAAMLEMSKY

SEQ ID NO: 41384 - protein, 118 aa, Brassica napus
  misc_feature (3)..(3): Xaa can be any naturally occurring amino acid
  misc_feature (18)..(18): Xaa can be any naturally occurring amino acid
  misc_feature (49)..(49): Xaa can be any naturally occurring amino acid
  misc_feature (64)..(64): Xaa can be any naturally occurring amino acid
  misc_feature (69)..(69): Xaa can be any naturally occurring amino acid
  misc_feature (79)..(80): Xaa can be any naturally occurring amino acid
  misc_feature (89)..(89): Xaa can be any naturally occurring amino acid
  misc_feature (93)..(93): Xaa can be any naturally occurring amino acid
  misc_feature (95)..(98): Xaa can be any naturally occurring amino acid
  misc_feature (101)..(105): Xaa can be any naturally occurring amino acid
  misc_feature (107)..(107): Xaa can be any naturally occurring amino acid
  misc_feature (109)..(110): Xaa can be any naturally occurring amino acid
  misc_feature (113)..(114): Xaa can be any naturally occurring amino acid
  unsure (1)..(118): unsure at all Xaa locations
MSXPCVVLATASYDHTIXRFWEAESGRCYRTIQYPDSHVNRLEITPHKXHIAAACNPHIRLFDXNSNSXHPVMTYDSTXXIGMAVGFPXDGKXMXXXXQDXXXXXPXLXXLPXXPKKE

SEQ ID NO: 41385 - protein, 392 aa, Acidobacteria bacterium Ellin345
MKLLVIGAGMMGSAAAYDMARQPQVSEVTLADSDARRVAEAVERINNLTDNKKVEGASVDAADLEKVAQLMKGHDGVLSAVPYFFNLGLAKTAIESKCHFADLGGNNVVVRQTLELAQEAKKNGVGLAPDCGLSPGMASILGGELLRRVGGRADSLKVYVGGLPQNPKAPFNYQLVFSVEGLINEYCEPARILRDGELTMIDPLSEIEEFNIEGWPALEAFHTSGGTSTMPETFGKNVGECFEKTIRYKGHCAMIRSLYDFGFFSSEKRKIGQHEITPRQMTTSLFLEKFVDDASEATILRVEAHQNGEVASFTLIDKTDPETKLTSMMRTTAWPASIVLQMMASGEITKRGDVLQERDVPAEKFLDEMAQRGLPIAYEVAVAQPEECEVGA

SEQ ID NO: 41386 - protein, 303 aa, Caulobacter crescentus CB15
MTVFVLGSINLDAVARVDDLPRPGETVAGLSLELFLGGKGANQAVAAARMGVATRLMGAVGGDDSGAGLKAKLAGYGVQVGDVVELPGVPTGQAHVWVANSAENMIVVTAGANAMVTPQQVAATTIEGQRVLLCQLETPATAIETLFRAGSAKGALRILNAAPALPQGAALFPLTDILIVNQTELATYAKLDREPVKLEEVSVAARKLMSRPDQTIIVTLGAAGAAVVRRDEAFLVEGKKVKAVDTVGAGDCFCGALAATLAAGMDLAEAVETANAAAALSVQKAGAAPSMPNRREVEAFLEG

SEQ ID NO: 41387 - protein, 338 aa, Prochlorococcus marinus str. NATL1A
MRAGSVIAIGEALIDRLGPLGGAPSSDLPVTDCFGGAPANVACALSRLGAKVSFIGSLGNDAFGEDFNNLLIQRRINTSGLQQDTLRPTRVVLVRRDSDGERCFEGFEGDKGLGFADQAISLEQIIRDWPLVAENAQWLVAGTIPLASEISSKAFLWCIENAMHSGIKIALDLNWRPTFWRNQVSNVSEPSVKEKNQILSILKNVSLIKLAKEEAQWFFHTSDPTEISSSLPQRPSVVVTDGSNPILWRLNNHVGKSFAIIPSSVVDTTGAGDAFTAGLIYKLISVELDQISEQSAKDIIQFGIACGSHVCKGVGAIEPQPYLDDIDNLLSLSKGGIS

SEQ ID NO: 41388 - protein, 507 aa, Oryza sativa (japonica cultivar-group)
MGDHRATAKVRVNGAPAEATLFCTDPPGAANGGGGDGGELRWRCAGGAAAERVLSLDADVLGVEARGKEVVVKAFVLPADAAARSVSCAAGAGKGGGGRRRRRRDYVFEMAAGEDAAAAWCDRMRGSLDSLGRPKRLFILVNPFGGKKCGKKIYEAEIKPLFEAAGVNVTMQETRYQGHARQVASSLDLARYDGIVCVSGDGVLVEVVNGILQRMDWEEAMKIPIGVVPAGTGNGMAKSLLHSASKTYSVPNAVFAIIRGYSQSLDVCTIVQGRKKFFSVLNMTWGLVADIDIESEKYRWMGSARFDFYALVRIMNLRKYYGSIQYVPAPGYEAYGDVVKQVENCTVECQEQIGKSLCSYQGPSVEFQGSEWRSLDGPFVSIWINNVQWAAESIMAAPGAKFSDGYMDAVIVRDCPKADLLALLMKMGDGSHVKSPYVTYLKVRCLRLSPGQLVENPKRGGIIDVDGEAIARGEGTYGKNQKQDVMGYGPSIQMTVHRALATMYCPK

SEQ ID NO: 41389 - protein, 414 aa, Campylobacter lari RM2100
MLIIEDLRAFEVLDSRGNPTIKAEIMLSDGSMGSAIVPSGASTGKKEALELRDNDERFGGKGVLKAIENINGTIAENIIGLDAFNQTQLDNTLLELDGTKNYSNLGANATLGISMATARAAANALGIPLYRYLGGANASVLPVPMCNIINGGAHANNNVDFQEFMIMPFGFSSFKEGLRSVCEIYAILKKELAALGYSTALGDEGGFAPNLANNTEPLDLLMTCIKKAGYENKIKLALDVASSELYKDGKYYLEGKVFSNEDLIARYEELCAKYPIFSIEDGLAEDDYEGWIKLTQKLGNKIQLVGDDLFVTNEDILREGILKNMANAVLIKPNQIGTITQTMRTVRLAHRNNYRCIMSHRSGESEDAFIADFAVALNTGQIKTGALARGERTAKYNRLLEIELDNDEYLGDKL

SEQ ID NO: 41390 - protein, 244 aa, Haemophilus ducreyi 35000HP
MLKNKLSTLALVVGTLFASQATFAEKADQAFVNDSSYAVGVLMGKNIQGVIESQKEVFSYNQEKILVGVQDTLKKTGKLTDEELQKQLKALDTYLAKQESKIAAEKSKATKEAGDKFRAEYEKKAGVKKTASGLLYKIEKAGTGASPKAEDIVIAHYKGTLPDGTVFDSSYERNEPIELQLKQLIPAWIEAIPMLKKGGKMEIVAPPKLAYGDRPSGKVPANATLKFEIELLDFKPTAAQPKKK

SEQ ID NO: 41391 - protein, 366 aa, Zea mays
MGKGAQGSDAAAAGGEVEENMAAWLVAKNTLKIMPFKLPPVGPYDVRVRMKAVGICGSDVHYLREMRIAHFVVKEPMVIGHECAGVVEEVGAGVMHLSVGDRVALEPGVSCWRCRHCKGGRYNLCEDMKFFATPPVHGSLANQVVHPADLCFKLPDGVSLEEGAMCEPLSMGVHACRRAGVGPETGVLVVGAGPIGLVSLLAARAFGAPRVLVVDVDDHRLAVARSLGADAAVRVSPRVEDLADEVERIRAAMGSDIDVSLDCAGFSKTMSTALESTRPGGKVCLVGMGHNEMTLPLTAAAAREVDVVGVFRYKDTWPLCIDFLRSGKVDVKPLITHRFGFSQRDVEEAFEVSARGRDAIKVMFNL

SEQ ID NO: 41392 - protein, 476 aa, Kluyveromyces lactis NRRL Y-1140
MLILSRVFERNHVEILRKFMKFVGPGIMVSVAYMDPGNYSTSVSGGAQFKYKLLFITFISNIFAIVLQCLCIKLGTITGLDLAENCRRHFSKRVNYILYGFAEVAIIATDLAEVIGAAVALNILFNIPLLWGVLLTVFDVLLILLFYRPDEHSMKRVRAFETFVGILVGATVICFAIELFKISVPSKLEVFKGFIPNPIIFKEQQAMYISLGILGATVMPHSLFLGSSLVKPRVFDYDLKKYGKIKEQPSVGAIEYTLRYSYAELIVSLFFIATFVNAAILIVAGATLYGQPDAEDADLLSIYELLSHYVSPAAGLVFALAMLFSGQSAGVICTMAGQIVSEGFLEWSLEPWVTRLLTRLIAIVPCFLVTAFLGEKGVSSILNLSQVVLSLILPIVSAPLIYFTMNHKIMTVVDVDSAPASADSTEESRLLSKGVKSIDYTNGRLLSISSFVIWLTIGSLNCYLVFSYLMGADVHF

SEQ ID NO: 41393 - protein, 147 aa, Oryza sativa (japonica cultivar-group)
SWSPNPSPKRPIQPPASTHRTTNHRPPRRRGERKEEREMEAAAAAGVQLGTSKPQIATQAEMSEARLPLPYRDQCAHLLIPLNKCRVAEYYLPWKCEPERHAYEKCQYELVMERMIQMQKIREAQEAKSKGAATIGVPLIPSTAKLS

SEQ ID NO: 41394 - protein, 515 aa, Acidobacteria bacterium Ellin345
MDTQSIVILDFGSQYTQLIARRIREQNVFSVVLPCTAKLDEIQKYNPAAIILSGGPSSVYDADAPPADPQVLHQGLPVLGICYGLHWMTHNLGGNVRPGAKREYGHAEVEIVKDSPLFAHLTGPLQVWMSHGDEADKLPDGFTLFAQSPNALAGMHNLEKNWYAIQFHPEVHHTRQGTEILRNFLFEIVKIKPNWTPARFIDETVESIRKQVGDGHVICGLSGGVDSSVAATLVHRAIGKQLTCIFVNNGVLRMNEFESVQTNLRDKLGLNIVGVDATDRFLGKLAGVTEPEKKRKIIGNEFIAVFEEEAHRIEQESGKVDWLVQGTLYPDVIESQSVRGPSQVIKSHHNVGGLPEKMKLKLIEPLRDLFKDEVRRIGRDLGMPEDVLNRQPFPGPGLAVRILGEVTADRVALLQKADHIVVSEIKRAGLYNKIWQSFAVLLPVMSVGVMGDQRTYAYTCAIRSVHSEDGMTADWVPLPYDVLKAMSNRIVNEVKGINRVVYDITSKPPGTIEWE

SEQ ID NO: 41395 - protein, 408 aa, Arabidopsis thaliana
MNSHFLTNDLILEVLSRLPLKSVARFHCVSKRWASMFGSPYFKELFLTRSSAKPRLLFAIVQNGVWRFFSSPRLEKSSSTLVATAEFHMKLSPNNLRIYHDNTPRYFSIGYASGLIYLYGDRYEATPLICNPNTGRYTILPKCYTYRKAFSFFGFDPIDKQYKALSMIYPSGPGHSKILTFGDGDMNWKKIKYRVLHDIYSQGICINGVLYYLGDTSDWDNDHDVTSGNVLVCFDLRSESFTFIGLECGQLINYKGKLAVIFWDDVDDDDVKDDAIDEMHVWVLEDVEKKEWSKYAYTWTEDKLYRSQVSVVGMTASGEIVFSMRKYTSEQPFYVYYFNPERNNLRRVEIQGFEAFTKFGTVYTFVDHVEDLNVYNLKHFKSVHPPSVQPEYDESDSESEEDREIIIG

SEQ ID NO: 41396 - protein, 366 aa, Bacillus cereus G9241
MIRTEEMLLNVGPQHPSTHGVFRLVIKIDGEIIKEATPVIGYLHRGTEKIAESLQYTQIIPYTDRMDYLSAMTNNYVICHAVETMMGLEIPERAEYLRVLAMELGRIASHLVWWGTNLLDIGAVSPFLYAFREREMIINLLNELCGARLTFNYMRVGGVKWDAPDGWIEKVEEFVPYMREQLAGYHDLVSGNEIFLNRVKGVGIYSAEEAISYSLSGANLRCTGVNWDLRKDEPYSIYDRFDFDIPVGSVGDAWDRYVCRMQEIEESLKIVEQAVQQFPKEGAVLAKVPKIIKAPKGEAFVRIESPRGEIGCYIASDGKKEPYRLKFRRPSFYNLQILPKLLKGENIANLITILGGVDIVLGEVDG

SEQ ID NO: 41397 - protein, 283 aa, Bacillus cereus G9241
MSDPNKELEDLKREAARRAKEEARKRLVAKHGVEISKLEEENQEKEKALPKNDDMTVEEVKRRAAAAAKAKAAALAKQKASQGHGDSGDEKAKAIAAAKAAAAARAKMKGTEGKKEEELKQEEPSVNQPYLNQYVEVIKGKMGEEILIDSYINKLSKDVPTLVVEPSKYYEVMELLRSHEELAFDYMSELHATDFVTHMEVYVHLFSYGKKQSVAVKVKLDREAPQVESVTALWKGADWPEREAYDLLGIVFKGHPNLSRILMPDDWIGHPLRKDYEPYDVEV

SEQ ID NO: 41398 - protein, 458 aa, Listeria monocytogenes str. 4b F2365
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQVLKASNRKTKIRHN

SEQ ID NO: 41399 - protein, 556 aa, Lolium perenne
MGSIAADAPPAELVFRSKLPDIEIPTHLTLQDYCFQRLPELSARACLIDGATGAALTYGEVDALSRRCAAGLRRLGVGKGDVVMALLRNCPEFAFVFLGAARLGAATTTANPFYTPHEIHRQATAAGARVIVTEACAVEKVRAFAAERGIPVVSVDEGVDGGCLPFAETLLGEESGERFVDEAVDPDDVVALPYSSGTTGLPKGVMLTHRSLVTSVAQQVDGENPNLHFSSSDVLLCVLPLFHIYSLNSVLLAGLRAGCAIVIMRKFDHGALVDLVRTHGVTVAPFVPPIVVEIAKSARVTAADLASIRLVMSGAAPMGKELQDAFMAKIPNAVLGQGYGMTEAGPVLAMCLAFAKEPFAVKSGSCGTVVRNAELKIVDPDTGASLGRNLPGEICIRGKQIMKGYLNDPVATKNTIDKDGWLHTGDIGYVDDDDEIFIVDRLKEIIKYKGFQVPPAELEALLITHPEIKDAAVVSMQDELAGEVPVAFVVRTEGSEISENEIKQFVAKEVVFYKRICKVFFADSIPKSPSGKILRKDLRAKLAAGIPSSNTTQSKS

SEQ ID NO: 41400 - protein, 652 aa, Mycobacterium tuberculosis H37Rv
MCGLLAFVAAPAGAAGPEGADAASAIARASHLMRHRGPDESGTWHAVDGASGGVVFGFNRLSIIDIAHSHQPLRWGPPEAPDRYVLVFNGEIYNYLELRDELRTQHGAVFATDGDGEAILAGYHHWGTEVLQRLRGMFAFALWDTVTRELFCARDPFGIKPLFIATGAGGTAVASEKKCLLDLVELVGFDTEIDHRALQHYTVLQYVPEPETLHRGVRRLESGCFARIRADQLAPVITRYFVPRFAASPITNDNDQARYDEITAVLEDSVAKHMRADVTVGAFLSGGIDSTAIAALAIRHNPRLITFTTGFEREGFSEIDVAVASAEAIGARHIAKVVSADEFVAALPEIVWYLDEPVADPALVPLFFVAREARKHVKVVLSGEGADELFGGYTIYREPLSLRPFDYLPKPLRRSMGKVSKPLPEGMRGKSLLHRGSLTLEERYYGNARSFSGAQLREVLPGFRPDWTHTDVTAPVYAESAGWDPVARMQHIDLFTWLRGDILVKADKITMANSLELRVPFLDPEVFAVASRLPAGAKITRTTTKYALRRALEPIVPAHVLHRPKLGFPVPIRHWLRAGELLEWAYATVGSSQAGHLVDIAAVYRMLDEHRCGSSDHSRRLWTMLIFMLWHAIFVEHSVVPQISEPQYPVQL

SEQ ID NO: 41401 - protein, 557 aa, Lolium perenne
MGSVPEESVVAVAPAETVFRSKLPDIEINNEQTLQSYCFEKMAEVASRPCIIDGQTGASYTYTEVDSLTRRAAAGLRRMGVGKGDVVMNLLRNCPEFAFSFLGAARLGAATTTANPFYTPHEIHRQAEAAGAKLIVTEACAVEKVLEFAAGRGVPVVTVDGRRDGCVDFAELIAGEELPEADEAGVLPDDVVALPYSSGTTGLPKGVMLTHRSLVTSVAQLVDGSNPNVCFNKDDALLCLLPLFHIYSLHTVLLAGLRVGAAIVIMRKFDVGALVDLVRAHRITIAPFVPPIVVEIAKSDRVGADDLASIRMVLSGAAPMGKDLQDAFMAKIPNAVLGQGYGMTEAGPVLAMCLAFAKEPFKVKSGSCGTVVRNAELKVVDPDTGASLGRNQPGEICVRGKQIMIGYLNDPESTKNTIDKDGWLHTGDIGLVDDDDEIFIVDRLKEIIKYKGFQVAPAELEALLLTNPEVKDAAVVGVKDDLCGEVPVAFIKRIEGSEINENEIKQFVSKEVVFYKRINKVYFTDSIPKNPSGKILRKDLRARLAAGIPTEVAAPRS

SEQ ID NO: 41402 - protein, 214 aa, Oryza sativa (japonica cultivar-group)
MEGFSQEHVIGIPLASFAYAEEKIERKTSRSSLVHKKGKKNSIIYRMSKLSQKTDSYVQGFKEHITLGPKISDTLKGKLSLGAKVLQAGSIDKVFRQYFQVDKDEKLLKAFQCYLSTTAGPIAGMLFISTEKIAFHSDRPLDLTSPKGGITRVPYKVLIPAKRIKSAAVRENLYNPDEKYIDVVTVDGFDFWFMGFISHTKSFEYLQRVISEFR

SEQ ID NO: 41403 - protein, 314 aa, Oryza sativa
MAAAARPVDVVRHFPCSSSVAASSSLLLSRSKSRLASPAAAAASSMRRRLVLGVGAAAAPAVAALAASATPAALRDCAATLLITAGAYSLVRAFDGLTARRLIEQNLSRKIVHVLSGVLFMSSWPLFSNSTEARFFAAIVPLLNCIRLLTYGLRLSTDEALVKSVTREGKPEELLRGPLYYVIVLLVSVLVFWRQSPIGIVSLSMMSGGDGFADIVGRRYGSAKLPFNENKSWIGSISMFISGFLLSALMLFYFSCLGYFTVCWDLALGKLALVALAATVVECIPVNDVVDDNISVPLATMLAAYLLFGYSSCC

SEQ ID NO: 41404 - protein, 346 aa, Bacteroides fragilis YCH46
MLAYTYVEHGKFELLEKLRPQIKDARDVIVRVTLGSICTSDLHIKHGSVPRAVPGITVGHEMVGIVEEVGSGVISVRPGDRVTVNVETFCGECFFCRHGYVNNCTDPDGGWALGCRIDGGQAEYVRVPYAEQGLNRIPDNVSDEQALFVGDVLATGFWATRISEISEDDTVLIIGAGPTGICTLLCVMLKKPRRIIVCERSAERIRFVREHYPDVLVTEPENCRDFVLCNSDHGGADVVLEVAGSEETFRLAWECARPNAIVTIVALYDKPQFLPLPDMYGKNLIFKTGGVDGCDCAEILSLIEQGRIDTTPLITHRFPLNEIEEAYRIFENKLEGVIKIAITGGR

SEQ ID NO: 41405 - protein, 559 aa, Burkholderia xenovorans LB400
MYQYDQYDQTIVDERVAQYADQVRRRLSGELSEEEFRPLRLQNGLYMQRHAYMHRIAIPYGNLRSNQMRVLAQIAREHDRGYGHFSTRSNIQYNWIKLEETPEILRKLAAVQMHGIQTSGNCIRNITADQFAGVAPDEVVDPRPWAEILRQWSTFHPEFAWLPRKFKIAVSGSKEDRAAVQIHDMGVYLKKNEQGELVADILAGGGMGRTPIIGAIIRKDLPWQHLLTYCEAVLRVYNRYGRRDNIYKARIKILVKALSPEKFSAQVEEEWQHLKDGPSTLTQAEVDRVSQYFQPPVYEKLADTDASYEKHLLENRAFARWVERNVRPHKVSGYASVTLSLKPTTIAPGDATDAQMEAVADWADEYSLGEIRVSHEQNLILANVKKRDLFALWEKAKAQGFATPNIGLLTDIIACPGGDFCSLANAKSIPIALAIQERFNDLDYVYDLGDVSLNISGCINACGHHHIGNIGILGVDKDGSEWYQVTLGGEQGTGASGAQLGRVIGPSFSAEEMPDVMSKVIDTFVENRHEGERFIETYNRIGITPFKERVYASRQPAHA

SEQ ID NO: 41406 - protein, 337 aa, Spinacia oleracea
KLKVAINGFGRIGRNFLRCWHGRKDSPLDVVVINDTGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPNLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQA

SEQ ID NO: 41407 - protein, 183 aa, Zea mays
  misc_feature (130)..(130): Xaa can be any naturally occurring amino acid
  misc_feature (154)..(154): Xaa can be any naturally occurring amino acid
  unsure (1)..(183): unsure at all Xaa locations
MASSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLXFGCTDSAQGVKEVQKCKTEDPNAXFIRIIGFDNNRQVQCISFIAYKPPSFTGA

SEQ ID NO: 41408 - protein, 320 aa, Pyrobaculum aerophilum str. IM2
MANMAKAINMALHEEMERDERVVVLGEDVGKKGGVFLVTEGLYERFGPERVIDTPLNEGGILGFAMGMAMAGLKPVAEIQFVDFIWLGADELLNHIAKLRYRSGGNYKAPLVVRTPVGSGTRGGLYHSQSPEAIFVHTPGLVVVMPSTPYNAKGLLKAAIRGDDPVVFLEPKILYRAPREEVPEGDYVVEIGKARVAREGDDVTLVTYGAVVHKALEAAERVKASVEVVDLQTLNPLDFDTVLKSVSKTGRLIIAHDSPKTGGLGAEVAALVAEKALDRLTAPVIRLAGPDVPQSPIAHDAAYAPTVERIIKAIEYVMRY

SEQ ID NO: 41409 - protein, 383 aa, Pyrobaculum aerophilum str. IM2
MEFKFPDLGEGLVEGEVIKWHVKEGDFVKEGDPLVDVMTEKATVTLPAPTTGRVVKILVREGEVVKVGQTLCVIEPAEGPAAGPQTEAPARPREVAAMPAARRLAKELGIDLSKVKGTGPGGVITVEDVKRYAEETAKATAPAPAPKAVEKAEEAEVVPVRGIRRAVAEKMSKAKRLIPHAYHLEEVDFTELIKLRERVKAEAEKRGIRLTLLPFIAKAVAMALREYPMLNSEYDEEKNAIVVKKEVNLGIGVDTEQGLVVVVVKNADKKGLLEMAKEINELAQKAREGKLELQDVRGSTFTISNIGAVGGLGGLSILNYPEAGILAVGQARKKPWAVGDRIEIRDIALLAVSFDHRVVDGAYVARFMNRVKELLENPWLLLL

SEQ ID NO: 41410 - protein, 268 aa, Desulfovibrio vulgaris subsp. vulgaris str. Hildenborough
MTQASIARTVLIIEDSPVQAKIIRKQIQAYTQFDVRVAHSLADAEDVLREAHDTIFVAVIDLNLPDAPDGEAVDLCLHWQMPSIVLTATFNEDIRRRFIERRVVDYFFKGSIQDMDPMVTSIERVFKNRFVHALVVDDSRTQRGIIRQLLEVQCVNVLEAENGVEGLAVLEANPQVTLVITDYQMPEMDGIELVRELRQRHRMDKIAIVGVSAVGSGPLTAQFLKHGANDFLTKPFEVEEFYWRVNQTLEGLDLMCDLRSCREQLESR

SEQ ID NO: 41411 - protein, 486 aa, Listeria monocytogenes str. 4b F2365
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALILCILVIVGQDYAAFLKPEFTNPAWWQKIGISYIGLPIFLVFWLSFKFTNKTKVIPLEDCKFDQK

SEQ ID NO: 41412 - protein, 398 aa, Acidobacteria bacterium Ellin345
MKAVCWNGRHDMRVETVDDPKILNPRDCIIKVTRTAICGSDLHLYNGLIPTMEAGDIVGHEFMGEVVEIGPQVKKLKVGDRVVIPFTIACGNCFFCRQQLWSSCDNTNPNAYIAEALMGYSPSGLFGYSHMTGGYAGGQAQYVRVPFADIGPLKIESDLTDDQVLFLSDVFPTGYMAAENCDIQPGKGQTVAVWGCGPVGLFAIKSAFLLGAEQVIAIDRFPERLYLAEQAGAETLNYSEIPDLIEVLKELTGGRGPDACIDAVGMEAHGVSIDALADEVKQVMKVETDRPLALRQAIQACRKGGVVSVPGVYGGFVDKIPMGAFMNKALTMKTGQTHMMKYMKPLLEHIEKGDIDPSFIISHRVTIDQVPEMYDVWLKKQDHVTKIVIDPWAENIAA

SEQ ID NO: 41413 - protein, 368 aa, Mycobacterium tuberculosis H37Rv
MTSGSLQFTVLRAVNPATDAQRESMLREPGFGKYHTDHMVSIDYAEGRGWHNARVIPYGPIELDPSAIVLHYAQEVFEGLKAYRWADGSIVSFRADANAARLRSSARRLAIPELPDAVFIESLRQLIAVDKAWVPGAGGEEALYLRPFIFATEPGLGVRPATQYRYLLIASPAGAYFKGGIAPVSVWVSTEYVRACPGGTGAAKFGGNYAASLLAQAEAAENGCDQVVWLDAVERRYIEEMGGMNIFFVLGSGGSARLVTPELSGSLLPGITRDSLLQLAIDAGFAVEERRIDIDEWQKKAAAGEITEVFACGTAAVITPVARVRHGASEFRIADGQPGEVTMALRDTLTGIQRGTFADTHGWMARLG

SEQ ID NO: 41414 - protein, 243 aa, Glycine max
MRDPNLELQESGWEELRKEARKIEGDLDVKLSSYAKLGARFTQGGSGSGYVDSGSPPIGSSRSWKSMEMEIQSLLEKLLDINDSMSRCAASAGPATSVTQKLARHRDILHEFTQEFRRIKGNINSMREHAELLSSVRDDITDFKTSGSMSPRMQLLRERAAIHGSISHIDDVISQAQATRAVLGSQRTLFTDVQGKVKVLGDKFPMIRSLLGSIRRRRSRDTLILSAVIAACTLFLIIYWLSK

SEQ ID NO: 41415 - protein, 146 aa, Triticum aestivum
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECK

SEQ ID NO: 41416 - protein, 486 aa, Dechloromonas aromatica RCB
MLQDKILNFINGEFVATNKWFENRTPISNAVIGQVAEAGKAEVDAAVAAAQAALKGPWGKMTLAKRVELLEALVAEINNRFDEFLEAECADTGKPKSLASHIDIPRGAANFKVFADVIKNVPGEFFDMATPDGGTAINYTFRSPVGVVGVICPWNLPLLLMTWKVGPALACGNTVVVKPSEETPRTAALLGEVMNKVGIPKGVYNVVHGFGPNSAGEFLTTHPDVDAITFTGETRTGEIINRAASVGSRPVSLEMGGKNAAIVFADCDFDAAIEGTLRSAFANCGQVCLGTERVYVERPIFEKFVAAMKAGAEKLKIGVPEDPATGMGPLISKEHQNKVLSYFQIAKEAGATIVTGGGVPDMPGELKDGCWVQPTIWTGLPETARVIKEEIFGPCCHIAPFDTEEEVLEKANDNIYGLATAIWTKDVSRANRVAQQMEVGIAWVNSWFLRDLRTAFGGAKQSGIGREGGVHSLEFYTELKNICIKL

SEQ ID NO: 41417 - protein, 137 aa, Shigella flexneri 2a str. 301
MLKRYLVLSVATAAFSLPSLVYAAQQNILSVHILNQQTGKPAADVTVTLEKKADNGWLQLNTAKTDKDGRIKALWPEQTATTGDYRVVFKTGDYFKKQNLESFFPEIPVEFHINKVNEHYHVPLLLSQYGYSTYRGS

SEQ ID NO: 41418 - protein, 209 aa, Treponema pallidum subsp. pallidum str. Nichols
MSVRVYLFVAHGFEEVETITPLDYLRRAGIALTLVGVGAEQVVSTRGLRVSCDCSLEALCASPGIADAACAADAVLLPGGLENCHTLAACAAVRDFVMRVHLRGGLVAALCAAPARVLSAWNLLGSRRYTCYPGMEPAVFSAHDDGVGKRTEEEKSRALRKPERARVVRDGNLLTACAAGAAEEFSFAVIEALCGVEVAQSVRAQVVAR

SEQ ID NO: 41419 - protein, 515 aa, Debaryomyces hansenii CBS767
MGQILSQPVTEKISEHGIDKHLAYGISCMQGWRVNMEDAHATILNLYDLKNEGKGAVSDKAQDNSSSGKSGTDNDTTEEHTSFFGVYDGHGGEKVAIFTGQHLHEIIKSTKAFQEKDYVNAFKEGFLNCDQAILNDDEMKEDDSGCAAVSVIITPRQVICGNAGDSRSIMSINGFAKALSYDHKPSNEGEKSRICSAGGYVDMGRVNGNLALSRGIGDFEFKKNIDLPPEEQTVTCYPDVIQHNLDFTKDEFVVLACDGIWDCLSSQQCIECVSRGLYERKPLQDICEEIMELCCAPTSDGSGIGCDNMSMSIVALLDESRNESLDQWYDRVIKRIELSQSEDEESQFYGNISGEYNDMYKQMYGEYFEIGQQSQNSNTKSAGNNSSYYSMFGGLPGLRNGPGLNQNEDEEENELSNEPTEEIQEDGTAADLAGNGAISLQKLLASNAITNENGVIYLDTSSAQSLLAHFGMSGEDDEYEGNDVHDKHIEEEEVEEDDDQESKSKIEEEPQDDEE

SEQ ID NO: 41420 - protein, 387 aa, Oryza sativa
MNAMEDVVVLIVGAGPAGLATAACLAQRHVPYIIVERESSTASLWRHRAYDRLKLHLAKEFCELPHMAYPAGTPTYVPRDMFVEYLDSYANQFGIRPRYHTAVESAIHDKGKNQWVVLVRDMDTSVVARLATQFLVVAAGENSAANIPPIPGLSRFEGEAIHSSAYKSGRAYTGKSVLVVGAGNSGMEIAYDLATHGAHTSIVVRSPVHIMTKELIWYGMTMVQNLGLNVTAVDSLLVMAANFYFGDLSKHGIMRPKMGPLLLKSQTGRSAVIDVGTARLIKGGVIKVFQGISKINTNSVEFHGGRQNSFDAIVFATGYKSTVNAWLKNGESMFKDDGFPKNYFPNHWRGENGLYCAGFARRGLAGIAMDAKNIANDIVAAMDKMSC

SEQ ID NO: 41421 - protein, 126 aa, Desulfovibrio vulgaris subsp. vulgaris str. Hildenborough
MTAFVPDFGKAGGLVPAIAQDADTGEVLMMAWMNAEAFEMTLKTGEAHYFSRSRGRLWHKGGTSGHTQHIRAVRLDCDSDTILLLVEQRGGAACHEGYRSCFYREMKDGEVSICSPKVFDPKEVYK

SEQ ID NO: 41422 - protein, 301 aa, Desulfovibrio vulgaris subsp. vulgaris str. Hildenborough
MSAPIPTRSVKLSQSPCAADSSESAHRVPFRIPERLYGIVGHPLGHTLSPLLHNWGFALHSLPAVYMAWPVPPGRFASFMEAVRTLPVHGASVTIPHKEEALRLCDRVTDRARAVGAVNTLFLEDGVVCGENTDVTGFLAPLRARGVRIDEALVLGAGGAARAVLAGLVELGVRRVRISNRTHDKAMELAGAFGADVVPWDERGSAAAGLVVNTTPCGMQGARMGESPLPEGAFSGRGMAYDLVYNPLTTRFLADARAAGWETQDGLGMFVEQGREQFRIWTGLDLPAEGARRLIAEALGL

SEQ ID NO: 41423 - protein, 60 aa, Arabidopsis thaliana
  misc_feature (34)..(34): Xaa can be any naturally occurring amino acid
  unsure (1)..(60): unsure at all Xaa locations
IIPVTSMHSSAIMVASPAQATIVSPSNGPKSSAXAFRATHKAFNDITSNRSIGGTVNCIQ

SEQ ID NO: 41424 - protein, 131 aa, Oryza sativa
  misc_feature (94)..(94): Xaa can be any naturally occurring amino acid
  unsure (1)..(131): unsure at all Xaa locations
TRLNPGRSRAHDVGHGDRHQRAAGAGEGSSSAAGPSSRKPNKRFEIKKWNAVALWAWDIVVDNCAICRNHIMDLCIECQANQASATSEECTVAXWGVCNHAFHFHCISRWLKTRQVCPLDNSEWEFQKYGH

SEQ ID NO: 41425 - protein, 553 aa, Mycobacterium tuberculosis H37Rv
MAFSVQMPALGESVTEGTVTRWLKQEGDTVELDEPLVEVSTDKVDTEIPSPAAGVLTKIIAQEDDTVEVGGELAVIGDAKDAGEAAAPAPEKVPAAQPESKPAPEPPPVQPTSGAPAGGDAKPVLMPELGESVTEGTVIRWLKKIGDSVQVDEPLVEVSTDKVDTEIPSPVAGVLVSISADEDATVPVGGELARIGVAADIGAAPAPKPAPKPVPEPAPTPKAEPAPSPPAAQPAGAAEGAPYVTPLVRKLASENNIDLAGVTGTGVGGRIRKQDVLAAAEQKKRAKAPAPAAQAAAAPAPKAPPAPAPALAHLRGTTQKASRIRQITANKTRESLQATAQLTQTHEVDMTKIVGLRARAKAAFAEREGVNLTFLPFFAKAVIDALKIHPNINASYNEDTKEITYYDAEHLGFAVDTEQGLLSPVIHDAGDLSLAGLARAIADIAARARSGNLKPDELSGGTFTITNIGSQGALFDTPILVPPQAAMLGTGAIVKRPRVVVDASGNESIGVRSVCYLPLTYDHRLIDGADAGRFLTTIKHRLEEGAFEADLGL

SEQ ID NO: 41426 - protein, 182 aa, Gloeobacter violaceus PCC 7421
MIKVLVPLAEGFEEIEAVTIIDVLRRADIEVTVAALADLAVQGSHGITLVADTRLDEINPLTFDAVVLPGGPGVARLRADERVRKLLLEMRAAERWTAAICAAPTVLSDAGLLAGARATSYPSVRPELTVGEYLETSVVVDGRIVTSRGVGTALDFALKLVALWEGESKAQALARAMVVGSP

SEQ ID NO: 41427 - protein, 478 aa, Mycobacterium tuberculosis H37Rv
MTEKTPDDVFKLAKDEKVEYVDVRFCDLPGIMQHFTIPASAFDKSVFDDGLAFDGSSIRGFQSIHESDMLLLPDPETARIDPFRAAKTLNINFFVHDPFTLEPYSRDPRNIARKAENYLISTGIADTAYFGAEAEFYIFDSVSFDSRANGSFYEVDAISGWWNTGAATEADGSPNRGYKVRHKGGYFPVAPNDQYVDLRDKMLTNLINSGFILEKGHHEVGSGGQAEINYQFNSLLHAADDMQLYKYIIKNTAWQNGKTVTFMPKPLFGDNGSGMHCHQSLWKDGAPLMYDETGYAGLSDTARHYIGGLLHHAPSLLAFTNPTVNSYKRLVPGYEAPINLVYSQRNRSACVRIPITGSNPKAKRLEFRSPDSSGNPYLAFSAMLMAGLDGIKNKIEPQAPVDKDLYELPPEEAASIPQTPTQLSDVIDRLEADHEYLTEGGVFTNDLIETWISFKRENEIEPVNIRPHPYEFALYYDV

SEQ ID NO: 41428 - protein, 927 aa, Coccidioides immitis RS
MSENEFDIAKSLFQDEADSDIDTRPRKRKAPTSLNLDVMADDNGDGDDGGSDDDAAFIAAHQASMNRKASNLKGRTVKKGGGFQAMGLNANLLKAITRKGFSVPTPIQRKTIPLVLDDQDVVGMARTGSGKTAAFVIPMIEKLKSHSTKVGSRGLILSPSRELALQTLKVVKELGRGTDLKCVLLVGGDSLEEQFGYMAGNPDIIIATPGRFLHLKVEMNLDLSSIKYVVFDEADRLFEMGFAAQLTEILHGLPQSRQTLLFSATLPKSLVEFARAGLQEPTLVRLDTESKISPDLQSVFFTVKSAEKEGALLHILHDVIKVPTGETEAGKHAREQAISGKSSKKRKRSEQNNPNPQESPTEHSTIIFVATKHHVDYIASLLRESGFAVSYAYGSLDQTARKIQVSNFRTGISNILVVTDVAARGIDIPILENVINYDFPSQAKIFVHRVGRTARAGRKGWSYSLVRDADAPYLLDLQLFLGRRLVMGRGQQESANFAEDVVVGGMARESIARSCEWVSKLLDEDIDIQNQREVAMKGEKLYIRTRNSASAESAKRAKDVVASDGWTMLHPLFNNEASQMEVEREKMLARIGGYKPQETIFEISGRRGGKAGDDEAIDMMRKIRSTMENKRAKKQDANQPTTDAEVPASALATTLGDDKDNGLGDDMDQDDVADMSMASDSELEVTFSYQSDKSKSKKKSGDKQSSGTFQNPEYFMSYTPAAHSFAEERGYGVHSGSNSNFVEASRDATMDLSRDEANRGFAEPRSIMRWDKRHKKYVSRRNDEDGSKGALLVKGESGAKIAASFRSGRFDAWKKSKRLGRMPRVGETENPGLGSTVPARGQKFRHNKEQAPKAADKYRGDYEKRRKKEQELQKRQAETGMLQFGSKGGTKKVKSEIRSVDDVRKARKLKEKRREKNARPSKKGKAR

SEQ ID NO: 41429 - protein, 446 aa, Mycobacterium tuberculosis H37Rv
MDRQKEFVLRTLEERDIRFVRLWFTDVLGFLKSVAIAPAELEGAFEEGIGFDGSSIEGFARVSESDTVAHPDPSTFQVLPWATSSGHHHSARMFCDITMPDGSPSWADPRHVLRRQLTKAGELGFSCYVHPEIEFFLLKPGPEDGSVPVPVDNAGYFDQAVHDSALNFRRHAIDALEFMGISVEFSHHEGAPGQQEIDLRFADALSMADNVMTFRYVIKEVALEEGARASFMPKPFGQHPGSAMHTHMSLFEGDVNAFHSADDPLQLSEVGKSFIAGILEHACEISAVTNQWVNSYKRLVQGGEAPTAASWGAANRSALVRVPMYTPHKTSSRRVEVRSPDSACNPYLTFAVLLAAGLRGVEKGYVLGPQAEDNVWDLTPEERRAMGYRELPSSLDSALRAMEASELVAEALGEHVFDFFLRNKRTEWANYRSHVTPYELRTYLSL

SEQ ID NO: 41430 - protein, 199 aa, Bifidobacterium longum DJO10A
MARTAHIVRETSESHIDLELNLDGTGKTDIDTSVPFYNHMMTALGKHSLIDLTIHAHGDTDIDVHHTVEDTAIVFGEALKQALGDKKGIRRFADATVPLDEALAKAVVDISGRPYCVCSGEPEGYEFCMIGGHFTGSLVRHVLESIAFHAGICLHMQVLAGRDPHHIAEAEFKALARALRFAVEIDPRVDGVPSTKGAL

SEQ ID NO: 41431 - protein, 350 aa, Azoarcus sp. EbN1
MKICILPGDGIGPEITAEAVRVIEALDLKFEMEEALLGGAAVDATGDPYPEATRKLAREADAVLLGAVGGPKWDTLPREQRPERGLLGIRKDLGLFANLRPAILYPELANASSLKPEVVAGLDILIVRELTGDIYFGQPRGLEVRDGERFGFNTMHYSESEIRRIGRVAFEAARKRNRRLCSVDKMNVLETTQLWRDVMIELAAEYPDVELSHMLVDNAAMQLVRAPKQFDVMVTGNMFGDILSDEASMLTGSIGMLPSASLDANNKGLYEPSHGSAPDIAGQGIANPLATILSVAMMLRYTFNQENGALRIENAVKKVLAQGLRTGDIFEPGTTKVGTKQMGDAVLAAL

SEQ ID NO: 41432 - protein, 570 aa, Roseovarius nubinhibens ISM
MARHLITSAIPYINGIKHLGNLVGSQLPADLFARYLRGRGQEVLFLCATDEHGTPAELAAAKAGKPVEQYCAEMHDIQAEIAKGFRLSFDHFGRSSSPQNHRLTQHFAGRLAEAGLIEEVSEKQVYSNADGRFLPDRYIEGTCPNCGYDKARGDQCENCTKQLDPTDLIEPRSAVSGSTDLEVRETRHLYLRQSSMRDELNAWIDAKKDWPILTTSIARKWLNDGDGLQDRGITRDLDWGVPVKKGEADWPGMEGKVFYVWFDAPIEYIACSQEWVDAGKGDDWERWWRTDKGAEDVTYTQFMGKDNVPFHTLSFPATILGSGEPWKLVDYIKSFNYLNYDGGQFSTSQGRGVFMDQALDILPADYWRWWLLSHAPESSDSEFTWENFQASVNKDLADVLGNFVSRVTKFCRSKFGEEVPAGGAFGAEETALIETLTTRIRAYEGHMEAMEVRKSANELRAIWVAGNEYLQSAAPWATFKDDPEKAAAQVRLALNLIRLYAVLSAPFIPDASAAMLKSMQTEDDQWPEDVGAALETLAPGHGFTVPDVLFAKITDEAREDWQTRFSGTRD

SEQ ID NO: 41433 - protein, 234 aa, Zea mays
MAMDDLAGASSSSSMAAAASSDPSHGWQTVSYPKRNRKQAHQPPRAMAPDLALQANGKGSGVFDAVEKRSQERHRALQQQLASRAADLDDARIAVATGAAYSDDDDSDEAAAPRQEGEVKKPKKPKVKKPKVTVAEAAVLIDAENLAAHLFEISASYENQQDIQLMSCDSVSASQFPWAKMFKESVMSKMVDPAKLPIVPVCTRVGPMGIGGPDRLPCSTPLSHCLAINVMIIM

SEQ ID NO: 41434 - protein, 193 aa, Bifidobacterium longum DJO10A
MAQSDITIDALSKVGQQDAEYLVSLVRSVPGFPKEGIIFRDFMPVLADPKGLKILLKALEEALPVSPSEFDSIAGLESRGFLFGPAMAAHLGKGFIAVRKAGKLPPETIGESYDLEYGTASVEIETDAVQAGKRVLIVDDLIATGGTAKAATDLIEKAGGTVVGFSFVMRLDGLDGLDKLDGKPSSSLIAMPA

SEQ ID NO: 41435 - protein, 372 aa, Cryptococcus neoformans var. neoformans
MPVAPTVKSARTTSVYDRSCRASASPKSSRRLSSQTKAKIQAVAAPVSQARAVPQHRKVEEVMYFEEDYSEEIIAYMNSMDNSTLASAELMDMQPELQWFMRSYLIDFIIEVHQQFRLRPEVLYLAMNIVDRYISKRVVYKKHYQLVGCAALWIAAKFEDAKDKVPLVHELSEMCCKAYDESAFIQMEGHVLSTIGWVLGHPSAEAWLRVFTTGIRYEDQKVANMARFLMEITLFHREFIGIQSSIIAAGALMLARFICGKPYKPCFPNVPETVAARVSIAIDKRFSQELEKVSEIVISKICADVLRPCLYRLPGMVSVRPTIHLQPCYAFHPRLRSFNSGPCSFMLIILGQAWFMGNRLSRGFLRFVGSWR

SEQ ID NO: 41436 - protein, 176 aa, hyperthermophilic archaeon G1-H
PYGGGKGGIIVDPKKLSDREKERLARGYIRAIYDVISPYEDIPAPDVYTNPQIMAWMMDEYEAISRRKTPAFGIITGKPLSIGGSLGRNEATARGASYTIREAAKVLGWGDLKGKTIAIQGYGNAGYYLAKIMSEDYGMKVVAVSDTKGGIYNPDGLNADEVLKWKQEHGSVKDFP

SEQ ID NO: 41437 - protein, 1049 aa, Ehrlichia canis str. Jake
MGDIGMISALQAPNEIRKRMQMLYRTEENSYARYLTEKTEVSQDSKIRIYSVAKQIIEKIRVDRNLGIIDAFMQEYGLSNEEGIALMCLAESLLRIPDDCTINDLIKDKIGNSMWSNHIGSSSSMFVNAATWGLFIGGIVLKESNDSAKWFGTINNLLKTMGEPIIRKAIQQAMCTLGKHFIKGRDITEALNNRKEGELYSFDILGEAAKTRKDAERYFSEYMQAVDSIGKSKGSDDTGRLVDYDEISVKISALHSRYEFSQIDDVLDEIVDKLLQICRLAKEYNIRVCIDAEEASRLEISLMILEKLRFESSLNGWEGLGLAVQAYQKRAFSVLDFVEDISVRSCHKMMVRLVKGAYWDYEIKNSQELGLSSYPVFTRKVYTDVSYLACANKILSKPNTFYPCFATHNAYTLAAILEMANKDHPGFEFQRLHGMGASLYEYVTQELAANIKCRVYAPVGGYQDLLPYLIRRLLENGANSSFINQLNDSNISLEQLIQDPLEKAKELEYLPHPNIPLPKDIFGPERLNSSGIDITDSVTLANFNDEMKNYQNCKFKASSIVNGEEFDGDFIEILSPSNSEDLVGEVLFASSTQALSALDIAYSAFKDWSNVPVSTRASILEKAANLIEENKAKLIMLLIREGGKVISDAIAEIREAVDFLRYYAVLGRQELEGSNRLPGPVGEDNYLYFRSRGVFVCISPWNFPLAIFIGPIAAALVTGNTVIAKPAEQTSIIAYEAVKLLYDAGIPKGVLHLLLGDGKELGEVLLKNEKIGGVAFTGSTETARIINQSIAEKEGGIIPFIAETGGLNTMITDTSALVEQVTNDVITSAFKSAGQRCSALRVLFVQEEVADKQIEMICGAMEDLVIGDPMLLKTDIGPVIDKASQEMLIAHADRMSQEGKLLCQVKLGEECQKGYFFAPCAYEIQNISQLQREVFGPILHIIRYKKGDLHKILSEINDTGYGLTFAVQSRVQSNIDNIIDNINVGNVYVNRNQVGAVVGVQPFGGQGLSGTGPKAGGPYYLHRFLTEKVVSINTTALGGNTSLMCLTDQ

SEQ ID NO: 41438 - protein, 454 aa, Methanocaldococcus jannaschii DSM 2661
MHWGMEMNVEQAIEYVKKNNVKFIRFQFVDILGFPKNVAYPVKAGEKGIEELREIFENGVWFDGSSITGFVGIEESDMLLKPDLSTLSVLPWRPEEKSVARVICDVYKDEKTPFEGDPRSRLKAILEELKKEMNGEYFVGPEPEFFLLKRDPHNPHRWVPADDGGYFDVEPLDDAPDIRRDIVLALENLGFHVEASHHEVAPGQHEVDFKFDNALKTADSVITFKMTIKNIAKKHGLKATFMPKPFFGMNGNGMHCHQSVWFNGEPSFYDPEGPYNGLSETCLSYIAGILSHAKALVAITNPTVNSYKRLVPGYEAPVNIAWANKNRSAIIRVPAARGKATRIEFRAPDPTCNPYLAFACMLAAGLDGIKKKMTAPEPVERNIFKMSEEEKKQLGIESVPANLAAALDELECDEVLQKALGKHIYENYMEIKRAEWDDFRTAVTDWETGKYLIY

SEQ ID NO: 41439 - protein, 86 aa, Zea mays
DVHFSFIYCVEDLVVKRQYKDWESCFEKLGLDAKPLELKYANQTDALEPPHRYVPWVVVDGQPLLEDYENFEAYICKAYKGTPPKA

SEQ ID NO: 41440 - protein, 322 aa, Acidobacteria bacterium Ellin345
MSRKIAVLTSGGDAPGMNAAIRSVTRSAIAKGWTVMGVNQGYAGLVAGDYRELAARDVGGLLSKGGTFLGSARCPEFQKEDVREKALRNLNRSGIGALVVIGGNGSQTGGAALNDMGFPTLGVASTIDNDLVGSEITIGVDTALNIALEAIDRLRVTAASHQRGFLIEVMGRKCGYLALMAGIAGGAELVLVPEIDFEPDQIAEAIHDAYRRGKAHAMVVVAEGAKHNAEQLVRYFHDKNTGFELRATILGHVQRGGTPTAYDRLLASRLGAGAVEALDKGISGVVVGMNQGVVSTTPYSEVTGRTKGISPELYQLAHVLSR

SEQ ID NO: 41441 - protein, 352 aa, Oryza sativa (japonica cultivar-group)
MGVYLSTPKTEKYSGEGGNDRLRYGLASMQGWRTTMEDAHTALPRLDECTSFFGVYDGHGGKAVSKFCAKHLHLQVLKNEAYSSGDLATSVLKSFFRMDEMMKGQRGWRELAELGDKGQKFTGMLEGIIWSPKPGESDKPEDTWTEEGPHSHFPGPTSGSTACVAIIRNDELIVANAGDSRCVLSRKGRAYDLSKDHKPDLDAEKERILNAGGFIVAGRVNGSLNLARAIGDMELKQNEFLPAERQIVTAEPELNTVKLSEDDEFIVLACDGIWDCMSSQEVVDFVHKEMNTEDSLSAVCEKLLDHCLAPVSGGDGCDNMTVIIVKFKKPSKSAATSSTNQSVSSEEMRPKI

SEQ ID NO: 41442 - protein, 313 aa, Arabidopsis thaliana
MAISDLPRDLVEEVLSRVPVTSLRTVRSTCKKWNIISKDESFTKKHVGQANAAARESEFQVVIMTEYKVYLMSVNLHGIQNNVDPSIEFKCKLISLDDSDRIVDFHPVYETEIYNFHSDSWKNIVDSTPEGDMQYFKQGVSLKGNTYWFARKYVIYEGGQEAWVSFLICFDFTTERFGPRLTLPFDYSTKESVSLLSAREEQLVLLYHPWFTMMMEIWVSNKIELNAVSWIKFLEVNMITFPHYRFSFHHVSFFIDKKNKVVVVLDKDKETRSRNLGYFIGDDGYFKEVELGGSRDRNGYPFVFSYVPSSVQF

SEQ ID NO: 41443 - protein, 535 aa, Gloeobacter violaceus PCC 7421
MRVTDDLEKLLAILPVPLQERLHAHERLDELVEVVLDLGRRPEARFREGSDYLSEIPVTQDELDGCTARVGEFSGDNRAGIERTLHRISAMRNRHGKIIGLTCRVGRAVFGTIGMIRDLVESGRSILLLGRPGVGKTTALREIARVLADDLHKRVVIIDTSNEIAGDGDIPHPAIGRARRMQVARPEYQHQVMIEAVENHMPEVIVIDEIGTELEALAARTIAERGVQLVGTAHGNKLDNLIKNPTLSDLIGGIQTVTLGDEEARRRGTQKSVLERKAPPTFEIAVEMQERYKWIVHKDVAETVDYLLRDRKPLPETRALNGAGKVSVTRELSEAEWDEPLTTRTGSWHSPVPVVPLGAMEMEADFDGSRVRIYPYAVSRSHLERIVNTLGYPVLLTKEIDEADVVLALRSHVRDKGKIAAVAQNRQIPVHTVKANTIPHITRALRRILQIDEPGIPGDLDAGLFGSLDSEDELEAMEEARLAVEQIVLPKGQPVELLPRAPHIRKMQHELVEHYRLKSESFGQEPNRRLRIYPE

SEQ ID NO: 41444 - protein, 282 aa, Coprinopsis cinerea okayama7#130
MLLRPLPLLFALVSSALAYPAPDRVHIVGRAQSAKANESDFDILYQGNQDFRATHADSIKKLSTGQAPKFLFLGCSDSRVPEGTVFNAKPGTFFAERNIANLFEQQDNNVKAIVSYGVEHLHVKHIIVMGHYGCGGVQAAIASPPPLPWDEATTSIQTWIKPIRKLYQTSNRREIVELRERNEGEEEVAGPPTHDPGFRALVEENVKSTVSNIVRSKIIAQHFSPSHPNVPDLYVHGWVYDIDNGEVRDLGVSVGPPGKAVPPAPFMAVEAAVEYVQNDRYD

SEQ ID NO: 41445 - protein, 612 aa, Streptomyces rimosus
MCGIAGWIDFERNLAQERATAWAMTDTMACRGPDDAGLWTGGHAALGHRRLAVIDPAHGRQPMHSTLPDGTSHVITFSGEIYNFRELRVELESQGHRFRTHCDTEVVLHGYTRWGRELVDRLNGMYAFAVWDEARQELLLVRDRMGVKPLYYHPTATGVLFGSEPKAVLAHPSLRRRVTAEGLCEVLDMVKTPGRTVFSGMREVLPGEMVTVGRSGVARRRYWTLQAREHTDDLETTIATVRGLLTDRVRRQLVSDVPLCTLLSGGLDSSAVTALAARAGDGPVRTFSVDFSGAGTRFQPDAVRGNTDAPYVQEMVRHVAADHTEVVLDSADLAAPEVRAAVLGATDLPPAFWGDMWPSLYLFFRQVRQHCTVALSGEAADELFGGYRWFHRTAAIDAGTFPWLTAGSARYFGGRGLFDRKLLDKLDLPGYQRDRYAEARKEVPVLPGEDAREAELRRVTYLNLTRFVQTLLDRKDRMSMATGLEVRVPFCDHRLVDYVFNVPWAMKSFDGREKSLLRAAVRDLLPESVVTRVKTPYPATQDPVYERLLRDELAALLADSQAPVRELLDLGRARDLLRRPVGAVSQPYDRGSLELVLWMNTWLAEYGVSLEL

SEQ ID NO: 41446 - protein, 818 aa, Zea mays
RLVTHSTRTHYLIGQSQTNWAPSPPLPLPMAQKLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLSLFAPGDLKADRVTEEVPLDPLLNRTGNVWHVFIHGDELHGMLCGYRFDGVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINFFSPMARYSSSGIRDSGCGAINEFKAFVREAHKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQEGQFPHWNVWSEWNGKYRDTVRQFIKGTDGFAGAFAECLCGSPQLYQAGGRKPWHSIGFVCAHDGFTLADLVTYNSKYNLSNGEDFRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTEFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 41447 - protein, 308 aa, Oryza sativa (japonica cultivar-group)
MASFRLMIAAVSLSLVQLSMGSRRLMELYIPPASDQLTYHHGSVLSGDIPVSILWYGKFTPTQMSIIADFVVSLTGAPNAATPSVGQWWGTIEQLYLSNAATNSQTSTRVLLDEQVSDEQCSLGKSLTLAQIDQLAARVGTKRGGVALVFTDEDVTVEGFCSSRCGKHGSDASAGTTHIWVGNSAKQCPGQCAWPFAQPVYGPQGTPLVAPNNDVGADGMVMILASMVAGTVTNPYGDGFYQGPQDAPLEACSACPGVYGSGAYPGNAGKLLVDATTGASYNANGANRRKYLLPALYNPATSSCDTLV

SEQ ID NO: 41448 - protein, 263 aa, Streptomyces rimosus
MTTSATPRTALVTGGTSGIGLAVVKTLAARGLRVFLCARSRENVDAVVKELRDQGLQVAGCEGDVRSRESVERVVRAAVDRFGPLSVLVNNAGRSGGGVTARIPDELWYDVIDTNLNSAFLVTREALTTGGLERAGVDGRIISIASTGGKQGVPLGAPYSASKAGLIGFTKALAKELAPTGVTVNAVCPGYVETPMAVRVRQAYAATWDTTEEDVLSRFNDKIPLGRYSTPEEVAALVGHLAGDEAGSITAQALNVCGGLGIY

SEQ ID NO: 41449 - protein, 474 aa, Mycobacterium sp. JLS
MNAHPAGPRHAEEIHHGGAPPRPAGPDEVLRIAPNVWPRNAVRGADGVVSIAGVPVTDIAAQFGTPVFIIDEADFRSRCREISAAFGGGEYVRYAAKAFLCTEVARWIDEEGLALDVASGGELAVALHAGFPAERIALHGNNKSPDELALAVKSGVGHVVVDSMIEIERLDEIAAAAGVVQDVLVRVTVGVEAHTHEFISTAHEDQKFGLSLASGAAMAAVRRVFETDNLRLVGLHSHIGSQIFDVAGFELAAHRVIGLLRDVVAEFGVDKTAQMSTVDLGGGLGISYLPQDDPPPVADLAAKLSAIVREESAAVGLPTPKLVVEPGRAIAGPGTITLYEVGTVKDVAVASDRYRRYVSVDGGMSDNIRTSLYGAEYDVRLVSRVSDADPALSRVVGKHCESGDIVVRDAWLSGDVAPGDLLGVAATGAYCYSMSSRYNLIGRPAVVAVRDGHARLILRRETVDDLLSLEVSGQ

SEQ ID NO: 41450 - protein, 234 aa, Pyrococcus abyssi GE5
KISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETIARRKTPAFGIITGKPLSIGGSLGRNEATARGASYTIREAAKVLGWDDLKGKTIAIQGYGNAGYYLAKIMSEDYGMKVVAVSDSKGGIYNPDG

SEQ ID NO: 41451 - protein, 376 aa, Azoarcus sp. EbN1
MAKRDYYEVLGVNRDASDNEIKKAYRKLAMKHHPDRNPDNKDSEDHFKEAKNAYEILSDAQKRAAYDRYGHAGVDPSAGAGPGGQGFDGFADAFSDIFGDIFGGAGGAGRGRSNVYRGADLRYNLEISLEEAARGADKTIRIPTVEECETCHGSGAKPGTQPKPCPTCGGAGQVRIQQGFFSIQQTCPKCHGTGRIIPDPCRDCGGAGRVKRQKTLEVKIPAGIDEGMRLRHAGHGEPGVNGGPPGDLYVEIHIRAHPVFQRDHDDLHCEMPISITTAALGGEIEIPTLEGMARLKIPAETQSGKVFRLRGKGIRNVRSQAHGDLMCHVVVETPVNLTERQKELLREFEEVSSSDADRHNPKAKSWMDKVKDFFGA

SEQ ID NO: 41452 - protein, 325 aa, Trichodesmium erythraeum IMS101
MTTVLAIETSCDETSVAIVKNRQVLSNIVKSQINIHSFYGGVVPEVASRQHLEIINQAIAQAFREANLDWPDIDGIGATCAPGLVGALLVGLTAAKTLAIVHEKPFVGVHHLEGHIYATYLSQPELVPPFLCLLVSGGHTSLIYVKNCGEYETLGQTRDDAAGEAFDKVARLLKLGYPGGPVIDKLAAEGNKLAFSLPEGKISLPGGGYHPYDFSFSGLKTAVLRLVQKIEQEGNELLSGSSVTKDIAASFQETVAKGLTKRAIACALDYSLNTIAIGGGVAANSSLRQHLSRAVESHNLQVLFPSLRFCTDNAAMIGCVRLVGH

SEQ ID NO: 41453 - protein, 377 aa, Arabidopsis thaliana
MADADDIQPIVCDNGTGMVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPDGQVITIGAERFRCPEVLFQPSFVGMEAAGIHETTYNSIMKCDVDIRKDLYGNIVLSGGTTMFLGIADRMSKEITALAPSSMKIKVVAPPERKYSVWIGGSILASLSTFQQMWISKAEYDEAGPGIVHRKCF

SEQ ID NO: 41454 - protein, 381 aa, Bifidobacterium longum DJO10A
MADYYETLGVERGASDDEIKKAYRKLSRKYHPDIAGPEFEDKFKEVNNAYDVLSNPDKRRMYDSGVDPNNPNAGAGGFSGAGFGDMSDVFSTFFGSAFGGGSQGPVPRTQPGRDALASASIDLKTAVFGGTAHVKINTFSLCQECGGSGAQGGAQPVTCPDCHGQGFMQKVVRTMLGQMMTSAPCERCEGHGTIIQNPCPSCMGHGRVRTTRTVGVTVPAGINDNARLRLANQGEVGEGGGAAGDLYIDIRIKADKQFTRDGDDLHCWIQVPMSWAVLGHDLSIDTFDGEKTVSIPAGCQPEDTVTLKGLGVTNIRNKDERGNLIAHVNVLIPTKLNETERGLIEQFAASHDSGATHVSQASRPQAGQKKGFFSKLKDALS

SEQ ID NO: 41455 - protein, 320 aa, Bifidobacterium longum DJO10A
MLNAIAAVMPELWGGSADLGGSNKTDLKGAATFAPAECATKQWPNCNEFGRQLHFGVREFTMGCITNGILLGSHTRPFGGTFFMFSDYERSAVRLAALMEIPNLYIWSHDSVAVGEDGPTHQPVEHLASFRAIPQLEVIRPADAFETAEAYRYFFEKKNTLPGAMVLTRQGVPVLAETAAKAKDGVKKGAYVLVDTEGTPDVILMASGSEVQWAVAAAKTLAGEGVKARVVSVPSMEWFEEQDAEYKEAVLPAAVKARVSVEAGVAMPWYKYLGSYGKPVSIEQFGLQGDGAQNMIDLGITAEHVVEAAKASIAEVEAAK

SEQ ID NO: 41456 - protein, 481 aa, Azospirillum brasilense
MANVTYTDTQLLIDGEWVDAASGKTIDVVNPATGKPIGRVAHAGIADLDRALAAAQSGFEAWRKVPAHERAATMRKAAALVRERADAIAQLMTQEQGKPLTEARVEVLSAADIIEWFADEGRRVYGRIVPPRNLGAQQTVVKEPVGPVAAFTPWNFPVNQVVRKLSAALATGCSFLVKAPEETPASPAALLRAFVDAGVPAGVIGLVYGDPAEISSYLIPHPVIRKVTFTGSTPVGKQLASLAGLHMKRATMELGGHAPVIVAEDADVALAVKAAGGAKFRNAGQVCISPTRFLVHNSIRDEFTRALVKHAEGLKVGNGLEEGTTLGALANPRRLTAMASVIDNARKVGASIETGGERIGSEGNFFAPTVIANVPLDADVFNNEPFGPVAAIRGFDKLEEAIAEANRLPFGLAGYAFTRSFANVHLLTQRLEVGMLWINQPATPWPEMPFGGVKDSGYGSEGGPEALEPYLVTKSVTVMAV

SEQ ID NO: 41457 - protein, 415 aa, Triticum aestivum
MEAGGNDRLNAFLTARGVPKDTPHIPKYNSNAAAAYRDRIVALAEGRAWTDPPVVKETPGSGAPAPARRPPLPAGVGGGGGGGGGGWDDWDDEVRPDMRRNQSAGSFAGAGADSGRQPTRSKSTQDIYTKQELEASAASKEDFFARRMAENESKPQGIPPSQGGKYVGFGSTPPPSANRNNNGAAQGDVMQVVSQGFGRLSLVAASAAQSAATVVQVGTKEIQSKMREGGYDQKVNETVNVVTNKTAEIGSRTWGIMKGVMALATQKVEEYAKEGGVGGGWGDDWQQREQQNNSNEPYRRYEQETSNGNGWNSPQDGSAKNQNHNSNSWDDWDDQDKKEEPAKTSQSSDSWAGWDDAKDDGFDSYSHHSPANKGGSNQNGTAGGSYWADGRLPLGCWSLCESHILCRSCYMPGKM

SEQ ID NO: 41458 - protein, 129 aa, Glycine max
  misc_feature (44)..(44): Xaa can be any naturally occurring amino acid
  misc_feature (53)..(53): Xaa can be any naturally occurring amino acid
  unsure (1)..(129): unsure at all Xaa locations
VAASAYTSLAIGKAQSRSRAVLSWPRSISSSKSGQAQMKSEMKXCIVRGVDNXGALKAQTIMGVCSGHTVSSEQSYRNVVMSIKGSLSRGGTMISTCIAIGEIIKRAALIKDASVVGQEKGFVIMGIEV

SEQ ID NO: 41459 - protein, 789 aa, Zea mays
MAQQLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLCLFAPGDLKADRVTEEVPLDPLLNRTGNVWHVFIHGDQLHGMLYGYRFDGVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINFFSPMARYSSSGIRDSGCGAINEFKAFVREAHKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTKFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 41460 - protein, 426 aa, Bifidobacterium longum DJO10A
MYARQILDSRGNPTVQVVLDTEDGAQGLGLVPSGASTGEAEAWERRDGDKSVYGGKGVLNAVKAVNEVIAPKVIGMDAADQRALDDLMIELDGTPNKGKLGANAILGVSLAALYASAESAGLPLYRYIGGTNGHILPVPNMNIMNGGAHADFATDIQEYMISPYGFDTYSEALRAGVEVYHTLKNVLKKEGLNTGLGDEGGFAPKMKSNEDSLKYIMDAISAAGYEPGKQIGICLDVASSEFYNKETGKYRFDGEERDSAYMLDYYENLINEYPIVSIEDPFNEEGWEDWAAITARLGDRLQFVGDDLLVTNPARLQKAIDLGAANSLLVKLNQIGSVTETLDAIELATANGYTSMVSHRSGETPDTTISDLAVAKNTRQIKTGAPARGERVAKYNRLLEIEEELGSTAQYAGYSAFKACKKYLAK

SEQ ID NO: 41461 - protein, 901 aa, Mycobacterium tuberculosis H37Rv
MASYLPDIDPEETSEWLESFDTLLQRCGPSRARYLMLRLLERAGEQRVAIPALTSTDYVNTIPTELEPWFPGDEDVERRYRAWIRWNAAIMVHRAQRPGVGVGGHISTYASSAALYEVGFNHFFRGKSHPGGGDQVFIQGHASPGIYARAFLEGRLTAEQLDGFRQEHSHVGGGLPSYPHPRLMPDFWEFPTVSMGLGPLNAIYQARFNHYLHDRGIKDTSDQHVWCFLGDGEMDEPESRGLAHVGALEGLDNLTFVINCNLQRLDGPVRGNGKIIQELESFFRGAGWNVIKVVWGREWDALLHADRDGALVNLMNTTPDGDYQTYKANDGGYVRDHFFGRDPRTKALVENMSDQDIWNLKRGGHDYRKVYAAYRAAVDHKGQPTVILAKTIKGYALGKHFEGRNATHQMKKLTLEDLKEFRDTQRIPVSDAQLEENPYLPPYYHPGLNAPEIRYMLDRRRALGGFVPERRTKSKALTLPGRDIYAPLKKGSGHQEVATTMATVRTFKEVLRDKQIGPRIVPIIPDEARTFGMDSWFPSLKIYNRNGQLYTAVDADLMLAYKESEVGQILHEGINEAGSVGSFIAAGTSYATHNEPMIPIYIFYSMFGFQRTGDSFWAAADQMARGFVLGATAGRTTLTGEGLQHADGHSLLLAATNPAVVAYDPAFAYEIAYIVESGLARMCGENPENIFFYITVYNEPYVQPPEPENFDPEGVLRGIYRYHAATEQRTNKAQILASGVAMPAALRAAQMLAAEWDVAADVWSVTSWGELNRDGVAIETEKLRHPDRPAGVPYVTRALENARGPVIAVSDWMRAVPEQIRPWVPGTYLTLGTDGFGFSDTRPAARRYFNTDAESQVVAVLEALAGDGEIDPSVPVAAARQYRIDDVAAAPEQTTDPGPGA

SEQ ID NO: 41462 - protein, 493 aa, Mycobacterium avium 104
MSDIQTQAKTEYDKLFIGGKWTEPSTSEVIEVHCPATGEYVGKVPLAAAADVDAAVAAARAAFDNGPWPTTPPKERAAVIANALKVMEERKDLFTGLLAAETGQPPTSVETMHWMSSIGALNFFAGPAVDQVKWKEVRTGGYGQSIVHREPIGVVGAIVAWNVPLFLAVNKLGPALLAGCTVVLKPAAETPLSANALAEAFAEAGLPEGVLSVVPGGIETGQALTSNTDVDIFSFTGSSAVGREIGRRAADMLKPCTLELGGKSAAIVLDDVDLPSALPMLVFSGIMNSGQACVAQTRILAPRSRYDEIVDAVSTFVQSLPVGLPSDPAAQIGSLISEKQRARVEGYIAKGIEEGARLVCGGGRPEGLDSGFFVQPTVFADVDNKMTIAQEEIFGPVLSIIPYDTEEDAIKIANDSVYGLAGSVWTADVQRGIAVSEKIRTGTYAINWYAFDPCCPFGGYKNSGIGRENGPEGVEHFTQQKSVLMPMGYTLEG

SEQ ID NO: 41463 - protein, 255 aa, Ehrlichia canis str. Jake
MSSSLIAGTLFLVIFMSLLIVANWKMYGDFITFSSFTKELSINLTNVKADLEVVLCPPFIALPKVVDCISCIKFGAQNCFYETEGKYTGEVSAKMLYDCGCSYVIVGHSERRSIFHESDYHVQLKASAAIKSGLIPIVCVGETLLDRENGMLKDSLLNQCYNSFPKSGKFIIAYEPVWAIGSNTIPSIDMITEALEVIRSYDSTSDIIYGGAVNQDNIRDVIAINQLSGVLVGSASLKLDSFYNIIHGAVNVRQN

SEQ ID NO: 41464 - protein, 472 aa, Pseudomonas putida GB-1
MSGQNMHSGELKRGLKNRHIQLIALGGAIGTGLFLGSAGVMKSAGPSMILGYAICGFIAFMIMRQLGEMIVEEPVAGSFSHFAHTYWGGFAGFLSGWNCWVLYILVGMSELSAVGKYVHYWWPEIPTWVTAAAFFVLINAINLMNVKFFGEAEFWFAIIKVVAIVSMIGLGAYLLTSGSGGPDATVANLWSHGGFFPNGVSGLVMALAFIMFSFGGLEMLGFTAAEADKPKSVIPKAINQVIYRILIFYVGALVVLLSLTPWDNLVASIDASGGSYGSSPFVQVFSLLGSDVAAHLLNFVVLTAALSVYNSGTYCNARMLLGMAEQGDAPASLAKVDKRGVPVRSILVSAAFTFVAVLLNYLMPQNALELLMSLVVATLVINWAMISYSHLKFRQHLDRTGQKPLFKAMWYPYGNYLVLAFVVLILGIMLMIPGIQVSVYAIPFWLFGMFVIYMVKPRRKLNAGGAAGHVAK

SEQ ID NO: 41465 - protein, 1486 aa, Coprinopsis cinerea okayama7#130
MADQQPHHLTDIVEEPASTGVSRIGSQMTLQPKPSSVDDKLEKDIEDDDDRGRHPPPSSPKVPHRTRRTSSASRVSMDFFDPSGMQSLRRTLTHERVGLPKGQSEPSESSDTSSDHTLIVDGDNFDLEKTIKTIIRRRDQSEIKPRQLGVVFRNLRVVGLKAAASFQPTVGSLFNPADVVQNIQNARHPPVRNILDGFEGVVRPGEMLLVLGSPGAGCSTFLKTLANHREEYHSVEGEVHYDSITPEELKKWFRGDVQYSPEDDVHFPTLTVEQTIKFAARTRTPRNRIEYTRAQFIDTLSNILTTVFGLRHARKTPVGDAMIRGVSGGEKKRVSIAESLATRACIACWDNSTRGLDASTALEFVRALRIGTDTMRLSTIVSIYQAGESLFSHFDKVCVIYEGQMAYYGPADQAKDYFYEMGYVPANRQTTPDFLVAVTDPNARIAREGVTNQPRTAEEFAAYFKASAHGQRNKAEIEEYIAEHVGKPDAAQRYIDSARAEFAKRSGKKNPYMLTIPQQVAAVMRRKVQILRGDMLATGLNLFSYVFQALIMGSIFLKMPEQTSAYFSRGGVLFFALLFSALATMAEIPALYAQRRIVLRHEKAALYHPFVEALAHTLVDIPITFCILSLFCIILYFMTGLQRSVDQFFVFFLFVFAMAVTMKSWFRGIAAAFKSEATAQAVAGISVLALSIYTGYTIPKPTMIGALRWITYINPLRYGFEAILTNEFRTLNGLCTSLVPSGPGYENVSLANQVCAVVGALPGEAFVNGARFAELSYSFKWSNTWMNLGIVIAFAIGFLIVLLIFAEFNTTSSADTATTLFKRGSKKAVAAASSGSDEEKKGSPSGTVVVDEKGKDTSALKDEPALRMTDTFTWQHVHYTVPIPGEADRTLLSDVSGYVAPGKLTALMGESGAGKTTLLNVLAKRVYSGVVTGDMFVNGQSLPADFQSQTGYCQQMDTHMPNATVREALLFSAKLRQPPSVPLEEKEAYVEKCLKMCGLEEYADAIVGTLNVEYRKRTTIAVELAAKPKLLLFLDEPTSGLDSQSAWAIVSFLRSLADQGQAILCTIHQPSAELFQVFDRMLLLKKGGQTVYFGDLGHNATTLIQYFERNGARHCDPSENPAEYMLDVIGAGATATTEFDWHGIWKSSPEATAVQEELEAIHTEGRNRPAVEAELHTEFATSWLFQVKELFIRNVQSYWRDPTYIMAKMVLNVSSGLFIGFTFFKAKDTIQGTQNKLFAIFMVTILSVPLASQLQVPFIKLRTIYEIRERPSRMYSWTALITSQILVELPWNIIGSTLLFMCWYWPVGFLASRGGYTYLMLGIIFPLYYTTIGQAVAAMAPSVEIAALLFSLLFSFVIAFNGVLQPFRELGWWKWMYRLSPYTYLIEGLLGQAIGRQDVECAPYEYVQITPPEGLSCGGYMDPFISFAGGYLTNPNATDACNYCSVKTTDQFLLASFNISYSHRWRNVGLMLAFTVFNNTYGEFAA

SEQ ID NO: 41466 - protein, 359 aa, Streptomyces rimosus
MRELPEFPWDVLLPYKKRAAAHPDGLVNLALGEPVDATPDVLRDALAAATDAPGYPPTEGTPALREAAAAWLRRRLGVTVDPSAVLPAVGTKELIAWLPAMLGTGPGDTVAFPRLAFPTFDVSARLAGARGRPVDSPLELGSEPVKVVWLNSPSNPEGRVLSVPELREIVAWARDRGAVLVNDECYIEYGWDRRPVSLLDSAVCGGSHDGLLAVHSLSKRSNLAGYRAGVCSGDPALIGRLLQVRKHAGHAVPAPVQAAMVAALEDDAHVERQRDRYAYRRRVLRTALEGAGFRVEHSEGGLFLWATRGEPCWPAVQKLADLGILVAPGAFYGEAGEQYVRIAFTATDERIAAAAARLT

SEQ ID NO: 41467 - protein, 404 aa, Oceanicola granulosus HTCC2516
MSPAPFRRAERLAGIEISEIVQLSERAAELRRAGQDVVALTTGEPDFPTPPHVVAAAHAAAEAGQTRYPPTAGTPELRAAIARQAGAEAAEVLVSTGAKQVLANAMLATLDPGDEVLIPAPFWTSYGDIVALAGGRPVRLPCPAADGFKLRPEALAAAITPRTRWLMLNSPSNPTGAVYGPGELAALAAVLADHPQVWVLSDEIYSHLAYVPAPSLRDAAPGLAERTLVVDGVSKAFAMTGWRLGWGIGPRALIGAMAAVQGQVTSGACSISQAAALAALTGPQELLADRRAAFRARRDRVCAALAAIPGISCVPPDGAFYAFPDVTGLILGGGFADDAALCRWLLDEVGLALVPGRAFGMPGHVRLSFAYAEREIDDALDRLATAAARLAARPFQASKEQVTT

SEQ ID NO: 41468 - protein, 507 aa, Oceanicola granulosus HTCC2516
MNQQTPTTLDSHADVLTRAGLAPAELGGGSLAVRSPIDGAEVARLAETPAADMPAVIARAQDAFRAWRQVPAPRRGELVRLLGEELRAAKDELGAVVTLEAGKITSEGLGEVQEMIDICDFAVGLSRQLYGLTIASERPGHRMSETWHPMGPCGVITAFNFPVAVWSWNAALALVCGNPVIWKPSEKTPLTALATMKILERALARFGDAPEGLAQLVIGGADLGAALAESRDVPILSATGSTRMGGKVGPQVLARWGRPILELGGNNAMIVAPSADLDMAVRAIVFSAVGTAGQRCTSLRRLIVHSSIREELVTRLRAAYASLPVGDPRASGTLVGPLVDEAALEGMQDALEAARAEGGTVHGGAPVREGVPGGAYAAPALVEMPGQTETVKRETFAPILYVMGYDDLSAAIEMQNAVPQGLSSCIFTRDLREAETFLSATGSDCGIANVNIGPSGAEIGGAFGGEKETGGGRESGSDAWKAYMRRQTSTVNYSDALPLAQGVRFDV

SEQ ID NO: 41469 - protein, 535 aa, Treponema pallidum subsp. pallidum str. Nichols
MNWRNLDECAAYARLQAIRAPSLKTVLCGPEGIERVRRYCTDAGAGLRYHYAAKTVNEEILTALAALADEQELVAKYDALRAGAQINTGEKRKVLHHLTRLGVQGSSLASLPCEVRDMHAFYTKEYERVCAFARQVHEGGLRTSRGAPFTDVVQIGIGGSDLGPRALYLALEGWAQRHQAVKMRTHFISNVDPDDAALVLSKLPLETTLFILVSKSGTTLETLSNELFVAHVLRQAGLEPHTQFVAVTSETSPLANNPQYLASFYMDDFIGGRYSSSSVCGAVVLTLAFGPQVFGHFLSGAAEADRAAQEQDIRRNAALLDALIGVYERTILGYEHTAVLPYSQALARFPAHLQQLDMESNGKSVNRFGIPITYKTGPVIFGEPGTNGQHSFYQHLHQGTSVVPLQFIAFQHSQLGQDPIIRGSTGQQKLLANVVAQIVAFARGKEHADANKTFSGERPSSLLYAKALTPQTLGALLAHFENKIMFQGFAWNLNSFDQEGVQLGKTLAQHILAGEVEGVLRAYADLFDLAHAPTC

SEQ ID NO: 41470 - protein, 175 aa, Acidobacteria bacterium Ellin345
MGYLRNIGAIAKGMGITFSEMFKPTTVENYPDGPGVLRGAVFQERFRGMHVLQRDENGLEKCVACFLCAAACPSNCIYIEAAENTETNRVSGAERYAKVYNIDYNRCIFCGYCVEACPTDAITHGHGFELATFNASNLVYRKEQLLSGKPAHIGANEIFASDSREQQRLDQKAAK

SEQ ID NO: 41471 - protein, 617 aa, Synechococcus sp. WH 5701
MTLTPERHLKSSGPGHTKVETEAVDAASRSSPATNGNAADESAAAIKPPSKFERLKAASDYLKEPLATELENDKPFFTDGAVQILKFHGSYQQDNRDNRQKGQEKDWQMMLRLRSPAGRIPVPLYLAMDDLADRLGNGTLRLTTRQAFQMHGIAKADIREVIGTIVRSMGSTLAACGDINRNVMAPAAPFEKGGYPAARRLADEIADLLSPLAAEGSYLDLWVDGDHSYRFKPAAAVKRVRQRQLQGAGFSGDPNEPLYGGTYLPRKFKVAVTVPGDNSVDLLTQDIGLVAFTDPSGRLRGCNVYVGGGMGRTHNKEETFARTADPLGYVAAEHVLDLVQAIVALQRDHGDREQRRHARMKYLIHDRGVDWFRQELGRYLDAPIKPLRREPKPRLDDYLGWHRQNRGLWFVGLPLVCGRLEGERKRGLRRLVETYQLEVRLTPNQDLLLCSIGTSQRNSVKEALAALGFEAPEAPSLLSRHAIACPALPTCGLAITESERILPAVLERLEALLQRLGIERPLLLRMTGCPNGCARPYMAEVGLVGSGVEQYQLWLGGTPNLTQLAAPYLERMPLADLEATLEPLLVLWKSTGGRQSFGQFISGLGAERIQGLLPAES

SEQ ID NO: 41472 - protein, 267 aa, Bifidobacterium longum DJO10A
MASKRIPLVAGNWKMNFDHLEATYFVQKLVWLLRDAHFDFKRCEVALFPSFTSLRSVQVLVEADKLHVAYGAQSVSVTTQGAFTGDVSADMIAHLGCSYVIVGHSERRKYHPEDDANIVDQVRAVLAAGMQPILCVGESFEERRQGIELDFAVGQVRDVTRDLNEEQAAKLIVAYEPVWAIGTGMVATPQSAQDAANAIRNDLKTTFGTKVSDSVRILYGGSVTSKNAAELISQPDVDGFLIGGAALDVEELAKIARLALKSTKSRN

SEQ ID NO: 41473 - protein, 1423 aa, Ashbya gossypii ATCC 10895
MAFLKRLNVSSHSRSSSGSSGRTPQNTSGGSKATAVKPLPQIPVEMGGIESEVIKNGEGGQSVVILCDDVGSGSYTSVLLSPSDPHMFSADGQRLSVEEQAEKTLYSWDVTDPEQWTMQRVMSWFKAHDFDEQWILFFKRNHISGKKFLQLLAHDNFNKYESFLSATKNSSYNRFQHLLKRTLEENVSNSHRRQRSNKSNDSKGSADCSLRYRRRRSVASEQRTLTAAEGVTPRKTVEVADDRAGSSKNHRKAKSASVLYRRSFISLRSSSSSNIKNDVDDDCKTLPAMKISIPPRPFSSIERSTSSSPASTLKSQSSPLSPGNHNMFRKDHKSSSSDSSLFNNLFGSADEITKAVGGTAPQGEQIAVKKYNDTLPSPMRVSPRHIDDKSTIWDKLKKRALPSTEQYTPSRIKQLTSGRNSSYIQTLQESPDECSANNEDPPATATLEAPIIDDLVLEEKHYPSQKQDSSAQYVLVTKDNRIFLPLNIAPYKTTQELKDGMTAFLGISSKAYTIHLTDLGCDPGVSLSDDVIAAIGQRKLNTRHLKFYVKDATRMHLRLKNDSFTSDHNITTEMSRSKGSLRSAASSFISSNDDTNSFSDITSIDEHGNITGRRVYPQTPSHYYDQSAATHSPEVDYWNIKERLSEGTSPMNISLLRSTTKAASLPSSIDEIKKSSFKVIRKASVTDIDFNKGRESPYIRPKLAPKREAPRPPRTSSQVSLASSSSIQSSLVEQKSISNSPTKPQRQHAGTYVKNKTRPPPPPSIGSTMTVDTKVMTSVSDSPVSNEPPNRPYGPFSTQKLVPQGFKGVGVHPGTRKVEEQMHTNPVTQYIQKQRSRNSISKMGNNPSLYSPPRLKKRISTRRMVSSTSAADIFDENEISFADAPDLSDYDSENSESSDDIIWSTTNTTSLDASKISVSDSTTGDDSNFSVASSVELQSSIKNDAKTSEDSIVDSIKEEGDSVCNLVGRKMTLRPTTEVVYQNLEMFFPGTDLDKPILEGLTPPASPDSEANKMPDQDLTPLSKVSTISSESSMRQSTPRLLITKKSDSPQPMPVRNLKPPKRTKTIRSIAREASEARKKSLYNNLKRQNTKMWGTRVVEVTDKRMVSINKSKNSKGEYREFAWIKGEMIGKGSFGAVYLGLNVTTGEMMAVKQVEVPKFGSQDETTVNNAEALISEVSTLKDLDHLNIVQYLGFENKNCIYSLFLEYVAGGSVGSLIRLYGHFDEQLIRFLTTQVLEGLAYLHLRGILHRDMKADNLLLDNDGVCKISDFGISRKSNNIYSNSEMTMRGTVFWMAPEMVDTTQGYSAKVDIWSLGCVVLEMFAGKRPWSNLEVVAAMFQIGKSKSAPPIPEDTLPHISQDGRAFLDDCFMIDPEERPTADTLLSHPFCQVPKEFNFRDTDLYNFIKQNDKLNNSKLTRNSQR

SEQ ID NO: 41474 - protein, 161 aa, Synechococcus sp. WH 5701
MPALAAMLLMLASAESSRAQPIQPGEQVGPALDQVPAVPAPAPTGQVTIESDRQQADNVTGIITATGNVRIVYPDRRVVATSRQAQYFTREGMIILSGDVDVVQDDGNLLRADRVTYLVERERALAQPLEGQQVFSKLLIQTTPQVQPPGAQPQPLTPPLR

SEQ ID NO: 41475 - protein, 460 aa, Acidobacteria bacterium Ellin345
MSTETLHLPAKKERQYRFPRGVEHNLLWEGLKNLGPIDPLRFFERLKRDYGKVGGYRVGNKRVVFLADAELIREVLVVQNDNFVKGEPVRRTKVLLGNGMITAEQQDWRSQRQAAQPAFHRQRIRSYADQMVGLTIETRDRIAPGIEFDLAQMFMELALKVVGKTLFDTDLDHEAGVVAHEISNIMDVYNFMMAVPAPQLMLHLPWPQVIKFRKARRRVDETVNRMIESHLHGPKRDCGDLLSMMIQAIPDVETPEGKEQLRDQVVTIFLAGYETTANALSWTFRLLGENPEVERRVLAEVDDVLNGRMASVEDVPQLKYIEMVLAESMRLYPPAWAMVRQGINDFQLGDYFLPGGTTVMMSQWVMHRSEEFWLDPLRFDPERFRPEAKAGRPKFAYFPFGGGGRQCIGEAFAWMEGALLLATLVQKYRFRLVAGQTFEPQSLITLRPRNGVRVVAEARG

SEQ ID NO: 41476 - protein, 230 aa, Triticum aestivum
  misc_feature (33)..(33): Xaa can be any naturally occurring amino acid
  unsure (1)..(230): unsure at all Xaa locations
MEKSRSGPFDREALYPPKAYALEEATTRGPGGXKKDGDRLAVSLTHPSPYASFGYKHSSKGQVIHWVNKLGRRPQGFRDHVTLGPKLSETVKGKLSLGARILQAGGVERVFRQAFSAEKGERLVKALQCYLYTTSGPIAGMLFVSTRKIAFRSDRSLTVTSPAGDVARVPYKVVVPLGRIKGVQPSENADNPEQKYIHMATVDGFEFWFMGFVSYQRCCKYMQQVISSQL

SEQ ID NO: 41477 - protein, 214 aa, Betula pubescens
LGKKQEEKPQEEVLVDEFEKVKVSDQSHPKVGKYYEEDYEVEELKKKDKHGLLEKLRRSGSSSSSSSDEEEGEGEEKKKKRKEKKEKKGTLKEKLAGEKEEEKYEKQHEEKYEKPYEEKYEKPYEEKYEKPYEEKYEKHEDTTVPVHVEKYEEAEATQFPAEPVHVEKYEEAEVAYIPEKPAGVPVHEAKYEEEVAHIPAEPAHPEEKKGFLEK

SEQ ID NO: 41478 - protein, 185 aa, Brassica napus
MKPVQSAPVKSRPRRRPDLSLPLPQRDVSLAVPLPLPPTSSGSSSSAPSSAGSSAPKNYSDLERGNRIGSGAGGTVYKVTHRPTSREYALKVIYGNHEENVRRQICREIEILRDVSHQNIVKCHEMFDQNGEIQVLLEFMDGGSLENRHVSNERDLAHLSHQILNGLAYLHGRHIGHRDIKPSNL

SEQ ID NO: 41479 - protein, 199 aa, Glycine max
LLSPIHQFSISASKLLKPMDKTARRSNVLKPKNIITQKSVDKLLHRHLKVDLDREGDIFSVLEPNTDFSTNALQPSEALSTPKQQKENKGFPQNCTETSSSSHKKPPSRLSGSCVTELVSPPVLKKVKNRVMHEKYINQLRCRESRRRADATKIIEGTSIQKRDVVNAAKVALQVNFVDNTSSSGEDNDDGIEFEDESQ

SEQ ID NO: 41480 - protein, 461 aa, Listeria monocytogenes str. 4b F2365
MSLFSLKRKNYFVPLEIQRQQWFKHFIVAFMSVFICYLTVYLLRNNFKAAQTLLIEQNHFSTTELGMIGLAFSVMYGIGKTILGYAVDGRNAKKIMSFLLGISAIISIIIGILLVTKQATVGILFILWGANGFVQSPGGPASYSTITRWTPKLKRGRWLGFWNASHNIGGALAGIVAFWGATTFFNGGAGGMFIVPGIIAIIIAIICFSVGHDEPEELGWNSAAEIFEEREEQGESETKDLSRFQILCRFVINNPWVWTLCVINIFIYIVRIGIDNWAPVYCIQALGWSTKDAIMTISFFEIGALLGSLSWGWLSDIMKGRRMLCSIIAVVIEFFMLISYSQVTSVYSMYTVLFILGFLVFGPQLLIGVSVIEFVPRNALAVTNGLTGTFAYLFGDSFAKVFLGYIADPTKAGIQIFGYTLHGWGATFTIMFTALIIAGLMMIPVALKQEKIIRQAKVLHL

SEQ ID NO: 41481 - protein, 224 aa, Aristida purpurea var. longiseta
IENKISRQVTFAKRRNGLLKKAYELSLLCDAEVALIIFSGRGRLFEFSSSSCMYKTLERYRSCNYNPQEAKAPQESEINYQEYLKLKTRVEFLQTTQRNILGEDLGPLSMKELVQLENQIEISLKQIRSRKNQMLLDQHYDLKNKEQKLQDLNKDLRKKLQETSGENALHISWEEGGHSGASGNAIEPNQGFLQHPENDSSLQIGYHQQAYMDQLSNEDMGAHH

SEQ ID NO: 41482 - protein, 420 aa, Oryza sativa (indica cultivar-group)
MELPCPRLLLLLRLLVFLVAVSWPLCGAGTEGLGVGEEGLSSIGASSGSRNVRRLLQTGGVNQGAPAPLPLEQSPSAGIAALLIISAAGAFYCRAKKMGTVRPWATGLSGQLQKAFVTGVPALKRSELETACEDFSNIIGCTSTCTLYKGTLSSGVEIAVASSLVTSADDWSKECESRYRRKITSLSKVSHKNFMNLLGYCEEEQPFTRVMVFEYAPNGTLFEYLHVREAEKLDWMTRLRISMGIAYCLEHMHQLKPPVVPRNFDSTTIYLTDDFAAKVSDLEFWSGAKEPNPATSNSSSSSDLENTVRKYGMVLLEMLTGRVPDSEEDGPLERLASRYFDGETRLAELIDPSIGSFSEEAARSLCEVVRSCIDPDPKRRPTMAEVAARMREITALGPDGATPKVSPLWWAELEIMSSES

SEQ ID NO: 41483 - protein, 47 aa, Zea mays
RTRGRGPSTNLFHLTLVTTAVICCWMMYAIVYLAQMKPLINPILSGE

SEQ ID NO: 41484 - protein, 448 aa, Pseudomonas fluorescens PfO-1
MNQPQSAVGHCLDVQSFINAQPISRYQWRVVILCFLIVFLDGLDTAAMGFIAPALSQDWGIDRASLGPVMSAALIGMVFGALGSGPLADRFGRKVVLVGAVFLFGAFSLASAYATNVDQLLVLRFLTGLGLGAGMPNATTLLSEYTPERKKSLLVTSMFCGFNLGMAGGGFISAKLIPAFGWHSLLLIGGILPLILTVVLLLWLPESARYLVVRNRGTDKVRKTLAPIDPAIVAQAASFSVPEQKTVKARNVFAVIFSGTYSVGTLLLWLTYFMGLVIVYLLTSWLPTLMRDSGASMEQAAFIGALFQFGGVLSAVGVGWAMDRFNPHKVIGIFYLLAGVFAYAVGQSLGNITLLATLVLVAGMCVNGAQSAMPSLAARFYPTQGRATGVSWMLGIGRFGAILGAWMGATLLGLGWNFEQVLTALVIPAGLATAAVVIKGLVSHADAT

SEQ ID NO: 41485 - protein, 1281 aa, Arabidopsis thaliana
MCLNTLCAILCFVLTVSFGFVSAQKCGESVFFRPNGNYDTNRRLVLSTLASNVSSQNNRFYNVSVGEGAGRIYALGLCIPGSDPRVCSDCIQLASQGLLQTCPNQTDSFYWTGDNADKTLCFVRYSNNSFFNKMALEPTHAVYNTMRFQGNLTAYTRTWDAFMNFMFTRVGQTRYLADISPRINQEPLSPDLIYALMQCIPGISSEDCETCLGKCVDDYQSCCNGFIGGVVNKPVCYFRWDGYKYYGAFGDEAPSQPPTPLPLPPPPPRDPDGKKISTGVIVAIVVSAVIFVVLVALGLVIWKRRQSYKTLKYHTDDDMTSPQSLQFDFTTIEVATDNFSRNNKLGQGGFGEVYKGMLPNETEIAVKRLSSNSGQGTQEFKNEVVIVAKLQHKNLVRLLGFCIERDEQILVYEFVSNKSLDYFLFDPKMKSQLDWKRRYNIIGGVTRGLLYLHQDSRLTIIHRDIKASNILLDADMNPKIADFGMARNFRVDQTEDQTGRVVGTFGYMPPEYVTHGQFSTKSDVYSFGVLILEIVCGKKNSSFFQMDDSGGNLVTHVWRLWNNDSPLDLIDPAIKESYDNDEVIRCIHIGILCVQETPADRPEMSTIFQMLTNSSITLPVPRPPGFFFRNRPNLDPLTYGSEQGQSSSMSVPFSIDSAPNGTYDTNRHLILSNLASNVSSRDGYYNGSVGEGPDRIYALGLCIPGTDPKVCDDCMQIASTGILQNCPNQTDSYDWRSQKTLCFVRYSNSSFFNKMDLEPTMVIGDLNSGLFQGDLAAYTRTWEEFMNSMITRVGRTRYLADISPRIGSARIYALMQCIRGISSMECETCIRDNVRMYQSCCNGFIGGTIRKPVCFFRWDGSEYLGAFGDTPSLPPPSPDGKTISTGAIVAVVVSVVIFVVLLALVLVIRKRRQSYKTLKPKTDDDMTSPQSLQFDFMTLEAATDKFSRNNKLGKGGFGEVYKGMLPNETEVAVKRLSSNSGQGTQEFKNEVVIVAKLQHKNLVRLLGFCLERDEQILVYEFVPNKSLNYFLFGNKQKHLLDPTKKSQLDWKRRYNIIGGITRGLLYLHQDSRLTIIHRDIKASNILLDADMNPKIADFGMARNFRVDQTEDNTRRVVGTFGYMPPEYVTHGQFSTKSDVYSFGVLILEIVCGKKNSSFYKIDDSGGNLVTHVWRLWNNDSPLDLIDPAIEESCDNDKVIRCIHIGLLCVQETPVDRPEMSTIFQMLTNSSITLPVPRPPGFFFRNRSNLDPLTYGSELGQSSSKSIPYTIDSASITRVTPR

SEQ ID NO: 41486 - protein, 407 aa, Bifidobacterium longum DJO10A
MNVFGTPLRVMDHGQGAHIWDVDGNEYLDFLAGIAVNSLGYAHPKWVKAVADQAAKVAHISNYFASEPQIELASKLVKLAGAPEGSKVYFGNSGAEGNEAALKLAKLYGRTLPGALPSIGGKPARILAMTHGFHGRTMGALSATWKPGIRKPYDPLVPNIEFVRAGDKVALHDAFAQTGLGRYGKGPVAAVILELIQGEAGVQPLGADYVKFVRELCDINHALLIIDEVQTGIGRTGKWFAFQRDDLSGGVTPDMVTFAKGVAGGFPMGGMIAFGEKLAALFTPGSHGSTFAGNPLGAAAGLATLDVIEDENLVANAEARGEQLRDGIMATGNPLFVSVRGRGLLDAVELKHPCSHAVMNYCLEHGLIVNAVAPNALRFAPPLIVTAQDVDQALAILKDVPTDLPDD

SEQ ID NO: 41487 - protein, 522 aa, Oryza sativa (japonica cultivar-group)
MAPPVPTAAARLVLRRLLSTAVAEAEAAAVAPAAEKAAAKGAKTAAAAGEEKDARSLYRRLSALGGAGEGSVSRVMNKWVREGREARAADLAKYVKELRKYKRHAHALELMEWMVNTKGMNMSYTNHAIRLDLIYKVRGIEAAEQYFAGLPDPGKNHKTYGALLNCYCSAKMEDKATDIYRKMDELGISSSTLPINNLMSLYVKIGQHRKVTSLFEEMKVKNVKPDNLTCCLLMSSYAALNKIDTVGEVLKEMEEKKVALGWSAYSTLASLYVNANMVEEAESALKKLESLIDVQAGRQPFDFLMSLYASVGNLSEVNRVWNLIKANFQKVTNTSYLGMLQALYKLNDDDRMKQIYEDWESNYENYDARLTNMMTRAHLRNGLTKEAELLWEKVKEKGAEFDSKTCELFLEHYMGKGDMTSALNWVENMTKLPRKKSKLDQEKISCFLKYFEEHKDVEGAERFLNCLRTSGCIDGKAYESLLRTYLAAGKTSRSIRQMIKEDKIEICYGIGKLLKRIADKGR

SEQ ID NO: 41488 - protein, 477 aa, Zea mays
MASHNGTKHLAPMEVSVEAGNGGGAEWLDDDGRPRRTGTFWTASAHIITAVIGSGVLSLAWAIAQLGWVAGPAAMLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVSRELRVGPLALSVFRLTWRSAFVCVTTVVAMLLPFFGNVVGFLGAVSFWPLTVYFPVEMYIKQRRVPRGSTKWVCLQTLSVACLVVSIAAAAGSIADVIEALKVYHPFSS

SEQ ID NO: 41489 - protein, 1075 aa, Azoarcus sp. EbN1
MPKRTDIQSILIIGAGPIIIGQACEFDYSGAQACKALREEGYKVILVNSNPATIMTDPETADVTYIEPITWQVVESIIEKERPDALLPTMGGQTALNCALDLARNGVLEKYGVELIGASRDAIDKAEDRLKFKDAMTKIGLGSARSAIAHSMEEALQVQGGIGFPVIIRPSFTLGGTGGGIAYNMEEFDEICKRGLEASPTSELLIEESLIGWKEYEMEVVRDRADNCIIVCSIENLDPMGVHTGDSITVAPSQTLTDKEYQILRNASIAVLREIGVDTGGSNVQFAINPKDGRMIVIEMNPRVSRSSALASKATGFPIAKVAAKLAVGYTLDELKNDITGGATPASFEPSIDYVVTKIPRFAFEKFPMANDRLTTQMKSVGEVMAMGRTFQESFQKALRGLEVGAYGLDEVEADREDLEHELANPGAQRIWYVGQAFREGYTQEQLFNLTKIDPWFLAQIEDIVLTEKALTGRSLKALLAAELRELKRKGFSDRRLAKLLGVDETAVRLHRHANGVRPVFKRVDTCAAEFATSTAYMYSSYEDECEARPTDKKKIMVLGGGPNRIGQGIEFDYCCVHAALALREDGYETIMVNCNPETVSTDYDTSDRLYFEPITLEDILEIVHVEKPVGVIVQFGGQTPLKRAQALEDNGVPIIGTSPDMIDAAEDRERFQKLLNDLGLKQPPNRTARTPEAAVRLAAEIGYPLVVRPSYVLGGRAMEIVHEQKDLERYMREAVKVSNESPVLLDRFLNDATEVDVDALSDGRQVIIGGIMEHIEQAGVHSGDSACSLPPYTLSAKLQDELRRQTEAMARALNVCGLMNVQFAIQGDGDEATVYVLEVNPRASRTVPFVSKACGLQLAKIAARCMAGQSLASQGVTTEIVPPYYAVKEAVFPFVKFPGVDTILGPEMKSTGEVMGVGRSFAEAFVKSQLAAGVRLPQSGTAFISVKPTDRGVAVEVARELHELGFGLAATRGTGSAIEAAGLPVTLVNKVNEGRPHIVDMIKNNEISLVINTVEEKRQAIIDSRSIRTSALAAKLTVFTTIEGARAACMGMRHLEELQVYGLQSLHAELTQKS

SEQ ID NO: 41490 - protein, 1236 aa, Arabidopsis thaliana
  misc_feature (514)..(514): Xaa can be any naturally occurring amino acid
  unsure (1)..(1236): unsure at all Xaa locations
MVEGKGFLVSSVTELHRKEKQKKKGKSGGFESLNLGPNVFNAIKKKGYKVPTPIQRKTMPLILSGVDVVAMARTGSGKTAAFLIPMLEKLKQHVPQGGVRALILSPTRDLAEQTLKFTKELGKFTDLRVSLLVGGDSMEDQFEELTKGPDVIIATPGRLMHLLSEVDDMTLRTVEYVVFDEADSLFGMGFAEQLHQILTQLSENRQTLLFSATLPSALAEFAKAGLREPQLVRLDVENKISPDLKLSFLTVRPEEKYSALLYLVREHISSDQQTLIFVSTKHHVEFVNSLFKLENIEPSVCYGDMDQDARKIHVSRFRARKTMLLIVTDIAARGIDIPLLDNVINWDFPPRPKIFVHRVGRAARAGRTGCAYSFVTPEDMPYMLDLHLFLSKPVRPAPTEDEVLKNMEEVMTKTSQAIDSGVTVYGRFPQKTIDLIFNRTREMIDSSAELDSLERTSTKAFRLYSKTKPSPSKESIRRAKDLPREGLHPIFRSIIETGELEAMSFFQKIKNFRXEPKQTILEAEGEVAKSKHVKGPAGQWVDVMKKKRAIHEEIINTRHQQNQKTSNNHLEMEAEPTTSFVDGTVEGSKVSGKKRKAQETFKDDEFFISSIPVNHHSEAGLSLRGNEGFGSNRLDAAVLDLVADDGQGIKQQQSNYHWDKKGKKYIKLNNGDRVTASGKIKTESGAKATAKKTGIYKRWQERSHKKVSRDSGDADETTRMSGRGGRDGKRRQGSVPNAHVRSEIKDLDQVRKERQQKANKVSYLQSKRGGRGGRGGARGGRGGGARGGRGGSRDFGGGGRDFGSSSDRGGRSGGRDFGGRRGGASTSSRGGKRGGGRGGGGIVQQGSMETVYYDVLGVTPSASEEEIRKAYYIKARQVHPDKNQGDPLAAENVFSSSWRQVLGEAYQVLSDPVHREAYDRTGKFSAPKETMVDPTAVFALLFGSELFEDYIGHLAVASMASTQMASEIENSDQFQDKLKANQKPYAVQKEREENLSRFLKDFLSQYVHGDKEGFISRAESEAKRLSDAAFGADMLHTIGYVYTRQAAQELGKRALYLGVPFVAEWVRNKGHSWKSQISAAKGALQLLQLQEESNRRLKKDGTSPANELESHIQTNKETLMGSLWKLNVVDIEVTLLHVCQMVFRENNLRKEELKSRAMALKILGKIFQQEKQSKNGTTSRKEDEDSDDDDSSSDDDSSQPLSYRTPLLTQGIGRLFRCLCNPAFDVDDDEIVYKGK

SEQ ID NO: 41491 - protein, 406 aa, Pseudomonas putida GB-1
MSVEQAPVQRADFDQVMVPNYSPAAFIPVRGEGSRVWDQSGRELIDFAGGIAVNALGHCHPALVKALTEQANTLWHVSNVFTNEPALRLAHKLVDATFADRAFFCNSGAESNEAAFKLARRVAHDRFGPEKHEIIATVNSFHGRTLFTVSVGGQPKYSDGFGPKITGISHVPYNDLEALKAQISDKTCAVVIEPIQGESGVVPADKAYLEGARKLCDEHNALLIFDEVQTGVGRTGSLYAYQHYGVTPDILTSAKSLGGGFPIGAMLTTTELAKHLAVGTHGTTYGGNPLGCAVACAVLDVINTPQTLAGIKAKHERFKTRLEQIGQKYNLFTQVRGVGLLLGCVLTEAWQGKAKDVLNAAEKEGVMVLQAGPDVVRFAPSLVVEDADIDAGLDRFERAVATLTQG

SEQ ID NO: 41492 - protein, 139 aa, Candidatus Desulfococcus oleovorans Hxd3
MERTLSIVKPDGVERGLIGEVVRRLEKEGLKIIAMKMIHMTRAQAEGFYAVHRERPFFESLTTFMSSGPVVVMVLEGEDAILRYRTLMGATNYKDAAEGTIRRDFATEIERNVVHGSDAPDTAAFEIGYFFNSFEIMGR

SEQ ID NO: 41493 - protein, 362 aa, Glycine max
  misc_feature (163)..(163): Xaa can be any naturally occurring amino acid
  unsure (1)..(362): unsure at all Xaa locations
MLKNQPQPDWPEPIVRVQSLSENCEDSIPERYIKPSTDRPSIKSCNFDDANIPIIDLGGLFGADQHVSASILKQISDACKEWGFFQVTNHGVNPDLMDKVRETWREFFHMPMEVKQQYANSPKTYEGYGSRLGIEKGAILDWSDYYFLHYLPFSLKDYNKWPXASPPSCREVPDEYGRELVKLCGRLMKAFSINLGLDEKILQNDFGGEDIGACLRVNFYPKCPRPELTLGLSSHSDPGGMTMLLPDDQVPGLQVRKCDDWVTVKPAKHAFIVNIGDQIQVLSNAIYKSVEHRVIVNSDKERVSLAFFYNPKSDIPIEPIKELVTPKRPSLYPAMTFDEYRLFIRMRGPRGKSQIESLKSPR

SEQ ID NO: 41494 - protein, 332 aa, Acidobacteria bacterium Ellin345
MAENNGHYALRLKTGLAEMLKGGVIMDVMNAAQAEIAQESGATAVMALEKVPAMLRAEGGVARMASPKVIKEIMRTVDIPVMAKCRIGHFAEAQILQELGVDYIDESEVLTPADEEHHVDKHAFKTPFVCGARNLGEALRRIAEGAAMIRTKGEAGTGDVIHAVKHMRQILKEMKQLTVMPEEELYAAAKNHQAPYELIRTVAKAGKLPVPNFSAGGIATPADAALMMQLGAEAVFVGSGIFMKERATPLEVGKWSEQDAKQGRCSSNQVGTPRNPEEREEAMTRAKAIVEATAHFNDPKVLAEVSEKVTGTMKGLAVSAIEEKELLQTRGW

SEQ ID NO: 41495 - protein, 493 aa, Photobacterium profundum SS9
MSFWLGYRFHTRSGKSLTDGIEMKLFYNVEDKPPVGASILLALQHMLAAMGAIIAVPLVVGSAIGLPTDQMVTLVNAALMVSGIVTIIQCKGIGPVGIRLPVVMGTSFTFVAISISIGLDAGVSGIFGASLVGSIVMIVGSRFMTQIRKLFPPVVSGTVVVLIGLTILPVSVDWFAGGFVGQEEYGQINNLLLGLLVLVVVIVLSQVGKGIISAAAIVIGMAVGYITAIFMGIVDFSPVRNAEFFALPKLLPFGLSFTVSGIIGMSIAYLVTIMESTGDFLALSDATHTKLTGKKLSRGILCDGLGSALASLFGTTPFSSFSQNVGIVSITGVASRHVVAVTGFIMLIAGLFPKLGGIVVTIPSPVLGGAGLVMFAMIISSGIGILSRISFTKRNMLIIAVGVASGMAVTVRPEILTYLPDSFRVILGSGITTGSLVALGMNAFLSINRADEAESAQEKREALETQIIECEACDKALKEEEALEQKERLESAK

SEQ ID NO: 41496 - protein, 126 aa, Listeria monocytogenes str. 4b H7858
MEQTYVMVKPDGVERGLIGEIVTRIEKKGLKIVAGKLMQIDRELAEKHYAEHIGKSFFEDLIGFITSGPVFAMVLEGDDAIATARRMMGKTNPLEADPGTIRADYAVHTNRNVIHGSDSPESAKRE

SEQ ID NO: 41497 - protein, 321 aa, Listeria monocytogenes str. 4b H7858
MKLNFLYANMQKDIDSVEKELKKALSGAAAETTSDAALHLLEAGGKRIRPMFVCLSARLAPNADFDAVKNASVAIELIHMASIVHDDVVDNADLRRGRETIKSKWGNHIAMYTGDFLFAKSLEYMTEIKDVAAHKMLSHVTVELSTGEIEQLKDKYNFDQSVRNYLRRIKRKTALLIAASCGLGGVVSGQSEADYQKLYRFGYYVGMAFQITDDVLDFVGTEKELGKPAGEDLRQGNVTLPVFFAMEDPFLKKRISQVTEETPAEEIAVLVEEVKKAGAKQAEDVATAYLKKAVEILDSLPQVPELKPLKQIVRVLDKRNY

SEQ ID NO: 41498 - protein, 1030 aa, Cryptococcus neoformans var. neoformans JEC21
MRFSSRDEEPEDGEVVEDDAVWKNPLATTKYLKGAPSVSSSQKTSSYKKSRPSFIPSLDPADDDGHRPRRPPPPSLSSPPYQQSRHRSSSHNRKTISYEDEERGSGMQHALPKNPQTRQYPHSTEMREPEQRREDKYAKEPRSPHRREGYYSSRRGDGRDYPPQLDRERYGPARRLESGGDGGYGDRSRDRNMDRGGYRDKDDRRSYGRPSDSSAWGRPPREEYRDRRPEEFARHPTGERYREDSRERFPVDRDTGQRRSCSPVRIRSPERSSDRPLTPVPDNGRTSSPDHGAKNIASSRGHRSSPSHSSNHEDHNGEKGNGPIKLNRNRHRPSLPLKHISTQPPRSPSAPPPPPPPDPSTVPPSPTEPPPPMPGNLSLEQTVPHAPNPRAQMATRPPSPKREEGEIRQETESVVFKFKLWTAEEELKALGKNFGGSSTLMRYNMGTKLGEGTFGVVTKAVENDTKRAVALKKITQHNFRDGAHITTLREIKILKSLQHPNVVPLLNMVISRHDNHSENTFIKNEVFMVFPYMDHDLCGLLSNNDFKVNHSGAKCIMKQLLDGMAYIHSNNIIHRDIKTANILVDKHGQIMIADFGLARPWTDNKKMPPHLATEYTNMVVTRWYRAPELLLGWCNYGPAVDIWSIGCVLGEMYLRRPILPGGGDREQLSMIFAKCGPLNEETWSGWQDLPGFPEAHGFAWDKTPRDTSILEESKSWHMDRGGADLLVKLLSLDPSKRPTASEALDHPWFWVSPKPAETINLDFAASHEMSAWHKQPAAAPVQPPPQKAYQTQQAYQSQQTHHAQQIYQPQQPYVAYQSGYGNQQRGHGGYQQQTANATRHNLAMNPYASSQVGNAQGYNQQPYMQAQGVSNMPPGADAYGGINPYGAPVAYNTASLPPPNMAYNGQSSFNGGGGLTGGGGQQYSLPHQSYLPPGPPPMMHGNVNRPSRPPPPTSSEGRPLAAAPFPLAGGGGGGGGMKTFAPPPPFSLAGGGGGGRGGMPPTMKRPPSDSRRDFGGDHKRQRTEAPLPYD

SEQ ID NO: 41499 - protein, 145 aa, Triticum aestivum
  misc_feature (15)..(15): Xaa can be any naturally occurring amino acid
  misc_feature (89)..(89): Xaa can be any naturally occurring amino acid
  unsure (1)..(145): unsure at all Xaa locations
MASSMISSPAVTTVXNRAGAGMVAPFTGLKSMAGFPTRKTNNDITSIASNGGRVQCMQVWPPVGKKKFETLSYLPDLDDAQLAKEVEYXLRKGWIPCLEFELEHGFVYREHNRSPGYYDGRYWTMWKLPMFGCTDASQVLKELQE

SEQ ID NO: 41500 - protein, 487 aa, Glycine max
  misc_feature (249)..(249): Xaa can be any naturally occurring amino acid
  unsure (1)..(487): unsure at all Xaa locations
MVEYASRTNLSYCRDYGIEEDSIDDMPLKSDPECYDDDGHLKRTGTIWTTSSHIITAVVGSGVLSLAWAIAQMGWIAGPAVMILFSIVTLYTSSFLADCYRTGDPIFGKRNYTFMDAVSTILGGYSVTFCGIVQYLNLFGSAIGYTIAASLSMMAIQRSHCIIQSSDGENQCNISSIPYTICFGAVQIFFSQIPDFHNMWWLSIVASVMSFTYSIIGLVLGITKIAETGTFKGSLTGISIGTVTEAQKXWGVFQALGNIAFAYSYSFVLLEIQDTIKSPPSEVKTMKKAAKLSIAVTTTFYMLCGCVGYAAFGDSAPGNLLAGFGFHKLYWLVDIANAAIVIHLVGAYQVYAQPLFAFVEKETAKRWPKIDKEFQISIPGLQSYNQNIFSLVCRTVFVIITTVISTLLPFFNDILGVIGALGFWPLTVYFPVEMYILQKRIPKWSMRWISLELLSVVCLIVTIAAGLGSMVGVLLDLQKYKPFSSDY

SEQ ID NO: 41501 - protein, 431 aa, Synechococcus sp. WH 5701
MKRVLAIILGGGAGTRLYPLTKMRAKPAVPLAGKYRLIDIPISNCINSGINKIYVLTQFNSASLNRHLTQSYNLSAGFGQGFVEVLAAQQTPDSPTWFEGTADAVRKYQWLFQEWDVDQYLILSGDQLYRMDYSRFVDHHIQSGADLTVGALPVDAEQAEGFGLMRTDLDGRIREFSEKPKGAALEAMKVDTARLGLAEAEATRRPYLASMGIYVFSRDTLFDLLAQNPGSTDFGKEIIPTALGQGDNLRAYLFDDYWEDIGTIGAFYEANLALTDQPRPAFSFYDEKFPIYTRPRYLPPSKLLDAQVTQSIIGEGSLLQDCSIHHCVLGVRSRIESEVVLQDTLVMGADFFESSEERAVLRERGGIPVGVGRGTTVRRAILDKNVRIGRNVTIVNKDGIEEADRPELGFYIRNGIVVVEKNATIADGTVI

SEQ ID NO: 41502 - protein, 456 aa, Haemophilus somnus 2336
MTKHYDYIAIGGGSGGIASINRAASYGKKCAIIEAKYLGGTCVNVGCVPKKVMFYGAQVAEAIAKYAPDYGFDVTLNHFDFAKLVESRQAYIDRIHTSYNNVLAKNNVDVLNGFAKFFDAKTIEVSYANGEKELVTADHILIATGGRPSRPTIPGAEYGIDSDGFFALTELPKRIAVVGAGYIAVELAGVVNSLGAETHLFVRRQTPIRSFDPLIIETLVEVMKQDGIQLHTQAIPQEIIKNADNSLTIKLEDGRTQDVDCLIWAIGREPATDVINLASTGVETNERGFIKVDKYQNTNVEGIYAVGDIIEGGIELTPVAVAAGRRLSERLFNNKPDEHLDYHLVPTVVFSHPTIGTVGLTEPKAIEQYGAEAVKVYTSSFTPMYSAVTSHRQPCRMKLVCVGKEEKIVGLHAIGFGVDEMIQGFAVAIKMGATKADFDNTVAIHPTGSEEFVTMR

SEQ ID NO: 41503 - protein, 352 aa, Oryza sativa (japonica cultivar-group)
MGASPPEEQHSTVEEVVVVRRNQKRTKNFSGKEDEGLVSAWLNVSKDVVQGIEQSRCAYWKRIYDYFHANKDFTSDRSQNSLMHRWSTIQENVTKFEGCLSRIGDRKQSWVSSQDKIMHACALYKAEDENHRPFHMMHCWNLLRNQQKWIDRSSQLPSHKKQKITNNSSLGMSTTTTDDTAAAPPPPPGFELSKTPESINAPPRCELSERPESRNAPPRCELSERPENRKGEKEKLRRGGDVVFVEDLDDLLAKKKEADVEKELKKDERYIQSHALEQEKVALEQAKVANETKNLEMRSKELELKTKEIDLKRMLEEERIMTMDISAMSGLQQQYYKSLQEEIVTRRFNSSG

SEQ ID NO: 41504 - protein, 238 aa, Avena sativa
IENKISRQVTFAKRRNGLLKKAYELSLLCDAEDALIIFSGRGRLFEFSSSSCMYKTLERYRTCNYNSQEAAPLVENEINYREYLKLKTRVEFLQSSQRNILGEDLGPLSMKELDQIESQIDVSLKHIRSRKNQVLLDQLFDLKSKEQELQDQNKDLRKKLQEMSCGENAVHMSWQDGGGQSSSSGQAVDPYPGPLQHPEHDSSMQIGYHQTYMEQLBNEDHTASHHPNAQPGSSAGWI

SEQ ID NO: 41505 - protein, 331 aa, Desulfovibrio vulgaris subsp. vulgaris str. Hildenborough
MTDDQIHQTDWLQRGRDVLDIEAEGIRAVRDRLGPSFESALALLAGCRGRVVVTGLGKSGLVGRKLAATFSSTGSPAFFLHPVEGAHGDMGSLKADDVVIAISNSGETDELNAILPSLRAIGTPIIALTGRADSSLGRGADIVLDCGVPREACPLGLAPTASTTAVLALGDALAVCLIDWKSFTENDFLRYHPGGSLGQRLRLRVAELMHTEGIPVVNEEAVCEEAVLALDKGGFGAVALTDGGGRLTGILTDGDVRRAVLRGTYGPRVGVTHIMTRNPRFARQTQSVAELIDIMEQKAITVLPITDDDHRLVGLVHLHDLLGKGGVTFAG

SEQ ID NO: 41506 - protein, 125 aa, Listeria monocytogenes str. 4b F2365
MAKEIIQTSSAPKALGPYSQAVKVNGLIFTSGQLGINPETGELADGTTKQAEQAFKNIAAVLAEAGSGLDKIIKATVFFKDLNEFKAVNEVYATFFSSDFPARSAFQVAKLPLDAAIEIEVIAEA

SEQ ID NO: 41507 - protein, 222 aa, Chasmanthium latifolium
IENKISRQVTFAKRRNGLLKKAYELSLLCDAEVALIIFSGRGRLFEFSSSSCMYKTLERYRSSNYNSQEVKAPLDSEINYQEYLKLRTRVEFLQTTQRNILGEDLGPLSMKELEQLENQIEISLKHIRTRKSQVLLDQLFDLKTKEQELEDISKGLRKKLHETSGENALHISWEEGGHSGASGNAVEPYQGFQQHRENESSLQIGYRQQAYMEQLNNEDMED

SEQ ID NO: 41508 - protein, 1077 aa, Desulfovibrio vulgaris subsp. vulgaris str. Hildenborough
MPKRTDLKRIMVIGSGPIIIGQACEFDYSGTQAVKALKEEGYEVVLVNSNPATIMTDPGLADRTYIEPIEPETVAAIIRKERPDALLPTLGGQTGLNTALALAASGVLDECGVELIGANRAVIEKAESRELFRLAMANIGLKVPASGIARSMDDVRRLGTEMPFPLIIRPAFTMGGTGGGIAYNMEDLEEIASRGLTASITSEVMIEQSVLGWKEYEMEVMRDKADNCVIICSIENFDPMGVHTGDSITVAPAQTLTDVEYQMMRDASIAIMREIGVETGGSNVQFGINPDNGDMVVIEMNPRVSRSSALASKATGFPIAKIAAKLAVGYTLDEIPNDITRETMASFEPTIDYVVTKIPRFTFEKFPGARDELTTAMKSVGEAMSIGRTFKESLQKGLRSLEVGAPGLGSRFRDKLPEHEEIVAKLRTPNSRRIFYVRLAMLSGMTIDDIHEITNIDPWFLRQMRELVDMEGDLRDFALANSMTPDNGELVTLLRRAKEYGFSDRQLAEMWKRPESDVRALRDATGIRPTYYLVDTCASEFEAYTPYYYSTYETGHEIEAESRRKVIILGGGPNRIGQGIEFDYCCCHASFALKEMGVQAIMVNSNPETVSTDYDTSDRLYFEPLTFEDVMHIIEAEKPDGVIVQFGGQTPLNLAVPLQRAGVPILGTSPDAIDRAEDRERFQALIHKLDLRQPANATVMNLRQAIAGANSIGYPVVVRPSYVLGGRAMEIVYDEEQLTSYFQNSVGEAPEHPILLDKFLENATEVDVDALSDGTDVYVAGIMEHIEEAGIHSGDSACSIPPYSLPSSITDEISRQTVALAKELRVVGLMNIQFAVKDGVIFILEVNPRASRTAPFVSKATAVPLPRLATQVMLGKTLKELDPWSMRRSGYVSVKESVFPFNRFPGVDILLGPEMRSTGEVMGIAPTFEEAYLKGQLAGGQRLPQQGKVFISVNDRDKTLVPDVARIFADLGFEIVATAGTAKLLKEHGVPTTHVNKVYEGRPNIVDMIKNGDIALVVNTASGKRTVQDSKSIRQATLMYGVPYSTTVSGARAIAKSIAASRTCGVNVKSLQEYYGL

SEQ ID NO: 41509 - protein, 225 aa, Danthonia spicata
IENKISRQVTFAKRRNGLLKKAYELSLLCDAEVALIIFSGRGRLFEFSSSSCMYKTLERYRTCNFNSQEAKAPLDSEINYQEYLKLKTRVEFLQTTQRNILGEDLGPLSSKELEQLENQIEISLKHIRTRKNQALLDQLFDLKSKEQELQDLNKDLRKKLQETSGENAVHISWEEGGHSGASGNAMEPSQGFLQHPENDSDLHMGYHQQAYMDHLNNEDMAAPHH

SEQ ID NO: 41510 - protein, 225 aa, Ehrharta erecta
IENKISRQVTFAKRRNGLLKKAYELSLLCDAEVALIIFSGRGRLFEFSSSSCMYKTLERYRSCNYNSQEAAPENEINYQEYLKLKTRVEFLRTTQRNILGEDLGPLSMKELEQLENQIVVSLKQIRDKKNQALLDQLFELKSKEQELRDLNKDLRKKLQETTGDNVLHMSWQDGGGQHSGSSGLTAEHHQGLLHHQDQGNHSLQIGYHQAYMDHLNNEAEMAGHN

SEQ ID NO: 41511 - protein, 482 aa, Methanocaldococcus jannaschii DSM 2661
MESIKKVMVFGSGPIVIGQAAEFDFSGSQACKALKEEGIYTILVNSNPATIQTDTDMADKVYLEPLHPTIVEKIIEKERPDAILPTMGGQTGLNLALELHRRGILDKYGIKLLGSNIRTIEIAEDRELFAEAMAEINEPVTKCKAVNSVDEAVEFAEEIGYPVIVRPAFTLGGTGGGIAHNKEELIDITSKGLKYSIINQVLIDESVLGWKEFELEVMRDRKDTCIIVCGMENIDPMGIHTGESIVVSPIQTLPDEFYQKLRNAAIKIIRHLGIEGGCNIQFAVNKEMTEYRVIEVNPRVSRSSALASKATGYPIARIAAKIAIGKTLDEILNDVTKETPASFEPTLDYVVVKIPRWPFDKFKTVDKKLGTSMKSTGEVMAIGRSFEEALQKAIRSLDIGRFGIIGDGKDKDYTDEEIEEILKNPTDERIFVIAKALEKGWSVEKIVELTDIDEFFIKKIKNIVDMKKELEKLKEEIKKLNA

SEQ ID NO: 41512 - protein, 460 aa, Triticum aestivum
RWSRRRGRRRPAGCLATFLDLSHRSFTDVSCLGSFKNLERLDLGHNCLVTLEGLSACTNLKWLSVIENKLVSLKGAEVLSKLQVLNAGKNKLTRIDEVKSMTSLGALILNDNNITSICKLDPHHQLNTLVLSKNPVITFGDALVNAKSIKKISMSHCEIESIGSSLAACVELKELRLAHNKITTIPSDLAKNTKILNLDLGNNLIERESDLKVLSELRYLRNLNLQGNPIAEKGTLAKKVMKIVPNLRIFNAKPIEAISQNENSGKGSKLKKDEEMPDRDPIDSNTKKKEKRKRSKQQVQSPEEPAAKDTPPAATIAAPVKSALSDSKKKKKEKVVTEQDKSSRPKSKDDKASFDDTEGKAKKESKKKKSANKGDKDAGGIDDTEVSFAELMFSGDGGVPEPMPKDKTQATAVDGKFVGGLVIDHTKKRKKAKGTPIDASDLKQLCSAPEVGAGGLSGWD

SEQ ID NO: 41513 - protein, 439 aa, Flavobacteria bacterium BBFL7
MAKFELKLPKMGESVAEATITSWLKNVGDTIEADEAILEIATDKVDSEVPSEVDGTLVEVLFQVDDVVQVGQTIAIIEIDGDGASTPAPATTETAAPAASTVETANAQVEKGIETAAPVDYSGSDSFYSPLVKNIAKEENISLQELESINGTGSNGRVTKNDILSYVADKKAGKTTTAAAPQTKTTAPASAPVQKPAAPVSVNGGDEIIEMTRMGKLISHHMIASVQTSAHVQSFIECDVTNIWNWRKKHKDVFAKREGENLTFTPIFMEAVAKALKEFPMMNIAVDGDNIIKRKNINLGMAAALPDGNLIVPVIKNADQLNLMGMAKAVNDLARRSRDGKLKPDDTQGGTYTVTNVGTFGSVLGTPIINQPQVGILALGAIRKVPAVVETPQGDFIGIRMKMFLSHSYDHRVVNGALGGQFVQRVAQLLEGFDDKREI

SEQ ID NO: 41514 - protein, 229 aa, Eleusine coracana
LENKISRQVTFAKRRNGLLKKAYELSLLCDAEVALIIFSAGRGRLFEFSSSSCMYKTLERYRTCNFNSHEVKAPLDSKINYQDYLKLKTRVEFLQTTQRNILGEDLGPLSNKELEQLEKQIEISLTQIRSRKNQMLLVQLLDLKSKEQELQDLNKDLRKKCQLKKTCGENATHISWEEGGHSGTSRNANEPNQGFLQHAENNYSSLQIGYYQQAYMDQLNNQDIGAAHN

SEQ ID NO: 41515 - protein, 180 aa, Glycine max
EFPHIPPIPSDSGITFNEQPLMIALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNDVPTGGLANVAATVMNLHGFEAPSDYETTLVEVVDN

SEQ ID NO: 41516 - protein, 504 aa, Oryza sativa (japonica cultivar-group)
MLRAAATAALRRLPQSQAPRRQARGLQYASPERRPLDGARWALYARLSAHLPSGGMVEELGRWLRERRPLSEEQVLFCVRRFRKFKQNKHALQLMDWMEARGVNLELKHHALRLDLVSKLNGIHAAEEYFGSLPDIFRSKQTYSTLLNCYAEHRMAEKGLELYENMKAMNIVSDILVYNNLMCLYLKTDQPEKIPTTVVKMQESGIQPNKFSYFVLTESYIMMNDIESAEKVLKELQEVNSVPWSLYATLANGYNKLQQFDKAEFTLKKAEEVLDKHDVFSWHCLLSHYANSGNLSEVKRIWESLKSAFKKCTNRSYLVMLKALKKLDDFDTLQQIFQEWESSHEHYDMKIPNIIIQAYLDKGMVDKAEAMRQTTMAQDHSNYRTFCIFAEFYLEKSKMNEALQVWKDAKKMVKGQDWVPEKLVNRYLKHFEDSKDVDGMETFCECLKNLGRLDAEAYEALIRTYISVGRTNPSIPQRMEVDRVDIRPEMFESLKAISTEGVES

SEQ ID NO: 41517 - protein, 173 aa, Candidatus Desulfococcus oleovorans Hxd3
MDLKATIRTLPNWPIEGVMFRDITTLLQDPAAFKEAINRFYDRYRTMKIDKIVGIDARGLIFGAPLAYKLEVGFVPVRKKGKIPFRTIGAAYSLEYGESMVEIHEDAILKGERVVVVDDLIATGGTVKATIDLVEKLGGEVVECAFVIDLPDLKGREKIRDYKMFALMEFEGE

SEQ ID NO: 41518 - protein, 164 aa, Camellia sinensis
MLRLPENLLVVCHGSLGKAVPKTAENFRALCTGEKGVGKSGKPLHYKGSKFHRIIPSSMLQGGDFTLGDGRGGESIYGEKFADENFKLKHTGPGFLSMANAGPDTNGSQFFITTVTTSWLDGRHVVFGKVLSGMDVVYKIEAEGNQSGTPKSNVQIADSGELPL

SEQ ID NO: 41519 - protein, 514 aa, Catharanthus roseus
ARVNFSLTSPIFLLLSSLFLIILLNKLMRGNKIQKGKKLPPGPKKIAIIGNLPSNGRFTSLIVFLNNLAEKYGPIMHLRIGQLSAVIISSAEKAKEILNTHGVRVADRPQTTVAKIMLYNSLGVTFAPYGDYLKQLRQIYAMELLSPKTVKSFWTIMDDELSTMITSIKSEVGQPMILHDKMMTYLYAMLCRATVGSVCNGRETLIMAAKETSALSASIRIEDLFPSVKILPVISGLKSKLTNLLKELDIVLEDIISAREKKLLSQPQQPLMLDEEDMLGVLLKYKNGKGNDTKFRVTNNDIKAIVFELILAGTLSSAAIVEWCMSELMKNPELLKKAQDEVRQVLKGKKTISGSDVGKLEYVKMVVKESVRLHPPAPLLFPRECREEFEIDGMTIPKKSWVIINYWAIGRDPKIWPNADKFEPERFSNNNIDFYGSNFELIPFGAGRRVCPGILFGTTNVELLLAAFLFHFDWELPGGMKPEELDMNELFGAGCIRENPLCLIPSISTVVEGN

SEQ ID NO: 41520 - protein, 271 aa, Azoarcus sp. EbN1
MARFDGFECMERKLVVGNWKMNGDLVSNQALFEQLVDRSPSSIDTALCVPFPYLAQGQRALSGSAIMLGAQNLSEFDAGAYTGEVSGRMLSDFDCRFVIVGHSERRTVFREDDQLVARKARAALAAGLVPIVCVGESLAERDAGQAEDVLLRQLEALVQLLDGASLARLVIAYEPVWAIGTGRAASPEQVQEILSFVRRWLSGHVGNSRAIRILYGGSVKADSAAALFSLPDSDGGLIGGASLVAQQFLEICEAAAKAAQDGNMGDFKGSR

SEQ ID NO: 41521 - protein, 417 aa, Azoarcus sp. EbN1
MAEIRNYTINFGPQHPSAHGVLRLVLELDGEVVVRADPHIGLLHRGTEKLAETRTWVQSVPYMDRLDYVSMMCNEHAYCLAIERLLGLEVPIRAQYIRVMFDEITRILNHLLGIGTHALDIGAMTMVLYTFREREDLMDAYEAVSGARMHAAYYRPGGVYRDLPDRMPQYVVNKFKNANTVRELNENRQGSLLDFLEDFTERFNGYCDDYETLLTDNRIWKQRTVGIGVVTPEQAKAWGFTGPMLRGSGVAWDLRKKQPYEVYDRMDFDIPVGKNGDCYDRYLCRMEEMRQSNRIVKQCIDWLRKNPGPVIADNYKVAPPPRERMKGNMEELIHHFKLFTEGMHVPSGEVYAAIEHPKGEFGVYAVSDGANKPYRLKLRAPGFAHLAAMDEIARGHMIADVVAIIGTMDVVFGEIDR

SEQ ID NO: 41522 - protein, 129 aa, Triticum aestivum
MAAASLRKGNARLPPEVNRALFVRNLPFNISSEEMYDIFGKYGAIRQIRLGNAKDTRGTAYVVYEDIYDAKNAVDHLSGFNVANRYLIVLYSQLNRMSKKTDIKKKEDEITRLQEKYGVGSKTPSANDA

SEQ ID NO: 41523 - protein, 489 aa, Halomonas elongata
MTAQSAQPLYIGGRPVDATSGETFTVTNPYDGSLLATIGQASQADVDSAVQAAQRGQREWAAMTGMERSRILLRAVALLRERNDELAELETRNTGKPISETASVDIVTGADALEYYAGLAPAIEGSQIPLRDTRLVYTRREPLGVIGAIGAWNYPIQIACWKAAPALAAGNAIVFKPSEVTPLTALKLAEIFTEAGLPDGVFNVVQGDGRVGAMLTEHEGIAKVSFTGEVGTGKKVMAAAGGSTLKDVTMELGGKSPLIVFADADLDRAADAAMMANFYSSGQICTNGTRVFVERSAKEAFEAKLVERVARIKAGDPMDPSVNFGPLVSFEHQEKVLSYIALGKEQGARVLAGGDAWNSGEWAKGAWAAPTVFTDCTDEMRVVKEEIFGPVMSVLAFDDEEEVIRRANNTKYGLAAGVFSESLNRAHRVIHQLEAGICWINTWGESPSEMPVGGYKESGIGRENGVETLNHYTQTKSVQIEMGPFESVF

SEQ ID NO: 41524 - protein, 250 aa, Nicotiana tabacum
MVRIAFGSIGDSFSVGSLKAYVAEFIATLLFVFAGVGSAIAYNKLTADAALDPAGLVAVAVAHAFALFVGVSIAANISGGHLNPAVTLGLAVGGNITILTGFFYWIAQLLGSTVACLLLKYVTNGLAVPTHGVAAGLNGLQGVVMEIIITFALVYTVYATAADPKKGSLGTIAPIAIGFIVGANILAAGPFSGGSMNPARSFGPAVVAGDFSQNWIYWAGPLIGGGLAGFIYGDVFIGCHTPLPTSEDYA

SEQ ID NO: 41525 - protein, 199 aa, Kineococcus radiotolerans SRS30216
MSRTARIERSTSESSVLVELDLDGTGRTSIDTTVPFYDHMLTALGKHSLMDLTVVAKGDTHIDVHHTVEDTAIVLGQAFRQALGDKAGIRRFADATVPLDEALAHVVVDVSGRPYCVHTGEPEGQEYHLIGGHFTGSLTRHLLESFAFHARIALHVRVLAGRDPHHVVEAQFKALARALRYAVEPDPRVQGIPSTKGAL

SEQ ID NO: 41526 - protein, 678 aa, Oryza sativa (japonica cultivar-group)
VRAAAVETLEGQAATGALLEKSVNTIRFLAIDAVEKANSGHPGLPMGCAPMGHILYDEVMRYNPKNPYWFNRDRFILSAGHGCMLQYALLHLAGYDAVLEEDLKQFRQWGSKTPGHPENFETPGVEVTTGPLGQGIANAVGLALAEKHLAARFNKPDSEIVDHYTYCILGDGCQMEGISNEACSLAGHWGLGKLIAFYDDNHISIDGDTEIAFTEDVSARFEALGWHTIWVKNGNDGYDEIRAAIKEAKAVTDKPTLIKVTTTIGFGSPNKANSYSVHGSALGTKEVEATRENLGWPYEPFFVPEDVKSHWSRHVPQGAAFEADWNAKFAEYEKKYPEDAATLKSIVSGELPAGWADALPKYTPESPADATRNLSQQCLNALAKVVPGLLGGSADLASSNMTLLKMFGDFQKDTPEERNVRFGVREHGMGAICNGIALHSPGLIPYCATFFVFTDYMRAAMRISALCEAGVIYVMTHDSIGLGEDGPTHQPIEHLVSFRAMPNILMLRPADGNETAGAYKIAVLNRKRPSVLALSRQKLAQLPGTSIEGVEKGGYIVSDNSTGNKPDFIVMSTGSELEIVAKAADELRKEGKTVRVVSFVCWELFDEQSAEYKESVLPEAVTARVSLEAGSTLGWQKYVGSKGKAIGIDKFGASAPAGKIYQEYGITAENVIATAKSL

SEQ ID NO: 41527 - protein, 116 aa, Zea mays
LDLTDADGQGVLTMDKCQLQELRVRPVSTSRGSHRTLMPELCMWLWYAPCIELPGGLVLNGATLVAIKPSEEGTGDTVWNETADAAWVLDAFEEPYRTAAKMLLKRRTYSLEMNSF

SEQ ID NO: 41528 - protein, 618 aa, Methanocaldococcus jannaschii DSM 2661
MDMEKLKEILLKAKKLGFSDKQIANLLGMDEIEVRDLRKKLNIIPLYKMVDTCAAEFEAKTPYYYSAYETFVYKEQDESNPSDRKKVIIIGSGPIRIGQGIEFDYSSVHAVLALKEMGIEAIIINNNPETVSTDYDTSDKLYFEPITFEEVLNIAEREKEKGELLGVIVQFGGQTAINLAMKLKNAGVNILGTTPENINAAEDREEFSKLLKKLNIPQAEGGTAYTKEEALEIAKRIGYPVLVRPSYVLGGRAMQIVYSEDELIEYMEEAVKVSEEHPVLIDKFLEDAIELDVDAVCDGESVLIGAIMEHIEEAGVHSGDSATVIPPQTLPKEIIDTVIDYTAKLARALNIVGLLNVQYAVKDGVVYVLEANPRASRTVPYVSKSVGIPLAKLATKIMLGKKLEELIKDYDVEKVAEKVWIAKPKYVSIKEAVFPFQKLPGVDPVLGPEMKSTGEAIGIDKDFGRAYYKAQLSANMELPIVGNVFISVRDRDKKHIVDVAKKLHELGFTIYATEGTAKVLRENGIPAILVKKISESPNDNILKLMRDGKMHLIINTSSGKKAKSDGYYIRRAAVDLGIPYITTIPGAKAAVKAIEAVKTGELSVYSLDELDARIKNRF

SEQ ID NO: 41529 - protein, 235 aa, Leersia virginica
LENKISRQVTFAKRRNGLLKKAYELSLLCDAEVALIIFSGRSRLFEFSSSSCMYKTLERYRSCNYNSQDAAAPENEINYQEYLKLKTRVEFLQTTQRNILGEDLGPLSMKELEQLENQIEVSLKQIRTRKSQALLDQLFDLKSKEQQLQDLNKDLRKKLQETSAENVLYMSWQDGGGHSGSATVLAADQPHHHQGLLHPHPEGDHSLQIGYHHTHHHHQAYMDHLNNEADMVAHH

SEQ ID NO: 41530 - protein, 787 aa, Oryza sativa
MDTLNHIGAGDKLYGDNGTLAVVLHHGGASCKKNSSIPQTGTLSHIGAGSGVSSDESMLYDAVIAKPGAGSGDELYGDNSALAVVLHHGGASCKKNSSIPQTATLSHIGAGSGVSSDESMLYDAVIAKPGAGLDDELYHDNGTLAVVLHHIGAGHEKNKAYDVIDHTATINHIGADGKDSMVNDHVGAGGDQNKVFDNIGALGMPAAQQAPPSTGKVNHYQSSDHLGNNYHHDESSVRQLLHTRGRLCTRPGRILVPGGRGAHLYAAPSYTLAAADQIHNLQLFGVNNFAATGIIDYFGAGADDLGTASSVFDAADDITLAHYLAMATVQSVWQENCMEQFKLVLEALHQPHRNLYIAVDMEFTADAATNMSHRPVTSTSCYQHVRRYVNGGDIVQMGLTFAFVGDVEGEQAPSPPIALEINFDFNVNSPKYHGESIHFLSSQGHDLTQHSKRGVTPEFVYEGLLRHLPFGDGSVTWVAYHGDYDLAFLLRLLQGGDHGSDALLTLSCFFKIVSLSGHQMHRMDARRGLLAGLEEWNMAIKCARHIDDHTGSIYVVKMLPHKLDEEARRIEELFAKFMASCGALGDPNISWVTFHGAHGIARMIRSFDIVTIPWIECKGGLFDVAQALNLKEIEADMEAARVAPRLHHRPWGLVAARRDCEHERPRGHAHILAAKMWRRRWIGKMTAGGSIDQKLETFLREVEAADDEMEALCDELSCLLVSAYRLRVWLAPMDRHAPALVSAATTAGMRSRLLGSARCLRARLAPMDRCAPAPASAATTAGHDVPD

SEQ ID NO: 41531 - protein, 225 aa, Lithachne humilis
IENKISRQVTFAKRRNGLLKKAYELSLLCDAEVALVIFSGRGRLFEFSSSSCVHKTLERYRSCNYNTQEANAPVENEINYHEYLKLKTRVDFLQTNQRNILGEDLGPLSMKELEQLDNQIETSLKQIRSRKNQVLLDQLFDLKSKEQELQDINKDLRKKLQETNGDQKVVHINSWQDGGQGSSSGHAIEPYQGLIQHPENDPSMQIAYHQVYMDQLNHEDMAAQH

SEQ ID NO: 41532 - protein, 222 aa, Panicum miliaceum
IENKISRQGTFAKRRNGLLKKAYELSLLCDAEVALIIFSGRGRLFEFSSSSCMYKTLERYRSSNYSSQEVKTPLDGEINYQDYLKLKTRVEFLQTTQRNILGEDLGPLSMKELEQLENQVEISLKHIRTRKNQMLLDHLFDLKSKEQELQDLNKDLRKKLQETNAENVLHVSWEEGGHSGASGNAIEPYQGFLQHPENDPSLQIGYHQQAYMDQLNNEDMAD

SEQ ID NO: 41533 - protein, 506 aa, Ashbya gossypii ATCC 10895
MTISMIWCGTWARPSKRVSVVTVATVRCCYQYKRTLSQSYESEEARLEALSRCHKTCAEITLHALEKNGGIFIKLGQHIGAMTYLLPQEWTSTMIPLQDKCPQSTLEEIDGMFRHDLRQGLDELFETFDPHPIGVASLAQVHIATLKGSHEKVAVKCQHPHLKEFVPLDVMLTQNVFNVLDVVFPEYPMTWLSDELQSSIYVELDFTKEAENAINTANYFYKYRKETALRIPRVVSAAKRILVLEFVEGERLDNLRYLDTNGISRSEVSSCLSHIFNNMIFTPNVGVHCDPHGGNLAIRVLPKPKAGHNFEIVLYDHGLYRMPTTEMRRDYAKFWLALLDKDTEKMKLYAKKFANVKEEQFPIFAAAITGRSIDTALNYDISTVRSQDEIDRMKNALLSGGLLVDIMALLSTIPRIVLLILKTNDLTRHLDECLENPLGPERTFLILTQYCARTIYQETCERIDHMYRRWTFRWIFCEIKAWLEYERRKSQLIIFDVALWCKKYFV

SEQ ID NO: 41534 - protein, 222 aa, Pennisetum glaucum
IENKISRQVTFAKRRNGLLKKAYELSLLCDAEVALIIFSGRGRLFEFSSSSCMYKTLERYRSSNYGSQEVKTPSDGEINYQDYLELKTRVEFLQTTQRNILGEDLGPLSMKELEQVENQIEISLKHIKDKKNQMLLNQLFDLKSKEQELQDLNKDLRKKLQETNAESVLHLSWEEGGHSGTGGNAIEPYQGFLQHPENDPSLQIGYHQQAYIDQLNNEDMAD

SEQ ID NO: 41535 - protein, 222 aa, Setaria italica
IENKISRQVTFAERRNGLLKKAYELSLLCDAEVALIIFSGRGRLFEFSSSSCMYKTLERYRSSNYGSQEIKTPLDGEINYQDYLKLKTRVEFLQTTQRNILGEDLGPLSMKELEQLENQIEIFLKHIRTRKNQMLLDQLFDLKSKEQELQDLNKDLRKKLQETNAESVLHVSWEEGGHSGTSGNAIEPYQGFLQHPDNDPSLQIGYHQQAYMDQLNNEDMGD

SEQ ID NO: 41536 - protein, 118 aa, Arabidopsis thaliana
  misc_feature (33)..(33): Xaa can be any naturally occurring amino acid
  unsure (1)..(118): unsure at all Xaa locations
MASSMLASAGVVTSPVSSHTWSSPFTGLKSSAXFAVTRKGNNDITSITRKGGRVSCMKVWPPIGKKKFENISYLPDLMEVELDKEVDYVLRNKGMPGVELELEHGLVYREQGSTPGYY

SEQ ID NO: 41537 - protein, 161 aa, Azoarcus sp. EbN1
MGAKDYIGSLFLTELIKGLALTGRHLFARKITVQFPEEKTPASPRFRGLHALRRYPNGEERCIACKLCEAVCPALAITIESEQRDDGSRRTKRYDIDLTKCIFCGFCEEACPVDAVVETRVMEYHGEKRGDLYYTKQMLLAVGDRYEAQIAADREADAKYR

SEQ ID NO: 41538 - protein, 457 aa, Lactobacillus brevis
MRKVSTGFVYFFGALGGLLFGYDTGVISGAILFIQKQMNLGSWQQGWVVSAVLLGAILGAAIIGPSSDRFGRRKLLLLSAIIFFVGALGSAFSPEFWTLIISRIILGMAVGAASALIPTYLAELAPSDKRGTVSSLFQLMVMTGILLAYITNYSFSGFYTGWRWMLGFAAIPAALLFLGGLILPESPRFLVKSGHLDEARHVLDTMNKHDQVAVNKEINDIQESAKIVSGGWSELFGKMVRPSLIIGIGLAIFQQVMGCNTVLYYAPTIFTDVGFGVSAALLAHIGIGIFNVIVTAIAVAIMDKIDRKKIVNIGAVGMGISLFVMSIGMKFSGGSQTAAIISVIALTVYIAFFSATWGPVMWVMIGEVFPLNIRGLGNSFASVINWTANMIVSLTFPSLLDFFGTGSLFIGYGILCFASIWFVQKKVFETRNRSLEDIEATLRAKTGEDAAELSTTK

SEQ ID NO: 41539 - protein, 231 aa, Bartonella quintana str. Toulouse
MPQINLIIFDCDGVLVDSEYLAAKIGSQLLKQTGYEISPEELSERYTGLIFRDILKRIEQETEKPISAHLIDQMSNLFRAQIKTELRAIDGIREAVEKVKSRYPCCICSNAKSVDIKEMLITVGLYDLFEDKIFSAPEVGTKKAKPAPDVFLFAAHLLHAKPSNTIVIEDSIHGVHAATAAGMRVIGFTGGSHSYLSHSNALVDAGAETSIAKHAHLLEVLEAMAIWQNSS

SEQ ID NO: 41540 - protein, 151 aa, Synechocystis sp. PCC 6803
MQDFGAVFHNQVLLISLAACFLAQGIKAIVEIFRNGKINLRSLVSTGGMPSAHSALVGALATGVGLQKGWGSNEFAIACLFAVIVMYDAAGVRQAAGKQARILNQLIDELFQEDQSLTEERLKELLGHTPVQVFAGLALGIAIAFFAVPAQ

SEQ ID NO: 41541 - protein, 390 aa, Thermotoga maritima
MEKMTIRDVDLKGKRVIMRVDFNVPVKDGVVQDDTRIRAALPTIKYALEQGAKVILLSHLGRPKGEPSPEFSLAPVAKRLSELLGKEVKFVPAVVGDEVKKAVEELKEGEVLLLENTRFHPGETKNDPELAKFWASLADIHVNDAFGTAHRAHASNVGIAQFIPSVAGFLMEKEIKFLSKVTYNPEKPYVVVLGGAKVSDKIGVITNLMEKANRILIGGAMMFTFLKALGKEVGSSRVEEDKIDLAKELLEKAKEKGVEIVLPVDAVIAQKIEPGVEKKVVRIDDGIPEGWMGLDIGPETIELFKQKLSDAKTVVWNGPMGVFEIDDFAEGTKQVALAIAALTEKGAITVVGGGDSAAAVNKFGLEDKFSHVSTGGGASLEFLEGKELPW

SEQ ID NO: 41542 - protein, 308 aa, Medicago sativa
MAKNVEGFEFEQRHGKERVRVARVWKSKDGKQHFVVEWRVSINLLSDCVNSYVRDDNSDIVATDTMKNTVYAKAKECSEILSVEDFAILLAKHFTSFYSQVTTAIVKIVEKPWERVNVDGQPHDHGFKLGSEKHTTEAIVKKSGALQLTSGIEGLSVLKTTKSGFEGFIRDKYTILPDTRERMLATEVTALWRYSYESLYSVPKKPLYFTEKYLDVKKVLLDTFFGSPKEGVYSPSVQATLYQMAKAALNRFPDIASIQLKMPNIHFIPVNLSNKNGQFVKFDDDVYLPTDEPHGSIEASLSRSRSKM

SEQ ID NO: 41543 - protein, 418 aa, Methanocaldococcus jannaschii DSM 2661
MESYIQNLFAERIGGKKFGKEDVIYKFEKIKRAKQEAMKRHPDMELIDMGVGEPDEMADPEVIRVLCEEAKKWENRGYADNGIQELKDAVPPYMEKVYGVKDIDPVNEVIHSIGSKPALAYITSAFINPGDVCLMTVPGYPVTATHTKWYGGEVYNLPLLEENDFLPDLESIPEDIKKRAKILYLNYPNNPTGAQATKKFYKEVVDFAFENEVIVVQDAAYGALVYDGKPLSFLSVKDAKEVGVEIHSFSKAFNMTGWRLAFLVGNELIIKAFATVKDNFDSGQFIPIQKAGIYCLQHPEITERVRQKYERRLRKMVKILNEVGFKARMPGGTFYLYVKSPTKANGIEFKTAEDFSQYLIKEKLISTVPWDDAGHYLRLAACFVAKDENGNPTTEEKYEDMVLEEFKRRLEGMDLEFE

SEQ ID NO: 41544 - protein, 672 aa, Oryza sativa (japonica cultivar-group)
QLIFLLLLAVLAAASSRNDEEARALMALKESLDPAGRVLGSWARSGEPCGGSFVGVTCDSGGRVTAISLQGRGLSGTLPPAIAGLRRLTGLYLHYNGIKGAIPREIGSLSELTDLYLDVNHLTGPLPVEIAAMENLQVLQLGYNQLTGSIPPQLGKLNKLAVLALQSNQLTGAIPATLGDLTQLARLDLSFNSLFGSIPSKIAEVPLLEVFDVRNNSLSGSVPAGLRRLNGGFQYVNNKGLCGVGFSLLDLCLSSEDGLKPSKPEPFGPDGTVKTRQVPQSANTDNHCEGSGCSKSSNASVGVLVVGVVAVVIGAAFCGIFAFSYYRRQKQKIGSSLEVSDSRLSTDHYQQKEVCRRSASPLISVEYSNGWDPLSGGGVGSSGEVGDSFRFNLEEVECATQYFSEVNLLGKSGFAATYKGILRDGSVVAVKSLNKTSCKQEESDFLRGLKMLTVLRHENLVGLRGFCCSRGRGECFLVYDYMVNGCLSQYLDVKEGSGANVLDWPTRVSIIRGIAKGVEYMHSKKANKPSVVHQNISAEKILLDHHLTPRLSVPGLHKLLADDVVFSTLKASAAMGYLAPEYATTGRFTEKSDVFAFGIVVLQVITGRRAVSQLKVSTVANDLDSLIDENLNGVFSRTEAAKLAAIAALCTSETASQRPTMEAVVQQLSNCH

SEQ ID NO: 41545 - protein, 308 aa, Medicago sativa
MAKNVEGFEFEQRHGKERVRVARVWKSKDGKQHFVVEWRVSINLLSDCVNSYIRDDNSDIVATDTMKNTVYAKAKECSEILSVEDFAILLAKHFTSFYSQVTTAIVKIVEKPWERVNVDGQPHDHGFKLGSERHTTEAIVKKSGALQLTSGIEGLSVLKTTKSGFEGFVRDKYTILPDTRERMLATEVTALWRYSYESLYSVPKKPLYFTEKYLDVQRVLLDTFFGSPKEGVYSPSVQATLYQMAKAALNRFPDIASIQLKMPNIHFIPVNLSNKNGQFVKFDDDVYLPTDEPHGSIEASLSRSRSKM

SEQ ID NO: 41546 - protein, 888 aa, Bartonella quintana str. Toulouse
MTKWVYSFGDGSAEGSARARNLLGGKGANLAEMSNIGLPVPPGFTLTTEVCNFYYAHGKLYPKELQEAVEQALKHIGEQTGCEFGNEKRPLLLSVRSGARASMPGMMDTVLNLGMNDETVKAIASQANNERFAYDSYRRFIQMYSNVVLGLDHSYFEEILDDLKVRNNYVVDTEITAADWKDVIVSYKAYIEEKLGKPFPQDPKQQLWGAIGAVFSSWMTARAITYRRLHNIPESWGTAVNVQAMVFGNMGEDSATGVAFTRNPSTGEKELYGEFLFNAQGEDVVAGIRTPQNITENARIVAGSNKPSLEKIMPEAFGELCQIVQKLEQHYRDMQDLEFTIEKGKLWILQTRSGKRTARAALKMAIEMVEEGLISREEAVMRIDAKSLDQLLHPTLDPKAARFVIARGLPASPGAATGEIVFTSEEAETASVEGRKVILVRIETSPEDIHGMHAAEGILTTRGGMTSHAAVVARGMGKPCISGAGSVRIDYNTNTMFVLGQSFKKGDVITIDGGSGEIFKGKVAMLQPELCGDFAKLMEWADEMRHIKVRANAETPSDARMARSFGAEGIGLCRTEHMFFSGERIIAVREMILSDDESGRRKALDKLLPMQRSDFAQLFEIMCGLPVTIRLLDPPLHEFLPKTDAEILDVAAIIGVSPQVLAERAQQLHEFNPMLGLRGCRLAITYPEILEMQARAIFEAAAEAAQKSGSPVMLEIMVPLVALKSELDFVKAHIDQVACEVMKEKGSTIQYMVGTMIELPRAALRADEIAKTAEFFSFGTNDLTQTTFGISRDDAAPFLETYFQKGLLEQDPFVSIDRDGVGELISVAVQRGRSQRAKIKLGICGEHGGDPASIALCEENDLDYVSCSPFRVPIARLAAAQSAIAKKT

SEQ ID NO: 41547 - protein, 934 aa, Arabidopsis thaliana
MVRISLLLLCLLVSTCLFTSSSAQAPGFVSLDCGGAEPFTDELGLKWSPDNHLIYGETANISSVNETRTQYTTLRHFPADSRKYCYTLNVTSRNRYLIRATFLYGNFDNSNNVYPKFDISLGATHWATIVISETYIIETAELVFLASSPTVSVCLSNATTGQPFISTLELRQLSGSMYGSMLSEDRFYLSVAARINFGAESEASVRYPDDPYDRIWESDLQKKPNYLVDVAAGTVRVSTTLPIESRVDDRPPQKVMQTAVVGTNGSLTYRMNLDGFPGFGWAFTYFAEIEDLAEDESRKFRLVLPEQPEYSKSVVNIKENTQRPYRVYAPGYPNITLPFVLNFRFAKTADSSRGPILNAMEISKYLRKSDGSVDATVMANVASLYSSTEWAQEGGDPCSPSPWSWVQCNSDPQPRVVAIKLSSMNLTGNIPSDLVKLTGLVELWLDGNSFTGPIPDFSRCPNLEIIHLENNRLTGKIPSSLTKLPNLKELYLQNNVLTGTIPSDLAKDVISNFSGNLNLEKSGDKGKKLGVIIGASVGAFVLLIATIISCIVMCKSKKNNKLGKTSAELTNRPLPIQRVSSTLSEAHGDAAHCFTLYEIEEATKKFEKRIGSGGFGIVYYGKTREGKEIAVKVLANNSYQGKREFANEVTLLSRIHHRNLVQFLGYCQEEGKNMLVYEFMHNGTLKEHLYGVVPRDRRISWIKRLEIAEDAARGIEYLHTGCVPAIIHRDLKTSNILLDKHMRAKVSDFGLSKFAVDGTSHVSSIVRGTVGYLDPEYYISQQLTEKSDVYSFGVILLELMSGQEAISNESFGVNCRNIVQWAKMHIDNGDIRGIIDPALAEDDYSLQSMWKIAEKALLCVKPHGNMRPSMSEVQKDIQDAIRIEKEALAARGGISDEFSRSSAHSSSLNMGMLDLAGSQSYVSIDESVLQPTAR

SEQ ID NO: 41548 - protein, 703 aa, Kineococcus radiotolerans SRS30216
MAAEVARRTRRAQVRRQRHGGRGPQAGLRRGRRVPAHRGPAARRRARRGPADLDHARPPADPQRVPRGAAGHDPRGHGRRPDGPHRPGRARARGPAQRPRPAGGRALRGGRRAAAGHPPPRGRRRGTGGRGTGGRRRRRRPPRRRRPARRRAHPRHLDDRPRGRRRRQPPARSGPQRQRGHRGLGHRGGPGGAEVRRHDRRGGVVPRLAEPGLAGPRDHRRRPRRAAAVAGVRDGPEDGGLPARGARRRPPRHGHRRPAGALGPAGGLHDLRQRHDGRAVSPQGVDDVDLVQASEALPATAGGDDAWLQRYTRSVMQTFGTPQRVLVRGEGCHVWDADGNRYLDLLGGIATNSLGHAHPLLVAAVTAQLTTLGHVSNFFASAPQVTLAERLLQVARAPQGSAVFFANSGAEANEAAFKMARRTGRPKVVSTLGAFHGRTMGALALTAKEAYRAPFEPLPGGVEFVPYGDVGALGRAVDGATAAVFLEPLQGENGVVPAPDGYLAAARRITAEHGALLVLDEVQTGVGRTGEWFAHQNPRHAGVVPDVMTLAKGLGGGIPVGAVVAFGPQNATLLGAGQHGTTFGGNPVASAAGLAVLHAVERDGLLANVAAVGRHLRDGITGLGHPLVEGVRGEGLLLGIALTGPVGAQVVAAALARGFIVNAPRPDTIRLAPPLVLTAAQADTFVAALPAILDAATQNGAPS

SEQ ID NO: 41549 - protein, 820 aa, Sinorhizobium meliloti 1021
MTETAREKLVIVGNGMAPGRMLEELFEKAPGRYAVTIFNAEPRVNYDRIMLSPVLSGEKEYEEIIIHGDGWYIKHGITLYKGHKIIAIDRDAKTVTSDHGVTESYDKLVIATGSVPFIIPVPGKELRGVITYRDLDDVQAMLLAAQSREKAVVIGGGLLGLEAAAGLQARGMDVTVLHVMPTLMERQLDPAAGYLLQKAVEERGIKVVTKANTKRILGEEKVEGIELDDGRIIPATLVVMAVGIRPNAGLAKEAGLAVNRGIVVDAGMQTSDGDIMALGECAEVGGMVYGLVAPLYEMARVAASHLAGDRRAAFAHSDTPTKLKVTGINLYSVGDFADADGREEIVLRDATAGIYKRLVLKDNRIIGTVLYGDTADGAWFNDLLKRGTDISEMRDTLIFGQAYQGGSPLDPTAAVAALPDDAEICGCNGVCKGKIVGAITSKGLTSLDDVRAHTKASASCGSCAGLVEQIMSLTLGDTYNPASVQPMCNCTDLGHDDVRRLIKAKKLKSIPAVMQELEWKTSCGCAKCRPALNYYLVCDWPDEYADDYQSRFINERVHANIQKDGTYSVVPRMWGGVTNSKELRAIADVVDKFNVPLVKVTGGQRIDLLGIEKEDLPAVWADLGQAGFVSGQAYAKGLRTVKTCVGSDWCRFGTQDSTGLGIRIEKFMWGSWTPAKLKMAVSGCPRNCAEATCKDVGVICVDSGFEIHFAGAAGLDIKGTEVLGLVRTEDEALEHIVALTQMYREQARYLERIYKWAKRVGLDEIRRQIMDDVEKRKAYFDRFVFSQKFAQVDPWSERVSGKDKHEFRPMATVGFNQAAE

SEQ ID NO: 41550 - protein, 393 aa, Ehrlichia canis str. Jake
MSDQVKITPMTLNFGPQHPAAHGVMRLVLEMGGEVIERIDPHIGLLHRGTEKLIEYKTYLQALPYFDRLDYVSPMAQEHAYSLCVEKLLKCEIPIRAKYLRVIFCELTRILNHLLNISSQALDIGAMTPLLWMFEEREKILGFYERASGARFHSAYIRPGGVAADVPSDLIDDIFKFVSTFSKFMDDIDDLLTENRIWKQRNVDIGVVSKKQALDWGFSGPMLRACGIPWDLRKSQPYEIYEDLEFEIPVGENGDCYDRYLVRMAEIRQSIKLLEQCLDRLPDGPVKTDDRKIAPPKRSEMKESMEALIHHFKLYSEGYSVPVGETYMAVEAPKGEFGVYIVSDGTNKPYRCRIRAPGFAHLQAIDIIAKGHMLADLTAIIGSLDIVFGEIDR

SEQ ID NO: 41551 - protein, 551 aa, Rubrobacter xylanophilus DSM 9941
MRFLREGQRLNQVEKWKLERHPLDVREAVLEVYSKEGVEAIERVPGEHERLKWVGIYPQNQGGNNFMQRIKVPGGRLTPEQARVIGRIARDFARGPEPNPHFGNNFLDITTRQDIQMHWIQIEEVPEIWRRLEEVGMTTVQACGDSARNVLCCPVSGLDREEAFDAYPAAQAITAYFVGNREYANLPRKFKMSVTGCLEDCAQAEINDIGMLPARLPDGTLGFNVRVGGGLGDGPRMASDIDVFVLPGEAVEITRGIAQVYGELGNRENRWINRLRYLVQELGPEGFREELEKRVSIPLRPAGEDLTRRYRGDHVGVHPQKESGLYYVGLNVPVGRMSGEQFEEAGRLAGEYGRDIRLATDQNLIITGVPEGRLDDLLSEPLLRRYSPDPGPFERGIVACTGSEFCRFAIVETKIRALEWAREMDRRFGDEIGQEAVRMHFSGCSASCAQPQIADVGFRGETAKKGDRIVEGVDIGLGGSLGRDAAFIDWVEGARPAEDVPEALSRVFERFRRERREGERFHEWARRVRNAELRDTLRGTSVPVVGTREGR

SEQ ID NO: 41552 - protein, 885 aa, Sinorhizobium meliloti 1021
MAQEVKTTCPYCGVGCGVIARVGDDGAVSVKGDPEHPANFGRLCSKGSALAETLDLDGRLLHPEIGGRRAGWSEALDLVAERFSRSIAEHGPDSVAFYVSGQLLTEDYYIANKLMKGFIGSANIDTNSRLCMSSSVAGHRRAFGSDTVPGAYEDLELAELVVLTGSNLAWCHPVLYQRLSAAKANRPEMKIVVIDPRRTMTADIADMHLAIAPDGDVALFNGLLAHLAASGAVDRNYISNYTSGFDEAVAAASRLDLPALSTATGLTVAQLRAFFRLFETTEKVVTCYSQGVNQSAAGTDKVNAIINCHLATGRIGRPGMGPFSLTGQPNAMGGREVGGLANMLAAHMDIEKSLHRDQVRRFWGAPSVASKPGLKAVDMFRAVADGRIKALWIMATNPVVSMPDADAVEAAIKACPFVVVSDIVRDTDTARHAHVLLPSLGWGEKDGTVTNSERRISRQRPFLAAPGEARPDWWQLAEVGRRMGFAAAFTHGSPAVIFAEHAALSGFENEGRRDFDISAHAEIDGPAYDGLRPFQWPQPQGSAPQKKRFFAEGAFYHPDGRARLVAVEVPRPRSANDAFPFTLNTGRVRDHWHTMTRTGKSARLSGHLAEPFVEIHPRDAQGAGISDADLVTLESPHGAAIVRALVTDRQAEGNLFVPMHWNDQFASKARIDALVAPVTDPVSGQPASKNMPVRASRFAAAAYGFAVSARKPRELDAAYWALARAEGGWRVELAFAETNADWLDWCRKTFAIAAGIEPIGYTDRTSGELRLAFFEGDRLLATLFLSPRPVAVARSWAVSQLGASHHNLAKRFAVTAGRPGADTPDPGATVCSCFSVGVNQITAAVRDGCHSVEAVGERLSAGTNCGSCRAEIRGIINGCLTLAAE

SEQ ID NO: 41553 - protein, 143 aa, Oryza sativa (japonica cultivar-group)
MVHGTLEVLLVGAKGLENTDYLCNMDPYAILKCRSQEQRSSIASGKGSNPEWNENFVFTVSDKATELLIKLLDSDTGSADDFVGEATIPLEAVYTEGSIPPTLYNVVKDEHYCGEIKVGLTFTPEDVRQRGLPEDFGGWKQSR

SEQ ID NO: 41554 - protein, 153 aa, Lupinus luteus
GVLTDVQVALVKSSFEEFNANIPKNTHRFFTLVLEIAPGAKDLFSFLKGSSEVPQNNPDLQAHAGKVFKLTYEAAIQLEVNGAVASDATLKSLGSVHVSKGVVDAHFPVVKEAILKTIKEVVGDKWSEELNTAWTIAYDELAIIIKKEMKDAA

SEQ ID NO: 41555 - protein, 528 aa, Oryza sativa (indica cultivar-group)
MQPTWLATMPAASSLVVGVAFTAAVAVAVAAAVARRAWRHRGLRLPPGPPSWPVVGNLLQVVFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEELVVRVDAVMKRVVLAVAARIDDYLPFLRPFLWRQHRQAVALRREQIDTVLPLINRRRAIVRGMRAGSPPDPAVAAPYSYLDSLLDLRVEGRDAVPTDEELVTLCAEMINGGTDTTATAIEWAMARVMDNPSIQARLHGEIMQRVGDARPVDDRDTDGMPYLQAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 41556 - protein, 153 aa, Lupinus luteus
GALTESQAALVKSSWEEFNANIPKHTHRFFILVLEIAPAAKDLFSFLKGTSEVPQNNPELQAHAGKVFKLVYEAAIQLEVTGVVVSDATLKNLGSVHVSKGVADAHFPVVKEAILKTIKEVVGAKWSEELNSAWTIAYDELAIVIKKEMDDAA

SEQ ID NO: 41557 - protein, 1412 aa, Cryptococcus neoformans var. neoformans JEC21
MHQQRAPAAHHHSYSYAPYPHASVSAENTVPSMAQPQVYYQQPPADFYPHVPGHNPHTGASHGTQAGPSQSAENNAFAMPDVRQSKSARPRPPPSSVTMPMIPTSLPDPSMHSYAPVQAPVPQQQTRTANRRSHNPAATLNSPSAPRPEELTDEYVLHPSVYAFKQEYPRRAMVGLGPYIVLQTLGEGEFGKVKLGVHADYGVEVAIKLIRRGDLQEEAHASKVEREINVLKTLKHPNIVRMFDVLDTHKYIGIVLEFAGGGELFEYILANEYLKDKEGQRIFAQLISGVDYLHKKGVIHRDLKLENLLLDKNRNLIITDFGFANQFDLSKGDLMSTSCGSPCYAAPELVVLDTPYHGSAVDIWSCGVILYAMLAGYLPYDDDPDNPDAGNVVELYRYIMNTELHYPDHVSPLGKNLLQHMLILHPEHRIKIPVIVKHPWLKSYHDMFNKSVEECEAAFQDAMYRKSRQARKELQERRRVQTQARESLQTKERAHVQRSQSSAPGTIINAAALDQIRRRPHSAMPGSTPLPEIIAKHSESVDDVALTMRSATPPTALSQPTEIRSPTTESPRPRSESMAPRLSFTTSVSTPTAMTVETPSSVPVQSPTDALPPAAMTVMQPSVEAAPPMRDHKNRNTIQVEHAGEGLHDRAKEAFDANHGRADGSMETTSTADTGMVASSLLDVKREESTDIEMESGSSDSEQPKPANDGISQQPGEKSMDIPPIVPITIPLAPPAESGTATAANDSSQVLEPQEKLSPALVEHGSASIDEMASPSTPRVSTSVEQEPVNITPRAKMRAPPVATTPKASLVNERKRHGSMPPPMGPSFVSDSRPESSLTATGLPKLPKKDRYRKGMSLDKFGLAKLLGHASQAHTTVHGEGKMAPPSASSSALALQHQLQQHGGQSQAVSESDSVKKSRRRTLQFGFHSRKDSKASSAAVATPGTPLMDKDTNGENRLSSITGGTASLRDKRRKTVQIGLSTQSEQKDTTVNVPGLSSSGHLVKNPATEPPQGISIGPVVGTDASALSQSSPSAVALEAFAAQQGHYPSYRGSSSRASKVMDWFRRKTFVKETLPEPKSPVIKSDSQSSFVRIGEVASPASKTQESAQASTVSQENTDKAEEKIDSTADQENAAKTTPTKSPVLPQPIGATATTPSVMITPPRPTAATTPTIGSSTQQSPPTTIRTRSASTFTFDESKIRVHTGLVDQSALSTKPPQDVFVEVIQVLRGMGVEMKRESDFKLRCTRAKKKAAGTSIGLGSVVSTGSGMSPFSIMNNASASKTDSRGLPRPTSPSAVANRSSAGIKGLLRRGSSRSSAHPARLTRTGDEVPNPPSQSTPNLELPESSMASKPEPLYGKELMDAGDEVKFTVELCKMKNLPGLFILKIKRTKGNLWSFKFIYQTVIERTTTLTH

SEQ ID NO: 41558 - protein, 953 aa, Flaveria trinervia
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLLGGKGANLAEMSSIGLSVPPGLTISTEACEEYQQNGKSLPPGSWDEISEGLDYVQKEMSASLGDPSKPLLLSVRSGAAISMPGMMDTVLNLGLNDEVVAGLAGKSGARFAYDSYRRFLDMFGNVVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPEAYKELVENCEILERHYKDMMDIEFTVQENRLWMLQCRTGKRTGKGAVRIAVDMVNEGLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPSLKVGICGEHGGEPSSVAFFDGVGLDYVSCSPFRVPIARLAAAQVIV

SEQ ID NO: 41559 - protein, 478 aa, Emericella nidulans
MKAATPRPSVRALSSGRSYRTARFVSRTSNARSSLAADTNSLLQQAPPSPKKQLASPLAKLPLSSVLRSLLILSVSSSSILLKPCIYTLSALAHPKTALLDVAKNPLLNLLVKHTIYKQFNAGENKLEVQRSINAIKELGYRGVLLGYAREVLVGESKTDPRDEQASRQEIQTWLDGTLQTVDMAQEGDFVALKFTGMGIQALEYLQNQAPPSPFMDEAIKQVCDLAISRNVRLLVDAEEQAVQPGIEEWATMYQKYCNSRTPGRAIFYNTYQAYLCSTPATLARHLEISRKEGYTLGVKLVRGAYLKTEPRHLIWAKKEQTDECYDGIVEALLTRRYNHMLKPASAEHTTELPPVSVIVATHNRDSVRKAHALRLEQASRGEKSDVELTYAQLQGMADEISCELLQGFQTAGPENTKVAESPNVYKLLTWGSVKECMGFLLRRAVENTEAVGRTKQSQEAMFSELRRRARRAFGLRY

SEQ ID NO: 41560 - protein, 253 aa, Oryza sativa (indica cultivar-group)
MATTSACCYRPLSAPPLHSRRGPPPQQQQLRTAVGGPRPRPSLQVAAAAAAATGGGQSVKAATDAEFFQTSDTRPIMLFDGVCNLCNGGVRFVQEHDPNRSIRYIPLQSESGRKLLQRSGRAPDDISSVVLVEKDRSYIKSEAVLRIMGYLNLPFPQLATFLNFVPLFLRDFAYDNVADNRQSSKEELYIAVCLKMVNITEVDALAMHTLTAQYLDGLLLGGCPTDIDKSCVTYGHTTILQEYQDLGIFHPVF

SEQ ID NO: 41561 - protein, 346 aa, Trichodesmium erythraeum IMS101
MSPYLEELKVTAQAMVAKGKGILAMDESNGTCNKRFEKLGIPTTEEYRQAYRQLILTTPDLSNYISGPILYDETIRQSTTEGVPFLKVITDAGMIPGIKVDTGAKNLANHPNEKVTEGLDGLGERIAEYYQMGARFAKWRAVITIGDGIPSRACIEANAHGLARYAALCQEGGLVPIVEPEVLIDGNHTLERCFEVTDETLHTVFNHLYTQGVAFDQMILKPSMVIPGKDCPTQVSVEAVAEATINCLLKNVPVTVAGIAFLSGGQSIEQSSAHLNAMNALFGSRCPWPVTFSYARAIQQPALDYWSGDSARVAEAQQKLLARAKCNSAASVGEYSASMDETPVLV

SEQ ID NO: 41562 - protein, 399 aa, Oryza sativa (japonica cultivar-group)
MLAAVMDYFRSCWGPRSPAGHRVRGSDVAGRQDGLLWYKDAGQLVTGEFSMAVVQANNLLEDQSQVESGALSMAEPGPQGTFIGVYDGHGGPETARFINDHMFHHLRRFATEHKCMSTDVIRKAFQATEEGFLSLVSKQWSLKPQIAAVGSCCLVGVICSGTLYVANLGDSRAVLGRFVKSTGEVVATQLSSEHNACYEEVRQELQASHPDDPQIVVLKHNVWRVKGLIQISRSIGDVYLKRPEYNREPLHSKFRLRETFKRPILSSEPAIAVHQIQPNDHFVIFASDGLWEHLSNQEAVDLVQNNPRNGIARRLVKVAMQEAAKKREMRYSDLKKIDRGVRRHFHDDITVIVVFLDSNAISKANWSRGPSVSLRGGGVTLPANSLAPFSTPTVLSSTY

SEQ ID NO: 41563 - protein, 297 aa, Solanum tuberosum
MGEKPVSGGVWPTVKPFINGGVSGMLATCVIQPIDMIKVRIQLGQGSAADVTKTMLKNEGFGAFYKGLSAGLLRQATYTTARLGSFRILTNKAIEANEGKPLPLYQKALCGLTAGAIGATVGSPADLALIRMQADATLPLAQRRNYTNAFHALSRIAVDEGVLALWKGAGPTVVRAMALNMGMLASYDQSVEFFRDNLGMGEAATVVGASSVSGFFAAACSLPFDYVKTQIQKMQPDAEGKLPYTGSFDCAMKTLKAGGPFKFYTGFPVYCIRIAPHVMMTWIFLNQIQKVEKKIGL

SEQ ID NO: 41564 - protein, 171 aa, Synechococcus sp. WH 5701
MAADLNDSAELMAELKDDINMDQTSVDETGTAETAAPTAVADKPAVSPARTGKLSAQDLIRAFEAEQLKSDLPEIYVGDTVRVGVRISEGNKERVQPYEGVVIAKRHGGLNETITVRRIFQGVGVERVFLLHSPQVATVKVERRGKVRRAKLFYLRDRVGKATRVKQRFDR

SEQ ID NO: 41565 - protein, 282 aa, Synechocystis sp. PCC 6803
MEWREISGSWVLVPPQPIAVVHFLGGAFVGTAPNVAYRWLLTELGKAGYVVVATPFVNTFDHQAIARSVLNRFEIILERLQKQGEITTGLLPVYGLGHSLGCKLHLLIGSLYEVERAGNILVAFNNYPVKQAIPFGEQLAQLQLDKFLTGVQKQLRQLNLQVDLNFEFTPSPEETNLLIAENYRVRRNLLIKFSNDDIDQTLGLRPILNQQTADLVAYCPLPGNHLTPLGQDIQWETGQEFSPLDAVGQWLKNSLSQDLRRLQKEILRWLEPTRFYSGFDNL

SEQ ID NO: 41566 - protein, 1118 aa, Synechocystis sp. PCC 6803
MNDKQKASGICESLYLLGEAKLSLKEKFYEISKLFYQFIKAFTEPENIVFRNFYAKFRYCISKINLDEEDVSNFEAFRKFIRRGFSEKVNQVAIEQGILLLQKLCLQATENSELLGFTFDNSKYNNQYFTKLFQARRSPSTKYLKLLYTGHHRSQSKRAFHLYGFDLENLQTNIVIECDWFNAPHLFYLIDILKEDTLIACHNLVPVAENKYQAKSESLIVIEPDFLVDASAISECFGNKNTSSDIFWLTKLVGELAGAAAFKGTIVGYCLDELVRNKQINIAQIFTDYKKSDALRSAYLGEQEMTNIQTSIVQEHLPNISQLVQRLQAENLRIWIEPTFFSQHYGLQGRLDLLTIDSNGSKDIIELKSGGAPYPGREWKNHKMQVVAYNMMLESTYGNYVGNKEIFYSKSDQPRRNIVSESQEKNELIKIRNEIVSKIYQLAAGNFISLDKLKSDGAGELPEYNQRRLKRFQQNYQPEKLTTNYYQQLLSFILRELINNKISDHQQSELEDKHQTSTGFASLWLDNFNVKQNNYRLIYDLKLIKVDKEKSYLSLALTQTDVPHSFRSGDIVIIHPKINGVYEPLKQHIFKGSIKGINQNQIIVSLFNKQNDYSFIEQYNFWALEPDIFERNYWSSIVCLLEVLSCSMEKKQLLLGHLEPQKALIDYQVNIYLSNDQNQIICQALEAKHYYLLQGPPGTGKTSIFLVNYVQNLLKLNKKNIFILAFTNKAVEQICKALKSPRYGELIDYLRLGNKTVVDESLLAEKLTGDNADLWRKYLQENQVFVTTVSTFKDKYLLLREFVGEFDQLIIDEASQLTEADLAGIVVLFNKFVLIGDQKQLPAVITQNEEECRVEVEPFRRYAINISDLRISLFERLINNAKNKGWNHCYGQLTEHYRMHRDIASLIAHHYDRPLVEQTQEQRKIESSYENNDNDLLSKLSKSRTIFIETPSETSIQRKNTNEAIIAATIVKTYWENKLLPMAEIGIIAPFRAQVAEINQQLEKIFAGADFSRDSIVVDTVERFQGDERELIIFSTTISWSKQVKNIQSIADGDRQGTDRKLLVSISRAKSKLVILGNSSQLQFAPAYRELIKHIEQSNGLIDLEIGQKIVNSHGGEF

SEQ ID NO: 41567 - protein, 808 aa, Methanocaldococcus jannaschii DSM 2661
MLIVRKPKKKKDEIEIVKVGGKIEDGIEVKNNQKIFANYKKVGDKYKLYRCRVGDKLIQPSKVLELLKSDKIFILKENEEEIEEVLKSYNLKFDYIELCPFCLLKNIYKRLTRNNRCRYGNLEICINCGINEIKEEVKISEEFIEKFLKRFKDVDKVLSLLRIRNPLDKPELTRYDIITGSEEDKIENYKIDELDIPEELKEIIKSRGIEELLPVQTLSVKAGLLNGDDLLIISATSSGKTLIGELAGIKNLIKTGKKFLFLVPLVALANQKYLEFKERYEKLGFKVSLRVGLGRIGKKVDVETSLDADIIVGTYEGIDYLIRTKRLKDIGTVVIDEIHSLNLEERGARLDGLIGRLRFLFKEAQKIYLSATIGNPKELAKQLNAKLVLYNGRPVPLERHIIFCKNDFAKLNIIKEIVKREWQNISKFGYRGQCLIFTYSRKRAEYLAKALKSKGIKAEFYHGGMEYIKRRKVEDDFANQKIQCVVTTAALSAGVDFPASTVILESLAMGADWLNPAEFQQMCGRAGRKGMHEIGKVYLLVEIGKKYHAKMENTEDEVAFKLLNAVPEDVKVEYNEDEEEEQILATISAGITNRYDIDRVPYIGRAFSLNKILSNLESYGMIKANNDVKLTNYGSAVAISFLYPKVAEKIKEGIIENKEIIKLITEIMPFENVYLSNNLKIKLSKILNINVPSRFFDALEVIREGMEKIKDKKLKEDLTLIIMEFEGVEVEEKILEMIINLRISGKTPGQISKTLYEEFKIQTYSGDIYYYLEQLLNLLDATERIARIFNKRYAEKVKELKEKIENPK

SEQ ID NO: 41568 - protein, 195 aa, Zea mays
MAGKKRKAEAARLEETDRALYGAFRGAANSLSQLYTLGMGAQKASFHAGERHAMEKLYEWILRQHENGLRLTVADVASHIQHEIQYGGDNASASPRSQYPSQSTAPTMHIPNTSNQQPSPSLFAPGNPGLTQSKNSMVFSSALSSPIRRSLQPYHLEQDGDAGYFANGASRDVNPTASNDSSMDMHSDSPAHDSY

SEQ ID NO: 41569 - protein, 347 aa, Synechocystis sp. PCC 6803
MTVSEIHIPNSLLDRDCTTLSRHVLQQLNSFGADAQDLSAIMNRIALAGKLIARRLSRAGLMADVLGFTGETNVQGESVKKMDVFANDVFISVFKQSGLVCRLASEEMEKPYYIPENCPIGRYTLLYDPIDGSSNVDINLNVGSIFAIRQQEGDDLDGSASDLLANGDKQIAAGYILYGPSTILVYSLGSGVHSFILDPSLGEFILAQENIRIPNHGPIYSTNEGNFWQWDEALRDYTRYVHRHEGYTARYSGALVGDIHRILMQGGVFLYPGTEKNPDGKLRLLYETAPLAFLVEQAGGRASDGQKRLLDLIPSKLHQRTPAIIGSAEDVKLVESFISDHKQRQGN

SEQ ID NO: 41570 - protein, 185 aa, Oryza sativa
  misc_feature (35)..(35): Xaa can be any naturally occurring amino acid
  unsure (1)..(185): unsure at all Xaa locations
MLRRRGFCCCSGAPTAAAAALLLLAVAAAAPRAAXGFHLGGDESVLVRGMLAAIRREQAEAEDAARFAVAEYNKNQGAELEFARIVKAKRQVVTGTLHDLMLEVVDSGKKSLYSAKVWVKPWLDFKAVVEFRHVGDSQSQSATDADGNAGQDTADPTVASRNDLHNTENNKVSVDLSTFSQTYSV

SEQ ID NO: 41571 - protein, 607 aa, Magnetospirillum magnetotacticum MS-1
MGGLLITQARSEYDASLLALEEQETQAMKEELIRQVETAKNFLRTMQASTEEVLRRQITDQVDQAYALSSALYDREQGRLGEGEVKRLVIEALRPIRFFNGKGYYFVDDMDGNCLLLPINPNLEGTSLLNNRDDAGTYIMRSLISAANNPSGEGFSRYRWYAPGSGKKMLEKIAYVRKFEPYNWLIGTGQYISDVDQVLQAEARNRLRGLRFGPHAKGYFVIYGPGEKVLVSPSRQESEDHLIDELPSDGRAVAHTIFDQGQKGDGFVRYDWAIDGGTSNKSTKLVYVSKVPDWDWVISAGLYLDDLAATIASRRAALDESIRNKVLVTVLAALTGIVISLAIGWKFSHISHRMVESFHSNIAHKNQELEAKTRTLEQSNADLEQFAYVASHDLQTPLRNIVRFAQLLERRYKGRIDSDADAFIGFIVDGGKHMTQLISDLLEFSRVSRQSAPLTPISATEAITQALKNLELEIAKSEAEVNVDDLPLVMADQTYLVSLFQNLVGNGIKYGAADRKPVISVSAMRVSSGRWRFAVTDNGIGIEPQYQEKVFEIFQRLDPTSRREGTGIGLTLCRRIVHRFGGAIWLESIPGEGTTLFFTLQDGSAAA

SEQ ID NO: 41572 - protein, 200 aa, Ehrlichia canis str. Jake
MKLKAIMSKCEFIIGATHVKSFPNFSIPEIAIAGRSNVGKSSLINAITNNKKNAKTSSRPGCTKQINFYLINKSFMVLVDLPGYGYSKATRATINNYLFLMEYYLLNSKNLLKVILLIDVKVGFKEIDLDFINWLELNHIYYQLVLTKIDRVSKEILDVNINYIKNLNLGFVIYPVISASSKYKQGIGELIYEIAQCIKK

SEQ ID NO: 41573 - protein, 208 aa, Triticum aestivum
HTPRGTKKQVCRGPEFPGYRRPTRPLVTCGTRGIGRAVVEELAALGAAVHTCSRKEAELGKRLKEWEARGFRVTTSVCDLSVREQRERLIGDVAERFCGKLNILVNNVGTNIRKPTTAFSGEDYSFLMATNLESAYHLCQLAHPLLKASGLGSIVFISSVCGLLAVFSGTLYAMTKGAINQVTWNLACEWAKHGIRANSVASWYITTS

SEQ ID NO: 41574 - protein, 267 aa, Oryza sativa (indica cultivar-group)
MGMARARARRLLPLLTFVTLGMILGSLLQLAFFRRIDHHSNVTHLENDQEAAFLRLGLVKPEVISWSPRIIVFHNFLSSEECDYLRSIARPRLQISTVVDVATGKGVKSNVRTSSGMFVSSEERKLPVIQSIEKRISVYSQIPEENGELIQVLRYEPSQYYRPHHDYFSDTFNIKRGGQRVATMLMYLTDGVEGGETHFPQAGDGECSCGGKMVKGLCVKPNKGDAVLFWSMGLDGETDSNSIHGGCPVLEGEKWSATKWMRQKEFV

SEQ ID NO: 41575 - protein, 407 aa, Flavobacteria bacterium BBFL7
MQSQDLLNIAQEHGSPVYVYDAHRIVSQYERLTSAFAQAKSLRIHYAVKALSNLSILKLFKQLGAGLDTVSLQEVQLGLAAGVEPHKIIYTPNGVSLEEIEQVAAMGVQINIDNLSILEQFGSKHPTIPVCVRINPHVMAGGNANISVGHIDSKFGISIHQIPHLLRIVENTNMTVNGVHMHTGSDILDIGVFLYATEILFETAAKFKDLEFIDFGSGFKVPYKEGDVSTDIEDLGEQLSERFNKFCKDYGRDITLAFEPGKFLVSEAGYFLAKVNVVKQTTSTVFAGIDSGFNHLIRPMLYGSYHGIKNISNETGRNRFYSVVGYICETDTFAQNRQISEITEGDILAFANAGAYCYSMTSNYNSRYRPAEVLWYNGEAHLIRERETMEDILKHQVPVELALEELV

SEQ ID NO: 41576 - protein, 182 aa, Gossypium hirsutum
MASSMISSATIATVNCSSPAQANMVAPFTGLKSASAFPVTRKANNDITSLASNGGRVQCMQVWPPLGKKKFETLSYLPDLTPVQLAKEVDYLLRSKWIPCLEFELEEGFVHRKYSSLPTYYDGRYWTMWKLPMFGCTDSAQVLEELENCKKEYPNAFIRIIGFDNVRQVQCISFIAYKPKGY

SEQ ID NO: 41577 - protein, 245 aa, Zea mays
MISLSSIPPFPERQKLSRFRFNPTKTVKISFQSEQVLRNHGRPSLKFYLLSLCVCVWLLCSSGIGRVAPLEAVLFDIDGTMAISDPFHHRATSEMLLKVGYNNGVPITPEFGMANMAGRSNEQIGRFLFPDWDQRRLDAFFAEKEALFARYAAEGLREIAGLTPLCRWAAGRGLRRAAVTNAPRANAELMISILGLSDFFSLVVTAEECGRSKPYPDPYLRALDLLGVSPDHALVFEDSTTGVQA

SEQ ID NO: 41578 - protein, 458 aa, Pseudomonas fluorescens Pf-5
MGIQEYSAAERLERLPISGYHRVIFIIIALAFFFDSMDLAMMTFLLGSIKTEFGLSSAQAGLLASSSFFGMVLGASLSGMLADRYGRKPVFQWSIVLWGVASYLCSTAQSVDSLTLFRVLLGIGMGMEFPIAQSMLSEMIPAQRRGRYIALMDGFWPLGFVAAGVLSYFLLPLIGWRDIFLVLAVPAVFVLVIRFFIPESPRWLEQAGRHADADRVLCGIEDKVRASLGTAQLPEPLHLPRIDSAPGHFFSALKQIWSPLYRQRTMMIWSLWFFALLGFYGLTSWLSALLQQSGFAVTQSVYYTVLISLGGIPGFLMAAWLVERWGRKPVCIVTLLGGGVMAFFYGQSAVFGGNVSLLIGTGLLMQFFLFGMWAVLYTYTPELYPTSARATGSGFASAVGRIGSLLGPLVTGLVFPLTGQGGVFALGAACFVIAAGVVWLFGMETRGKTLEELSEAGS

SEQ ID NO: 41579 - protein, 321 aa, Pseudomonas fluorescens Pf-5
MNQLPIIDISPLYQDEQQGWDSVAKQIDRACREWGFFYIKGHPISAQRIEQLLSTAKQFFALPSVEKLKIDITQSRHHRGYGAIATEQLDPSKPSDLKETFDMGLHLPAEHPDVLAENPLRGPNRHPDLPGWQALMEQHYQDMQALAQTLLRAMTLALGIERDFFDRRFQDPVSVLRMIHYPPRHTASSAEQQGAGAHTDYGCITLLYQDAAGGLQVRNVKGQWIDAPPIDGSFVVNLGDMMARWSNDRYLSTPHRVISPLGVDRYSMPFFAEPHPDTRIECLPGCQDAEHPAKYPVTTCAQFLLSRFADTYAYRRELEQA

SEQ ID NO: 41580 - protein, 131 aa, Glycine max
  misc_feature (85)..(85): Xaa can be any naturally occurring amino acid
  misc_feature (107)..(107): Xaa can be any naturally occurring amino acid
  unsure (1)..(131): unsure at all Xaa locations
NSLDLIGRDTQLNSAYKKSRPKKEEAPGKNEEEERSAGPLTDLMMSARKNTHARRTGGASRKLPGRVRALDRHCNKVLENVRQMXTEEPKTGKGPKTAQPANKDRFXKMSLRGHSVLIVLTNPKSDSVINL

SEQ ID NO: 41581 - protein, 83 aa, Oryza sativa (japonica cultivar-group)
MVFVWLTAFFLVVALIVLVIYQLMCLADLEFDYINPFDSSSRINKVVIPEFVLQAALSVLFLLSGHWAMFLLSAPMVYYNYTL

SEQ ID NO: 41582 - protein, 486 aa, Pseudomonas putida
MKEIKHFINGEYVESASGKLFDNVNPANGQVIAKIHEAGEAEVDAAVKAARAALKGPWGRMTVAERTEILHRVAAGISARFDEFLEAECLDTGKPKSLASHIDIPRGAANFSVFADLVKNVPTEAFEMATPDGTGALNYGVRRPKGVIGVISPWNLPLLLMTWKVGPALACGNTVVVKPSEETPTTTALLGEVMNAAGVPAGVYNVVHGFGGNSAGAFLTAHPDVDAYTFTGETGTGETIMRAAAKGLRQVSLELGGKNAGIVFADCDLDKAIEGTLRSAFANCGQVCLGTERVYVERSIFDEFVARLKAGAEALVIGPPDDASSNFGPLVSLKHREKVLSYYQQAVDDGATVVTGGGVPEMPAHLAGGAWVQPTIWTGLADNSVVVTEEIFGPCCHIRPFDREEEAIELANSLPYGLASAIWTENASRAHRVAGQIEAGIVWVNSWFLRDLRTAFGGSKQSGIGREGGVHSLEFYTELKNICVKL

SEQ ID NO: 41583 - protein, 446 aa, Oryza sativa (japonica cultivar-group)
MAVTIQSVKARQIFDSRGNPTVEVDVGLSDGSFARGAVPSGASTGIYEALELRDGGSDYLGKGVLKAVSNVNTIIGPALIGKDPTEQVDIDNFMVQQLDGTSNNWGWCKQKLGANAILAVSLAVCKAGAMVKKIPLYQHIANLAGNKTLVLPVPAFNVINGGSHAGNKLAMQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 41584 - protein, 481 aa, Klebsiella aerogenes
EFDYCCVHASLALREDGYETIMVNCNPETVSTDYDTSDRLYFEPVTLEDVLEIVHIEKPKGVIVQYGGQTPLKLARALEAAGVPVIGTSPDAIDRAEDRERFQHAVDRLKLKQPANATVTAIEQAVEKAKEIGYPLVVRPSYVLGGRAMEIVYDEQDLRRYFQTAVSVSNDAPVLLDRFLDDAIEVDVDAICDGEMVLIGGIMEHIEQAGVHSGDSACSLPAYTLSKEIQDVMREQVQKLAFELQVRGLMNVQFAVKDNEVYLIEVNPRAARTVPFVSKATGVPLAKVAARVMAGKTLAQQGVTKEIIPPYYSVKEVVLPFNKFPGVDPLLGPEMRSTGEVMGVGRTFAEAFAKAQLGSNSTMKKQVRALLSVREGDKERVVDLAAKLLKFGFELDATHGTAIVLGEAGINPRLVNKVHEGRPHIQDRIKNGEYTYIINTTAGRQAIEDSKLIRRSALQYKVHYDTEKVISVQEMHAQITK

SEQ ID NO: 41585 - protein, 359 aa, Magnetospirillum magnetotacticum MS-1
MMRTYAIAAIPADGIGKEVVAAGLEVLDALAKRDGGFRLNVESFDWGSDYYKKHGVMMPENGRDTLKKFDAIYFGAVGAPDVPDHITLWGLRLNICQPFDQYANVRPTRILPGIKSPLGNVRPQDLDWVIVRENSEGEYAGQGGRSHRGFPEEVATEVTIFTRAGVTRIMRFAFKLAQSRPRKLLTVVTKSNAQRHGMVMWDEIAAEVAAEFPDVTWDKMLVDAMTMRMTLKPETLDTIVATNLHADILSDLAAALAGSLGIAPTANLNPERKFPSMFEPIHGSAFDITGKGIANPIGTFWTACMMLDHLGETAASARLMRAIERVTADPALHTPDLGGKATTRIVTDAVIAAIKADNE

SEQ ID NO: 41586 - protein, 351 aa, Ashbya gossypii ATCC 10895
MDLVLEFCDSYFFDYVYATLLPASLSPKMGGTWQQAMIKEQMVNATRVFGRSLERPLEVYGYAPFMFEVSPHAFGSVLPRYSLLRQSLSLFLVTTVFGWLLYLIVASFSYVFVFDKSVFNHPRYLKNQMSMEIKQGLGAIPYMAVMTVPWFLLELHGYSHLYMGLELNVRGYVRLALKALFFILFTDFGIYLLHRWLHWPAVYKVLHKKHHKWLVCTPFASHAFHPIDGYLQSLPYHLFPMLFPLHKVSYLVLFTFVNVWTVMIHDGEYLSNDPVINGAACHTVHHLYFNYNYGQFTTLWDRLGGSYREPDHELFDSNLKKDKAVWEQQIKEVDEMIKNVEGPADDRVYER

SEQ ID NO: 41587 - protein, 276 aa, Brassica napus
HIQVYLYGGQVTSWKNEKGEDLLFMSTKAIFEPPTPIRGGIPVLFPQYANTGPLPSHGFVRQRFWKIDANPPPLSSHPSSTAHIDLILKSSEADLKIWPHKFVYRLRVALGHGGDLTLTSRIRNSDVKLFNFTFGLHPYFSVSDISQIQVEGLQNLDYLDQLKNRTRFTDHGKFITFNSQLARLYLKTPNKIRIVDHKKKKTIVVRKEGQADAVVWNSWDKKVVDLGVEDYRRFVAVEPVEVEKPIILKPGQEWKAIFQVSVVPSGCSRKSCIPHT

SEQ ID NO: 41588 - protein, 388 aa, Flavobacteria bacterium BBFL7
MENPFNNTEIAFSLKSNRELRKAHFLFKMMGYPSLVNFGSAVMMKSLQWKLPVKGLIKHTVFEHFCGGTTEEECESVVKRMYEKGVSSILDYSVEGKEDEADFNAVVDKKLKLIKHAAHSDALYFEVVKPTGIGRFYIWQKVTEKKELTAAEQAEWQRIKDRVLLLSQTAYDHNIALLFDGEESWMQDAADELIRDMMVQFNKEKAIIYNTLQCYRHDRLDYIKSLYEDAQKNNYIVGVKIVRGAYMEKERARAEEMGYESPICVNKMATDELFNSAMFFILDHLDVIKLCIGTHNESSTLQAMEILTKKGIAANNKDVWFGQLYGMSDNLTFNLAQMNYNTFKILPFGPIADVMPYLIRRAQENTSVAGQTGRELILIKQEMKRRGL

SEQ ID NO: 41589 - protein, 259 aa, Brassica napus
  misc_feature (228)..(228): Xaa can be any naturally occurring amino acid
  unsure (1)..(259): unsure at all Xaa locations
MSNYEEQPRAKKTKREAFRLSCLPDDLVLNCLARVSRPDLAALSMVSKRYHSLVASPDLYKIRSLIGRTETYVYVCLRIPTPVPSVRWYILRRRKTLDASDLIQIPSLPSQPLEASSVVVLDCSIYVIGGLIKGEQRSSDVWSLDCRTHVWHPVPSMGAARAYGAAGVVDGKIYVFGGCDVDDNYGEVFDPEIQTWNPLPPMPKRKKHIHSSMVRDQKVYALDEKREXFYYSPREGKWGTGNRGQLVGYRRDWCMVDNL

SEQ ID NO: 41590 - protein, 504 aa, Thermoplasma acidophilum DSM 1728
MKYGFLEKLYPVFRRYLKDRKHEREDHEWDYEIERHGEIAVRRFIELGPTFIKLGQILSARPDLLPKEYLKSFRLLQDRVDPDPFPLAREIIERNVGKIEDVFEYFNENAISGASLGQVYEAVYHGKKVAVKVNRYNIEERVRNDLIVIKHLLRLAKGRIDNFLYLSIENVVSDFNRRIFDEIDYRKEASNMRAIAANLKEEDRVIVPGIIEELSGKEVLVMEYIEGIKIDDVQRLKDAGLDTKEIALRYDTIFMRMLLKNEIFHADPHPGNVSVREDGSIILYDFGMIGHINDDMRFRLLSLYDGLLNRDPDEIIDALIALNALSPGANRGVIRKGIELAISNFYGRSAEDLEIRELLDVANDVIFQFPFRLPRALVLYMRMSSLLEGVCQQLDPDFKFIRVLQKLLYDEGLIQTLYKQQLKNFLSDTLRSVEKAVQIVPLMKRRLESEDETVRPQRDYRIPASIFLGFILLSLFIEEKTRPLVFIPLIAIDIVAFLYIMIRK

SEQ ID NO: 41591 - protein, 332 aa, Zea mays
MAGPAPAVAASAAASQSPPMQLPSPFAELVKGSSGLEKIVLRGARNCCAEIYLYGGQVTSWKNDNGEELLFLSSKAIFKPPKAIRGGIPICFPQFGTHGNLEQHGFARNRFWTIDNNPPPLPVNPAIKAYVDLILKPSEEDLKIWPHSFEFRLRVSLGPSGDLSLTSRIRNTNTDGRPFSYTFAYHTYFSVSDISEVRVEGLETMDYLDNLKAKERFTEQGDAIVFESEVDKVYLAAPSKIAIIDHEKKRTFVVTKEGLPDAVVWNPWDKKAKAMQDFGDAEYKSMLCVEPAAVERPITLKPGEEWKGRLVLSAVPSSYCSGQLDPSKVLQG

SEQ ID NO: 41592 - protein, 496 aa, Xylella fastidiosa Ann-1
MSAPFALYDTAAAAALDARLAAHLGDDGDLLMQRAGRAAWDLLRQRWPDARQVLVACGTGNNGGDGYVLACLAHRAGLQVQVVHLPGRGPASLLAQRAYDAYLAAGGQVMLFSGVLETADVLVDALFGIGLNRPLDVPMQGLINALNAAGRPVLALDVPSGVDAERGAVFGTPVCAHVTLQFMVPHVGLYTGPALEAVGERVLAALDVPPALRDALPPCAERWGPQRLASLFRPRRRNSHKGEFGRVLCVGGNWGSGGAIMLSAEAALRSGAGVVHVATREAHVAPLLARCPETMPRGVAGSAELMPLLAAADVVALGPGLGQDSWGQALLAATLDSGCALVIDADALNVLAAAPGPLPPGAILTPHPGEAGRLLGCTTAQVQADRRAAAQALAARFAAVVVLKGAGSLIAAPGCLPCVIDAGNPGMAVAGMGDVLTGVIAALRAQGERAFDAALFGALLHAAAGDLVARDGGERGLLPSDVLPVLRRLINPDSAP

SEQ ID NO: 41593 - protein, 121 aa, Methanococcoides burtonii DSM 6242
MIDLDTLKFDGNGLIGAIAQDNRTGEVLMFAFMNREALEKTIETGIAHYWSRSRQKLWKKGESSGHMQKVHELLIDCDMDAIILKISQEGGACHTGYRSCFYRNIEGDVVGEKVFDPADVY

SEQ ID NO: 41594 - protein, 371 aa, Schizosaccharomyces pombe
AQWRVSMGINLLWGIITFIGISFLPESPRYLISVGRDEEALQIMAKNNDLPIEHEVIQTEYHVIKSDCEAELAGGPATWPEIFGPDIRYRTFLGLGVMSLQQLTGDNYYFYYGFEVFEGTGMNSPYLSALILDADNFGCTFGGLFVLEFLGRRMPLIIGALWQSITFFIYAAVGNRALTRKNGTSNHRAGAVMIVFSCLFIFSFAQTWGPAAYVIVGESYPIRYRSKCAAVATTGNWLWGFLISFFTPFITNSIGFKYGYIFAACNLCAACIIFLFGHETKGLTLEEINELYISGAKPWMPRPKNLGNFTKQQEEVREKSRGVQGESAAHLENVDGEEGIEDSSNDISSTTSSDGRAKPESSYHDQEEQFA

SEQ ID NO: 41595 - protein, 82 aa, Brassica napus
TDYVDKKALVNRLSKAMGGAEKVEIEHGNHSLSNRVHEAVQAIIGFVKREGPSGWDDPGAKSSFFFIYMDGKLSKSQSHELA

SEQ ID NO: 41596 - protein, 479 aa, Pseudomonas fluorescens Pf-5
MQRPRHLEPQPELHAMQPDASRPSELIYGLDDRPQPLPALLAALQHVLASFVGIITPPLVIGSALGLSTHLPYLISMALMVSGVGTFIQARRPWGIGAGMICLQGTSFAFLGAVLSAGFLVKQRGGSPEDILAMIFGVCFFGALVQIVLSRFIGRLRRVITPLVTGIVITLIGISLIKVGITDLGGGFNAADFGAPGNLGLGLLVLLTIILLNRSNTPWVRLSAIIIGLALGSLAAWFSGKLVPQPLPDLPLISLPLPFRYGFSFDWSAFIPVALIYLISTLETVGDLTANCMLARQPISGPSYISRLKGGVLGDGVSCMIAATFSAFPNTTFAQNNGVIQLTGVASRFVGLYIGLILFCLGLFPLIGALLQQIPKPVLGGATLVMFGSVAAAGVRILAQAPLDRRSMLIIATSFGVGLGIAAQPNLLHLLPKVVQNLFDSAITSGGLTALLMSLLLPESKGAANDANPIPENDTLKAH

SEQ ID NO: 41597 - protein, 288 aa, Synechocystis sp. PCC 6803
MVNSAVRSLAIVGGVHGNERTGVEVVRRWQQKDFARYFPALKCHYFLANPRAIAANRRYINQDLNRCFRPQDRKNPYLMGYEQLRARQLAHQISLAGIDFIVDLHTTTAAMGTTLILNCPHPLLLNLAAYLSAQDEEIRVLQYSPQKDLPYIRGLCELGLTIELGPVPQGVYDPTAIAKTQRTLARILAYLQASTSGNVPAADNCTVYQQIDTIDYPRDEQGQIVAEIAPHIRDYQAIKPGTPLFYHRRGNVTPYQGAATVYPVFIGEAAYVEKGIAMALTQRKTIAI

SEQ ID NO: 41598 - protein, 449 aa, Pseudomonas fluorescens Pf-5
MNMPETAPQSLASQLKLDAHWMPYTANRNFQRDPRLIVGAEGSWLVDDKGRKIYDSLSGLWTCGAGHSRKEIQEAVAKQLGTLDYSPGFQYGHPLSFQLAEKITDLTPGNLNHVFFTDSGSECADTAVKMVRAYWRLKGQSTKTKMIGRARGYHGVNIAGTSLGGVNGNRKLFGQAMMDVDHLPHTLLASNAYSRGMPEQGGIALADELLKLIELHDASNIAAVFVEPLAGSAGVLVPPQGYLKRLREICDQHNILLVFDEVITGFGRTGAMFGADSFGVTPDLMCVAKQVTNGAIPMGAVIASSEIYQTFMNQATPEYAVEFPHGYTYSAHPVACAAGLAALDLLQKENLVQSVAEVAPHFENALHGIKGTKNVIDIRNFGLAGAIQIAPRDGDAIVRPFEAGMALWKAGFYVRFGGDTLQFGPTFNSKPQDLDRLFDAVGEVLSKLD

SEQ ID NO: 41599 - protein, 263 aa, Synechococcus sp. CC9605
MSGATAIPDAWKEWLLQNRDRGCDPEGLMQRALEQGFAREAIVAVLQSSTPDWLAWFEAPLTRPDHRPRAWRLDTSLAQVYELPGLLSHEECEQVIDAINASLQPSTVTQGSSDYRTSRTCHLRQNHLQMAANLDQRFAALFGVDPRLSEPIQGQRYDPGEYFKEHTDWFSPGTEEYATLTDIGGQRTWTVMVYLNTVERGGETLFRRLGRSFTPVPGTALAWNNLQADGTPNHFTLHEALPVEAGQKWVITKWFRADFGRND

SEQ ID NO: 41600 - protein, 172 aa, Staphylococcus aureus subsp. aureus Mu50
MDLKQYVSEVQDWPKPGVSFKDITTIMDNGEAYGYATDKIVEYAKDRDVDIVVGPEARGFIIGCPVAYSMGIGFAPVRKEGKLPREVIRYEYDLEYGTNVLTMHKDAIKPGQRVLITDDLLATGGTIEAAIKLVEKLGGIVVGIAFIIELKYLNGIEKIKDYDVMSLISYDE

SEQ ID NO: 41601 - protein, 588 aa, Bartonella quintana str. Toulouse
MQKKTLSISCNPFPASRKIYQQSLLFSDVRVPLREISLTDGSNEKPLKVYDTSGPYTDKDTIIDFTKGLPAISLPWLSKRADTESYSARSVKPEDNGLAYDTKTVPAFKQKRPILRAKNGKAITQMAYARAGIITAEMEYVAIRENEGLEIKNQQKAQSDETCNGSIPEIYTAEFVRNEIACGRAIIPKNINHPECEPMIIGRNFRVKINANIGNSAVTSSMAEEIDKMVWAIHWGADTVMDLSTGRNIHNIREWILRNSPVPIGTVPLYQALEKVQGIAENLTWDIFRDTLIEQAEQGVDYFTIHAGLRLPFIPLTANRVTGIVSRGGSIMAKWCLHHHTESFLYEHFNEICDIARTYDISLSLGDGLRPGSIADANDEAQFAELKTLGELTKIAWAKDVQVMIEGPGHIPMHKIKENMEQQLDLCHEAPFYTLGPLTTDIAPGYDHITSAIGAAMIGWFGTAMLCYVTPKEHLGLPDKNDVKTGVITYKIAAHAADLAKGLPRAQLRDNALSRARFDFRWHDQFNLSLDPETACAFHDETMPKEAHKLVHFCSMCGPKFCSMRISHDIREAAAINKPKGDGIGCQV

SEQ ID NO: 41602 - protein, 338 aa, Arabidopsis thaliana
MPTLYKKAGCQFQLTTMGGVKRKISIELIEKKDSRAVAFSKRSRGLYSKASDLCLLSDAQIAIIATPVSSKSNVSFYTFGHSSVDNVVAAFLTNQRPREGLGLDYWWEDERLSKSEDLEELRDAMDSMSKMLKDLKDLQNQRDCEEDVKKKGVLHGTHQKQTFNPESCSVNFDGFNKNTEEFDLDEIFDYVSTAEALSMNLDMDDVSVVTTNQNPVSASETVEDRELVVHKNMDEDNIHVSDMDDKDTMLMISDKNNVLPENLDEFDQELDLDQLLDFETNYESLLKSCEMEDYASMVTTKQNLCSNPEAVEDGGLMIQKDLPEDNLCFSDYFSDLHC

SEQ ID NO: 41603 - protein, 153 aa, Fulvimarina pelagi HTCC2506
MNIIQELEASEAERISAIRKIPEFSAGDTVRVNVRVTEGTRTRVQAYEGVCIARSGKGLQENFTVRKISYGEGVERVFPVYSPQLDSVEVVRRGKVRRAKLYYLRNRRGKSARIVEATNVRARRLNDEARQIAADQREKAKAEKEAAKSGAAE

SEQ ID NO: 41604 - protein, 298 aa, Oryza sativa (indica cultivar-group)
MVSSSAAAGAGGEPQKQLLSIIRDFAAEKSHGERRVKDLKRRLDDVRAASDAAAAELEAAKRAREGAEQELRGGQVQVAIAAASIQALEATISHLQEEISKAGSDLDALKGKGDIERDEFISQMDQLNTKIRQFQQTVSVEFKRQKCSELPSGEGQHVRDRSEIKESEGILKDLIDKVNNADAELHVLEEEYKKDLLHHDEVRRELADTQAKRALMEAVMGETKQLQELGEYPFLGFFQKFFELATSSAISCAKFTKRLRKAFFNGKQAGSRNGESARFACGGVAEAEWENTGRKNVQ

SEQ ID NO: 41605 - protein, 245 aa, Flavobacteria bacterium BBFL7
MVIGAGQAGVLFKTLGNGVDLENTYGEGFHIIAPWNDMIIYPTRQQSISDKMQVLSVNGLEVKVDATVWYMPEYDKLPFLHQEKGRQYESEILAPAISAAARSVVGRYTPEQLYSSKRDVIQAEILEEVQKELETQYVIVNRVLVKDVTLPIKIKEAIERKLKQEQESLEYEFRLTKATKEAERQKIDAEGKAVANRILSASLTDKILTEKGIEATLMLSQSPNSKVIVIGGSESGGLPIILGNQ

SEQ ID NO: 41606 - protein, 230 aa, Triticum aestivum
  misc_feature (26)..(26): Xaa can be any naturally occurring amino acid
  misc_feature (73)..(73): Xaa can be any naturally occurring amino acid
  misc_feature (174)..(174): Xaa can be any naturally occurring amino acid
  unsure (1)..(230): unsure at all Xaa locations
MALYLATELRWKEGSLESGRHHLLKXQTNHSYIADERVGRVKPAEGVELCLCPSQGKAAQILADHLPKEHSGXLTVPGASIVGVVVWRRPHASSRVPNRQEDSKWQAATSGSAMPMISQPSSRSSNASHQEIVTADVPPGFGSGVVRDDDGLPEYNSVSVSNSSTSRFCPDRRXARELVRKYGDRPSAAQPWKGDGNDDDDMPEWDPYYQGSDGMVSNPRQFCAICKRPF

SEQ ID NO: 41607 - protein, 54 aa, Zea mays
  misc_feature (41)..(41): Xaa can be any naturally occurring amino acid
  unsure (1)..(54): unsure at all Xaa locations
MGCDYKCGCAVPCPGGKDCRCTSGSGCHREHTTCCFWEHCXVSPCTCGLATMPF

SEQ ID NO: 41608 - protein, 433 aa, Streptococcus sobrinus
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAAARAAADYLEIPLYSYLGGFNTKVLPTPMMNIVNGGSHSDAPIAFQEFMIMPVGAPTFKEGLRWGAEVFHALKKILKERGLETAVGDEGGFAPRFDGIEDGVETILKAIETAGYEAGEKGIMLGFDCASSEFYEDGVYDYTKFEGEKGAKRSAAEQIDYIEGLVNKYPIITIEDAMDENDWEGWKALTERLGNRVQLVGDDFFVTNTDYLARGIKEGAANSILIKVNQIGTLTETFEAIEMAKEAGYTAVVSHRSGETEDSTIADIAVATNAGQIKTGSLSRTDRMAKYNQLLRIEDQLGEVAQYKGINSFYNLKK

SEQ ID NO: 41609 - protein, 342 aa, Hyphomonas neptunium ATCC 15444
MPPSNSRTRHQRQPGVRSITVLTSQSDLDLARNVIRTERNALEKLEQTLGPSLEEAVSTILATDRHVIVAGVGKSGHIGQKIAASLASTGTPSFFLHPTEASHGDLGMIVPGSVVIAISYSGESRELIDLLRYCKSNAIPLIAMTRARESTLGRYADVLLELPTVPEACPNGLAPTSSTTMALALGDALTIVLMARRGFSTEDFGFRHPGGKLGRTLQTAGDYIRDHKDPLPLASAGASFEELVIAVSEGRKGCVGIIDETRKLIGMVTDGDLRRAILAGRTNASAREVMTPGPRTIDPDARMMSVIKSFSENRISNAFVVDETGAPAGLIDMKDLLAEGYV

SEQ ID NO: 41610 - protein, 150 aa, Virgibacillus halodenitrificans
TKERTFLMVKPDGVQRNLVGEVVKRFESKGLKLAGAKLMVISKDGAAAHYAELGGGPFFGGLVGGATSGPVFAMVWEGLNAAATARQILGATNPSDAAPGTIRGDFGVSAGRNAIHGSDSAGSAAKEIGAFFGGGEAASGTPAAAADIYG

SEQ ID NO: 41611 - protein, 531 aa, Oryza sativa (japonica cultivar-group)
MGCCGSSLQAGTHPEKPPGMAAPPQRPSFSLNQHQAPGSAAAQGVGRGEVPAFAEFSLAELRAATGGFAAENIVSESGEKAPNFVYRGRLQRTRRAIAVKKFPKMAWPDPKQFEEEAKGVGKLRYRRLANLIGYCCDGDERLLVAEFMPNDTLAKHVFHWENQTIEWAMRLRVAHHIAEALDYCSSNERPLYHDLNAYRVLFDENGDPRLSCFGLMKNSRDGKSYSTNLAYTPPEYLRNGRVTPESVIFSFGTVLLDLLSGKRIPPSHALDMIRGKNIQVLLDSHLEGKYSTEEATALVDLASQCLQYEPRDRPNTGKLVSILDPLQTKLEVPSYEMLGIPKHEEEAPPAPAPAPAPQPQHPLSPMGEACSRMDMTAIHQILVATHYRDDEGTNELSFQEWTQQMRDMLDARKRGDFAFRDKDFKTAIECYTQFVDVGTMVSPTVYARRSLCHLMSDQPDAALRDAMQAQCVYPDWPTAFYMQAVALSKLNMQSDAMDMLNEASQLEEKRQERLWSKDASAQSPLRLKGLC

SEQ ID NO: 41612 - protein, 250 aa, Triticum aestivum
  misc_feature (66)..(66): Xaa can be any naturally occurring amino acid
  misc_feature (93)..(93): Xaa can be any naturally occurring amino acid
  unsure (1)..(250): unsure at all Xaa locations
MPASIAFGRFDDSFSLASFKAYIAEFISTLIFVFAGVGSAIAYSKVSGGAPLDPSGLIAVAICHGXFGLFVAVAVGANISGGHVNPAVTFGLXALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWIYWAGPLIGGGLAGVVYRYLYMCDDHTAVAGNDY

SEQ ID NO: 41613 - protein, 402 aa, Synechococcus sp. CC9605
MTEPTLSEITAKIRDSETGPFYLIDFDGIENSIMRLKSAFDADFKKVRLAYSFKTNSLQAITTFMHSKSMGAEVVSGQELEWALSDNFEPNNIYFDGPVKSKKEHKRAAELNVNIQVDSVQELIDLLEITSDPSKLKVGARLSMPYKNKINSRFGLTRSEFKEATTIMKRTGISFSGLHLHSGSNITNINQYRESIMSCIDCITETWHELSWIDFGGGFPANTALANESEELPTPEAFSSCIKSIISKKNLSLNNKTVVIEPGRCLVEDNGLLLARVEQIKKREDRNIVVTNAGLNLVKSMHSWYHPVIFLRQEIDEEQSTPYEVYGCNCFESDLIIDELEGPPSDLRIGDWIAIGSTGGYDMQNFNAWTQPYPSIYGSSREGIKKLSGCLSPRQMRQNQHR

SEQ ID NO: 41614 - protein, 464 aa, Arabidopsis thaliana
MDRYKLIKEVGDGTFGSVWRAINKQTGEVVAIKKMKKKYYSWDECINLREVKSLRRMNHPNIVKLKEVIRENDILYFVFEYMECNLYQLMKDRQKLFAEADIKNWCFQVFQGLSYMHQRGYFHRDLKPENLLVSKDIIKIADFGLAREVNSSPPFTEYVSTRWYRAPEVLLQSYVYTSKVDMWAMGAIMAELLSLRPIFPGASEADEIYKICSVIGTPTEETWLEGLNLANTINYQFPQLPGVPLSSLMPSASEDAINLIERLCSWDPSSRPTAAEVLQHPFFQSCFYVPPSLRPKPSVARTPPPVGPRGSFEHQSVKRYPVSLANAKPFNSYVSPKSNAAFGSGVQRKLDMVNQDGTRNTKPVRSSVRDSKYRPPGKKSPHNAAAASLNKNRVTRSSVSETADKLANMTIGATGSRRHSVSVVGQHQQLKPPPMKAGWVGETRDMFLRPTQPTTNAYSRKVAG

SEQ ID NO: 41615 - protein, 491 aa, Arabidopsis thaliana
MDPCSFVRIIVGNLAVRFPSSSSSSSSSSGPSVSGINPTSPNCYCKIRFKNFPREIVSVPVMFRTESESETRCSSSGNVSTVAACFSLSKAQIEASLKKPKFSVLSVEAYSRGNSDGDDGVSGASCGLATAGEKLLGRFEVSLDLKSAETKSFLAHNGWVALPSKKTKSKTGSDPELHVSVRVEPDPRFVFQFDGEPECSPQVFQVQGNTKQAVFTCKFGSRNSNSGDRNLLHSSSMMSEISSTRSCISSMNSEKEQPSKERKGWSITVHDLSGSPVAMASMVTPFVPSPGSNRVTRSSPGAWLILRPDGCTWKPWGRLEAWREAGYSDTLGYRFELFQDGIATAVSASSSISLKNGGSFVIDVTGGTSTTASTPTTSPQGSWDLGSGSSAGSRPASRPGSGSGSDFGYLLPQHPSAAAQNRGFVMSATVEGVGKRSKPEVEVGVTHVTCTEDAAAHVALAAAVDLSLDACRLFSHKLRKELRQQSQLGVV

SEQ ID NO: 41616 - protein, 294 aa, Bartonella quintana str. Toulouse
MLKGAVTALITPFDDNGAIDEKAFCNFVEWQITQGINGVSPVGTTGESPTLSHEERKQVVELCVEQVAKRVPVVAGAGSNSTSEAVELAQHAEKAGADAILVVTPYYNKPNQKGLYTHFSSIAKAISIPVIIYNIPGRSVIDMAVETMRDLCQDFKNIIGVKDATSKIGRVSEQREKCGKDFIQLSGDDCIALGFNAHGGVGCISVSSNVAPKLCAELHAACFRGDYETALKLNDLLMPLNRAVFIEPSPAGIKYAAAKLGLCGSLVRSPIVPLAETTKKIIDAALHHAGLLKE

SEQ ID NO: 41617 - protein, 151 aa, Synechococcus sp. CC9605
MAERTFIAIKPDGVQRGLVGEILGRFERKGFKLVGLKQITPSRALAEQHYGVHKERPFFAGLVDFITSGPVVAMVWEGDGVIASARKLIGATKPLEAEPGTIRGDLAVNIGRNVIHGSDAAETAQFEIGLWFQASELNDWSPSDQGWRVEG

SEQ ID NO: 41618 - protein, 175 aa, Brassica napus
MASLYNQAPSVSAVFSLYTSFSAIMMLFRTIFNDIVPKRIQDHITGKVVDFFFSSYLPSRFTFVIEKEWDSVENITFRAAEVYLPTLLSGLSTGKIVVGSSNLKNPEAQPKLGIPIDINITDEFEGIHLEWTLHSVETKNSPYEKRFFHLTCEKEFRKKIMTEYFTYLTKSADNI

SEQ ID NO: 41619 - protein, 241 aa, Thermoplasma acidophilum DSM 1728
MADYEKQKMNAAIKAAEYVRSGMIVGLGTGTTSYYLINEIGRRVREEGLKIRAVCTSRRTEDLAKQNGIEVIQGTKDQIDLTIDGADQVGMYGTLIKGGGGALLREKIVAYNSKEMYVIVDSRKIEAAHFGSFPLPVEIVPFMHMRTLENLRGICTQTDLRMNEKGEPFVTDNGNYIADMHMGMIDDPINLERSLKSIPGVVEVGLFNGIAKRIFEGTDEGCNIYSITNSGIKKEEVYFDP

SEQ ID NO: 41620 - protein, 404 aa, Frankia sp. EAN1pec
MGGSVSAWSGRDSHPHVPACSLEPRAVQARDVVRPSSRAGHGPAPPGRPPPRQAPRKRPMRATYMYGAGDVRITDVGDPVLEQPTDALVRVVLACICGSDLHPYHSLAATPAGVPMGHEFIGVVEEVGGEVSTLRAGDLVIAPFAWSDGTCEFCREGLHTSCRTGGFFAAGGVGGGQAEAIRVPQADGTLVKVPVPEDSAILPSLLTLSDVFGTGYHAAVRAGVNPRTTVTVIGDGAVGLMAVLSARRLGAEQIILMGRHKARTDLGLEFGATDVVAERGEEGVARVRELTGGDGSHAVLEAVGYRAAYDQALGVVRPGGVISRVGVPQYADAPIGFPSLFGRNITLTGGPAPVRAYIETLLPAVLDGEVEPGKVFDRTVSLEDVPAGYRAMDDRKALKVLVRP

SEQ ID NO: 41621 - protein, 257 aa, Thermoplasma acidophilum DSM 1728
MLNIIGVGLRGTGSITFDEFDALRTSDFVYADMYTSIGQPGLIRKISAMIDRDILPLTRDEIENGSILPQAASKNVSLIVVGDPLMATTHNELRYEAMNQGIGVRIFENASILNAAIGKAGLMVYKVAPPVSLPRISEKFFPLSVIDKIKRNADLGLHTPVLIDLEDQENIPLHDALASLLEMERRREYSGIIREICVLSRISFPDEKILFGRIEDMMQQEVNSPYMMFILSKLDDNERRFLSLFSESVSKVSDARS

SEQ ID NO: 41622 - protein, 136 aa, Flavobacteria bacterium BBFL7
MKNKQNDVILFDGVCNLCNGAVTFIIKRDRKNHFRFAALESDIATLYLKKHKINPNEIDSIVLIRGERAYTKASAALRIAQKMSGLWPLLYVFAIFPKFISNAIYDYIARNRYKWFGKQESCMIPTEELRDKFLHK

SEQ ID NO: 41623 - protein, 886 aa, Thermoplasma acidophilum DSM 1728
MAQIEKFVYRFDEGGKEMVDLLGGKGAGLAEMTKIGLNVPPGFTITTKACIAFLKHGGFPEGMMDQVMQALHDLENKVGRVFGDEKNPLLVSVRSGAPVSMPGMMDTVLNVGLNDSTVEGLAFMTDNRRFAMDAYRRLIQMFGEIVYGLPHEEFREKIEEVKRMRGYDEDRFTVQDLQGLIDQYTVIYRKHGKIFPQDPETQLVESIKSVFNSWNSKRAVAYRKMNGIPDDMGTAVSIVAMVFGNMGDDSATGVAFTRDPNTGEKKVFAEYLTNAQGEDVVAGIRTPKYIDDMQNEMPQVYADLMKTCDILEHHYRDMQDIEFTVERGKLYLLQTRTGKRSAKAAIRIAIDMVDEGIISEEEALMRITPATFDRTMHPQVKTTGREIPLGKGLAASPGAASGMIVFSSERALEIGKSKKMILVRPETTADDVRGMAVCEGFLTQKGGMTSHAAVVARAMGKPAVVGVESMSVNANEKTLTIGGKKLREGDVVTIDGTSGYFYEGELPVEKPTVDDYSKRLLEIADKYRRLGVRANANTPEEAKIARENGAEGIGLARTERMFLGNDRIGIMRSMIMSETPEDRKKYLDQLLPMQIHDFVEFFRTMEGYPVIIRLLDPPLHEFLPNKEDIIRQIYDVNNGKGKIEDLPYLEKLLKTVRDLEEFNPMLGFRGCRVGLVYPEIYDMQVRAIIEAAAKVIEEGREIYPEIMIPLVGHHNELRKIRARLEETAKSVRNHEKVKYKFGTMIEIPRACVTADKIAQYADFFSFGTNDLTQMTFGYSRDDAEGKFMFFYLENGILESDPFSSVDRDGVGELMKMAVERGKRAKPDLEVGICGEQGGDPDTIEFCDEIGLDYVSASPHRIPVARLAAARSSIARNRPEMTQISKY

SEQ ID NO: 41624 - protein, 457 aa, Oryza sativa (indica cultivar-group)
MIRVVSPPPPSAVQLRGGGGTPGPSSSSAVCRFWGSRRGSRVAATSSWGWGKSRRRRRAAISCCSAEEGEGPRVATPSAPPAPSEGSIQLYSQIERVITEAAKQSREGWGSTGDWTEIEGAWVLKPKSQEPSFVVHFVGGIFVGAAPQITYRFFLERLADKGALVIATPYASGFDHFFIADEVQFKFDRCLRNMVEPVNDLPTFGVGHSLGSVIHLLIGSRYAVQRSGNILMAFNNKEASLAVPLFSPVIVPMAQSFGPIFSQLTSYPTLRFGAEAAIKQLENLSPPVVKQLLPLVQQLPPLYMDLVKGREEFVPKPEETRRLVKSYYGISRNLLIKFKDDQIDETSILAQVLSSESAISSLLDMSIRSLPGDHGLPLQQVLPDVPPAMADAVNRGSELLTNLATGTPWEAVAKEVGSTLGADSGVLRAQISKDVNTLVDVIVSWIESNSGPRLLRS

SEQ ID NO: 41625 - protein, 297 aa, Fulvimarina pelagi HTCC2506
RQPEKLVILGGGYIAVEFANIFLGLGTDVTLVYRGQEILQGFDDDLRKSLHEQMSAKGMSVRCRETFQEVRQKPGGGFEAELDNGEVLDADEILLAIGRKPNTENLGCEKAGVELDQRGAVKVDDYSRTNVENIYAVGDITNRLQLTPVAIHEAMCFVETVFKNNAKKPDYESVPTAVFSQPEIGTVGLTEAEAARRFDEVAIYKTDFKPMKHTLSGRNERTVMKIVVDQATERVLGVHILGSDAAEIAQVLGIAVKAGLTKSHFDETMALHPSGAEELVTMYEPTYVLRKGERIAA

SEQ ID NO: 41626 - protein, 419 aa, Capsicum annuum
MAFSSLLKPTASLVRPSHRSQASCVGLQHSSNSVKLQSAIFGDVVSIAQSSSLQNSGACSIQPIRATATELPPTVPKSQTGGKTRVGINGFGRIGRLVLRIATFRDDIEVVAVNDPFIDAKYMAYMLKYDSTHGVFRGSISVLDDTTLEINGKQIKVSSKRDPADIPWGDLGADYVVESSGIFTTVDRASGHKKGGAKKVVISAPSADAPMFVVGVNEKTYKANMDVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRLNKSASYDDVKAAIKYASEGPLKGILGYTNEDVVSNDFVGDSRSSIFDAKAGIGLSKSFMKLVSWYDNEWGYSTRVLDLIEHMALVAATS

SEQ ID NO: 41627 - protein, 131 aa, Flavobacteria bacterium BBFL7
MKKIIYTDLAPNPIGPYNQAVLVDTPHQKTLYTSGQIAINPSTGELKIDDLKEETGLVMQHLESLLKQVDMTFENVIKSSIFLSDMGNFATVNEVYGSYFNESTAPARETVEVANLPKYVNVEISVIAMTF

SEQ ID NO: 41628 - protein, 175 aa, Triticum aestivum
  misc_feature (49)..(49): Xaa can be any naturally occurring amino acid
  unsure (1)..(175): unsure at all Xaa locations
MAPTVMASWATSIAPFQGLKSTTGLPVTRRSKGDSLGRVSHGGRIRCMXVWPIEGIKKLETLSYLPPLSTEALLKQVEYLIRSKWVPCLEFSKVGFIFREHNASPGYYDGRYWTMWKLPMFGGTDATQVINEVEEVKKEYPDAYVRIIGFDNMRQVQCVSFIAFKPPGFEESGKA

SEQ ID NO: 41629 - protein, 336 aa, Medicago truncatula
MATELEELVSFLSSPSPQITKAAVDIVRGLTGSEEGIHSLANQSKNLISALSRLLTAPEEVSEAAAEALVNLSQNSNLAEEMVKLKLVETTMDVLYKPECCVTRLLVMLLVNLTQLDAGTDSLLQIDDEKVRGLYVMKLVRSFCRTTHEKDDDSFEHVGSILVNITKQRAGRELLLDPKRGLLKQIIRQFDSNSSLRKKGVSGTIRNCCFEAENQLQNLLLVSEFLWPALLLPVAGNKIYSEEDRKKMPLELGTALSIEREPVNDPEIRTQVLEAIYLILLQEAGRRAFWSVNGPRIVQVGYEDEEDPKVMGAYEQLGSLLINGSGMEEPSTETRE

SEQ ID NO: 41630 - protein, 281 aa, Ustilago maydis 521
MEQKDNANPIVYQSSSRLTQRRSSSSANAEWWRDQSIHSSAQSAGRPSASSSSIAGIGAVGSSAISSNNFAASFARATRSTIDQDDDEELEDEADDSDDDVEMSRRSGTPATSPEIECAAPHTKAVATSMDEEIDSQEIYDLIRSITDPEHPLTLEQLAVVNASHITVSHGDAAANKLPHVLLEFTPTIPHCSMATLIGLSLRVRLLRALPDRFKVDIRVRPGTHQSENAVNKQLNDKERVAAALENSHLFNGEEEKVPMRSQHTSVGLRAAMAKRTRIIS

SEQ ID NO: 41631 - protein, 120 aa, Phaeodactylum tricornutum
MLKLKTQKVIDAIESKFIKKDLPTLKIGDNVRIGVKIIEGTKERVQFYEGTIIAKKNSSINMTITVRKILQGIGIERVFLVHSPKIDSITVLRSSKVRRAKLYYLRNLRGKASRLKQTFK

SEQ ID NO: 41632 - protein, 528 aa, Photobacterium profundum SS9
MFFNLEGLLPEAIESIEEQTERAYQQYQKFDKDMDKHIYLRNIQDTNETLFYRLVENHITEMMPIIYTPTVGAACEDFSNIYRRGRGLFISYPNRDRIEDMLNNASRQNVKVIVVTDGERILGLGDQGIGGMGIPIGKLALYTACGGISPAYTLPVVLDVGTNNPQRLSDPMYMGWRHTRISGQEYDNFVDEFIQAVKRRWPDALIQFEDFAQKNAMPLLERYKNKICCFNDDIQGTAAVTVGSLLAACKAAKSKLSEQRISFLGAGSAGCGIAEAIIAQMVSEGISEAQARSQVFMVDRWGLLIDDMPNLLNFQQALVQKRDTVNEWDLADNNVSLLDVMRNAKPTVLIGVSGVPGLFSEDVIREMHAHCKRPIVFPLSNPTSRVEATPADIINWTDGNALVATGSPFEPVVHNGKTYPIAQCNNSYIFPGIGLGILAVNARRVTDEMLMASSRALAECSPLAINGHGALLPPLEDIQKVSRKIAFAVAKKAIEQGKAPKNSDERILDKIDANFWQSDYRNYKRTSF

SEQ ID NO: 41633 - protein, 323 aa, Vibrio vulnificus YJ016
MTLSFDYRAVAKQVLATEIRGLEQLSQYFDEQFEQACELILNNAGKVVVMGMGKSGHIGKKIAASLASTGTSSFFVHPGEASHGDLGMIERGDIVLAISNSGESSEILALFPVLKRLGIRIISMTGKPSSTMAKLADYHLQITVPEEACPLGLAPTTSTTATLVMGDAMAVALLQARGFTAEDFALSHPGGALGRKLLLKLNDIMHTDEQLPRVSPNALVRDALLEISQKGLGMTAIVDQDNLLLGIFTDGDLRRILDKRVDIHSAQIGEVMTKHPTVANPSMLAVEGLNLMQQKKINGLMLCQDGKLVGALNMHDLLKAGVM

SEQ ID NO: 41634 - protein, 394 aa, Methanosarcina acetivorans C2A
MFSINSECILSKQSEDIPPFYVMEVLESAKELEAQGRHIIHLEVGEPDFPTAPHICEAACAAIGKGLTKYTHSQGLPALREAIAESYYRKFGVDLDPNQVIVTSGTSPGLLMVFMALLEKRDEVIMSNPHYACYPNFVKYLGGTPVFVYTSEANGFALEPETVRQCLSPNTKAILINSPSNPGGHVMSPDTLQGLAAIADEKGIPVVSDEIYQGLIYSGEEHSILEYTKNAFVLNGFSKLYAMTGWRLGYIICPPGCVRAIQKIHQNFFICANSFVQEAGIAALKGSQEHVVEMVQIYNMRRQYMLKRLLGMGLEVRKEPMGAFYVLADARKFGNDSLELSRSILNEAGVAVTPGVDFGNGAEGYLRFSYANSLENIAEGMDRLEAFLEKELDG

SEQ ID NO: 41635 - protein, 640 aa, Corynebacterium glutamicum
MCGLLGILTANGNAEAFVPALERALPCMRHRGPDDAGTWHDADAAFGFNRLSIIDIAHSHQPLRWGPADEPDRYAMTFNGEIYNYVELRKELSDLGYTFNTSGDGEPIVVGFHHWGESVVEHLRGMFGIAIWDTKEKSLFLARDQFGIKPLFYATTEHGTVFSSEKKTILEMAEEMNLDLGLDKRTIEHYVDLQYVPEPDTLHAQISRLESGCTATVRPGGKLEQKRYFKPQFPVQKVVKGKEQDLFDRIAQVLEDSVEKHMRADVTVGSFLSGGIDSTAIAPLAKRHNPDLLTFTTGFEREGYSEVDVAAESAAAIGAEHIVKIVSPEEYANAIPKIMWYLDDPVADPSLVPLYFVAAEARKHVKVVLSGEGADELFGGYTIYKEPLSLAPFEKIPSPLRKGLGKLSKVLPDGMKGKSLLERGSMTMEERYYGNARSFNFEQMQRVIPWAKREWDHREVTAPIYAQSRNFDPVARMQHLDLFTWMRGDILVKADKINMANSLELRVPFLDKEVFKVAETIPYDLKIANGTTKYALRRALEQIVPPHVLHRKKLGFPVPMRHWLAGDELFGWAQDTIKESGTEDIFNKQAVLDMLNEHRDGVSDHSRRLWTVLSFMVWHGIFVENRIDPQIEDRSYPVEL

SEQ ID NO: 41636 - protein, 466 aa, Pseudomonas fluorescens Pf-5
MDQTLKQGELKRGLKNRHIQLIALGGAIGTGLFLGSAGVLKSAGPSMILGYAIAGFIAFLIMRQLGEMIVEEPVAGSFSHFAHKYWGGYFGFLAGWNYWVLYVLVGMAELTAVGKYVQFWWPEIPTWVSAAVFFVLVNLINMMNVKFFGEAEFWFAIIKVVAIVGMIVLGCYMLFSGSGGSQASVSNLWSHGGFFPNGGTGLLMAMAFIMFSFGGLELVGITAAEAAEPRKVIPKAINQVVYRVLIFYVGALAVLLSLYPWDELLVSLNAGGDAYSSSPFVKIFSLIGSDAAAQILNFVVLTAALSVYNSGVYCNSRMLYGLAEQGDAPKALMKLNKQGVPILALGISALITLLCVLVNYLAPHEALELLFALVVAALMINWALISLTHLRFRKAMAEQGVVPSFKAFWSPLSNYLCLAFMVMIVGVMWMIPGIRASVYAIPVWVLVIWGFYLLSRAKKASQPALR

SEQ ID NO: 41637 - protein, 389 aa, Gibberella zeae PH-1
MSFTSIPILDLAAAQDPATKPQFLTELRHALMEVGFLYLKNVGIEDELFQKVIQLGKGFFDIPEQEKLKIEMKNAPSFLGYSRLSAEITAGEVDHREQIDLSTEHPVPEPGAPLYRNLLAPNQWPSEDSLPEFRNVYTEYMERMGKISIQFTSLIAEAIELPSDAFNKYFDEDQQHKLKIVKYPDAKELGIQGDAQGQGVGPHKDSMLSSYLLQATSHKGLQVQNVRGEWIDCEPIPGTLVVAIGQGLEALTQGVCVSTTHRVLSPAAGSGARFSIPFFQGVRMSAEFEDLEKVGVGLVPEEVREQRRQIVERNGGRIDDVEFTFRAGGVSKTLGEATLRNRVKSHPDVGERWYPDILASIREEQAKAKQQKESTVPAVEVPPKAVEAH

SEQ ID NO: 41638 - protein, 263 aa, Campylobacter coli RM2228
MKFLAVIGDPISHSKSPRIHNNAIQALKLDGIYTRYHLQDYHQLRQDFFKLKLQGANITLPFKEAALEMADVKDELASNIGSANTLCLKDGKIYAYNTDALGFLEAIKEFESINKALILGAGGTALALAFALKQKGVEVCVVNRSEKRFKDFTLYKTSLYDALDDFDFDLVINSTSAGLKDDDLPCDKILLDKILSRAKFAFDVIYGKETSFLKLCKEHNLKVKDGFDMLLWQAVFAFELFFDVKDKREKIKNAMQEALKLEF

SEQ ID NO: 41639 - protein, 363 aa, Ashbya gossypii ATCC 10895
MSEVSVKEYISQQEALERQAREAMPGDPTKCTYSMGPLRQPIFACRTCGDIGVCYSCSIQCHTECDLVELFEKRQFSCDCGTERQKSAEKTCKLRENSTADIPDYSNRYGQNFKGLFCWCAREYSPEKDAVMVQCLLGLECNEDWYHDHCIMGVRDDPDSADAERELPGFPALDTFAAFICWNCVHKYEMQFKRLLAHELADQLIADTVDWIPTDTPAERAALSDADRAMPGAAGSKRKAADQIYSIFLKEGYSAVLERVRDSLPPGDKLRIFLTDIAPFLIHEDPVYEPPEDSDPVSSYEAASRALDMVSHERALNGILAYQAFKTKLSEFLQPFADTGKVVKEEDIKSFFQAQKEPPEDSS

SEQ ID NO: 41640 - protein, 392 aa, Gibberella zeae PH-1
MAAPRNQLAAASWRALAKYQSCPRLRTQPHIAMTSCSRSKLYSTSPDTSRFSYHVASSFIAKDRPYDPSSHVFHFNPYNRIQPPRNRRPSARPESGHDAFFVSRVNDSGSVAFGVADGVGGWVDSGVDPADFSHGFCDYMALAAHEHQTSSEPPLTARQLMQKGYEAICNDRSLRAGGSTACVAIAGADGNLEVANLGDSGFLQLRLNGVHTYSEPQTHAFNTPFQLSLVPPSVAARMAAFGGAQLSDLPRDADVTQHALRHGDIIVLATDGVLDNLFNQDILRIASRVLVSSGAWVMTEAGGVRMAESLEPLVELPDNSEGKRTVTLQSALATELVTAAKRASVNTKVDGPFAKEVHKYYPHENWHGGKVDDICVVVAVVNEIASAAKSKL

SEQ ID NO: 41641 - protein, 290 aa, Synechocystis sp. PCC 6803
MATSRTQRDVWVYVGIGAMVSALVLFSLVPLVMGLWQPRPAADGVVNGGTPLESQALGYQLVLEREPDNVNALQGLLEIRLQQKNLAAAIAPLERLGQIRTDQVQYRILLAQLKTQLEDNAGAAKVYREILTQSPHNIQALKGLSGLYAQQERPAEAVAIVQNAITQAIKAQTGAPGTVPPDQLTSLQLLLGEIYLSQNRPDQAIAIYEAASKVNGNDFRPVLAQAQVMAQTGKVKEADPFFQQAIMLAPVQYKDPIKNIALQVTNQALANQNGAPETSIPSPAPILKSE

SEQ ID NO: 41642 - protein, 515 aa, Methanocaldococcus jannaschii
MCGINGIIRFGKEVIKEEINKMNKAIKHRGPDDEGIFIYNFKNYSIGLGHVRLAILDLSEKGHQPMGYNVDEDKIIYRDDELDRADIIIVYNGEIYNYLELKEKFNLETETGTDTEVILKLYNKLGFDCVKEFNGMWAFCIFDKKKGLIFCSRDRLGVKPFYYYWDGNEFIFSSELKGILAVKEINKKENINKDAVELYFALGFIPSPYSIYKNTFKLEARQNLIFDLDKREIRKYYYWELPDYKPIYDKKKLIEEGKKLLYDAVKIRMRSDVPVGAFLSGGLDSSTVVGVMREFTDLSKLHTFSIGFEGKYDETPYIKIVVDYFKTQHHHYYFKERDFEELIDKYSWIYDEPFGDYSGFPTYKVSEMARKFVTVVLSGDGGDEVFGGYMTHLNGYRMDFIRKLPKFLRVVGSKLPVKKDLNGIANLYLLKEAFRLSLINPEEFYAESIKEDAIRPEIYKKWTIEKLRYCLNKGDNKLGEALRIFDLLFNTLCDNFLVKVDRASMLTLWKLEVHF

SEQ ID NO: 41643 - protein, 229 aa, Glycine max
  misc_feature (204)..(204): Xaa can be any naturally occurring amino acid
  misc_feature (206)..(206): Xaa can be any naturally occurring amino acid
  unsure (1)..(229): unsure at all Xaa locations
MWMILLRKRQVVVVVVLSLLQCSVRVDSVFCFSVQVVVHKNSPRETHFRRAGPRQKVYFESEDVYACIVTCGGLCPGVNTVIREIVCGLYHMYGVHKVLGIEGGYRGFYSCNTIPLTPKVVNDIHKRGGTILGTSQGEGGNDTLKIVDSIQDRGINQVYILGGDGTQRGASVIFEEIRRRGLKGSVVGIPESVDNDIPVIDKSXFXFDTAGEEAQRAINAAHVEAESTE

SEQ ID NO: 41644 - protein, 214 aa, Oryza sativa (indica cultivar-group)
MADVNCRCSRVVYVGNIAFHATEAELRDACELIGPVRSLRLAALDPATNKRKGYAFVEYADDETARSALRNLHGHLLRGRELRVGLAARPSIRRRGGGGGGEREPVGMEDAVHAASLVVSGRPLASVTRYLAARSRQEVREMVAALEATEQLKIPGLGTAMEQAQRLLEMFTADEEEVARKKLKRASDEEHAKQSKVVGVDGVVKASSRIVPCF

SEQ ID NO: 41645 - protein, 263 aa, Corynebacterium glutamicum
MLFAFGLTLFAGLATGIGGLIAVARKTVTEGFLAGSLGFSVGVMLYVSFVEILPGAFDELTSVWGEKGGSWAAVIGFFGGIALIAIIDRLVPTAINPHEPSTVGGAVEGFERRNRMMKMGVLTALAIAIHNFPEGFATFLAGLSDPMIAIPVAVAIAIHNIPEGIAVAVPLREATGSRRKALGWATLSGLAEPAGALIGFLLLMPFIGPEALGLCFAAVAGVMVFISVDELLPTAISSGKHHTAIYGLIAGMAVMAISLLLFI

SEQ ID NO: 41646 - protein, 347 aa, Prochlorococcus marinus str. MIT 9312
MKDSNSKEIDSITSEKEINIDNFSRDELLEMLSKMILIRNAEYKIAKGREFGLVGGPVHLGVGQEAIPVGISQYLNNQDKVFGAHRSHSHILSLGIDLKSFFSEILAKSSGISKGMGGSMHLFGGSVGFCGSVPIVGGTVPLAVGTALASKLKEEKVVSISYLGDGAIEEGIVHESLNFARINNCPVIFVVENNLFSSHLNIKLRQPKKLTYRFAKANDIESKVLDGNNLTSICKTGKEFIRRCRDGEGPFFIEALTYRWFGHVDWREDIDVGINRSADDLKYWKKRDPILRLKKSLLKENYFGENHLINLEKDIQKDIDNAWVDALGESSPEWNESLDYVFKSNYK

SEQ ID NO: 41647 - protein, 329 aa, Prochlorococcus marinus str. MIT 9312
MKKFTYSTAILDAYNFLLKNYPEVFVIGQGLWSPWYVGNTMKDLDKNFGKKRIIDTPVSEAAVTGAAVGASLNEMKPIVVHPRMDFMMYAMDPIINQAAKWSYMFGGQSSPSITIRGIINRGGEQGAQHSQALHSLFAHIPGLKVVLPSSVADARDLLIASVLADQPVIYIDDRWLYDQEDQLPEAKEINLESINPCILREGNSITLVGCSYSTFLLKQITKKLIKNKINPEIIDMRIINPFHSELITNSVKKTGRLFVLDGGWGPCGISSEIISSAVENVEPKFFKSKPARLTLPFTPAPTSKVLEKEYYPNEKKILNKIFKIFENNL

SEQ ID NO: 41648 - protein, 196 aa, Synechocystis sp. PCC 6803
MSHSTDLSALARWMAADFSNQAQAFENPPFYAHIRVAIRPLDQAKFGDRLLFLEQAYDFMLQRPYRLRVLKLKVVEDHIEIENFKVKDEEKFYGAARDLGKLAQLTPADLEPMHGCDMIVEWTGTSFKGEVQPGRQCRVMRDGKETYLENSFEVSETGLISLDRGYDPETNERVWGSVAGAFHFVRWQSFADEVSF

SEQ ID NO: 41649 - protein, 273 aa, Synechococcus sp. WH 7805
MRFRPLLALVLAFCLTVVTACSGGAQAVERSNVTYDDIRNTGKANDCPTLSDSARGSIALTPGADYELRGICMHPTQVFVKGEPANKRQEAQFVEGKILTRYTSSLDEVYGTLEVGEDSLTFTEEGGIDFQPITVLIPGGEEFPFTFSSKSLSASANGAAITTSTDFDGTYRTPSYRTSNFIDPKGRALTTGVDYPQGLIGLGGDYKELETENVKRYIDGQGVMSMSITKVDPETGEFAGVFSAIQPSDSDMGGREIVDVKINGELYGRLEEA

SEQ ID NO: 41650 - protein, 494 aa, Pseudomonas fluorescens Pf-5
MRRPGQRHKDGPSQRFIRAHNNKEALKVTTSNKGFEAISNREHGLRRQLTAGQMSMIAIGGAIGTGLFMGSAYAIGYAGPSVLLSYAIGALITLILMGCLAEMTVAHSTSGSFGAYAEFYVSPLAGFLVRYAYWAAIVLAVGAEVTAIAMYMKYWFANVPEWVWIISFSSVLIVLNGISVKTFGNFEYWFSTIKIAAIVGFIILAVYVVFGSGNPDYGLHNYSAHGGFFPNGFEGMWIAVIVSIFSYLSVEMIAVAAGEAKDPQRAVKQAFRATIVRLVVFYLLTLALMLAIVPWAQAGKAQSPFVTVMQTIGIPGATGVMNFVILIAALSAMNSQLYITTRMMFSLSRAGYAPKSMGALSKNGIPLNALLLSSSGIALATLVNVLYPESSFTLMMAISMFGAIFTWFMIFLTHYCFRRYHQRHGEQQLSFRMRLFPYSTLLGLVLMGAVMITTFFTEAFKMTLVFGVPFLLLLTLVYYLCFRKPRVVAGLSEV

SEQ ID NO: 41651 - protein, 497 aa, Synechococcus sp. WH 7805
MAGERFYLELEPPEERLRHAPHVVIVGGGFAGVRACKALANADVRISLIDKRNFNLFQPLLYQVATGLVSRGDVATPLRQMVGRQRNVQVLLGEVTQINPEGQQIVFNGKAYGYDYLVLATGSGSTFFGHENWRTFAPPMKILEHAEEIRRRLLMAMEQAEQTPDPEARRFLQTVVIVGGGPTGCEMAGATSELMRNAMRREFRQLNPSDTRIVLVDPGDRVLRAMPESLSQAAQETLEALGVEMLFKGRVQTMQPGEVTVGTPDGDRRLQAATVIWTAGVRPSHLGKKLADAIGCETDRSGRVIVAPDFSVPGHPEIRVVGDLCSYKHTRDGNPLPGMAGPATQAGGFVGKDIAAVVSGRSRPTFSWFDFGSMAVLDRVDAVADLRGFKFKGGIGWLLWAAAHLAFMPDRENRYTLLIKWIFAVVSQSRASMLLTGMPSQHMGLDAPDAAFPMQSGSGPSIAEPGAALRAAMDYYSNQVSGLPTQSGSGDSAAAIK

SEQ ID NO: 41652 - protein, 338 aa, Solanum tuberosum
MANGKIKIGINGFGRIGRLVARVALQRDDVELVAVNDPFISTDYMTYMFKYDSVHGQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPSLNGKLTGMAFRVPTADVSVVDLTVRLEKEASYEDIKAAIKEESEGKLKGILGYTEDDVVSTDFVGDSRSSIFDAKAGIALSKNFVKLVSWYDNEWGYSSRVIDLICHMAKA

SEQ ID NO: 41653 - protein, 428 aa, Staphylococcus aureus subsp. aureus Mu50
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGDDIAGVIVEPVAGNMGVVPPIEGFLQGLRDITTEYGALLIFDEVMTGFRVGYHCAQGYFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFEQANKSDLKLFAEMYREMAKEGVFLPPSQFEGTFLSTAHTKEDIEKTIQAFDTALSRIVK

SEQ ID NO: 41654 - protein, 116 aa, Haemophilus somnus 2336
MVEETIFSKIIRKEIPANIVYQDELVTAFRDISPQAPTHILIIPNKIIPTVNDVTSEDEVTLGRLFTVAAKLAEKEGIAQDGYRLIVNCNKHGGQEVYHLHMHLVGGEHLGKMLAK

SEQ ID NO: 41655 - protein, 746 aa, Porphyromonas gingivalis W83
MTIHDNTLFSADERSRFLSSYASLIRTLAPDRQLVKKVRSLLSRFTELGCFDRDKNGMHGLLRNMEVARIASCEIGLGIEAIGALLFYRPAMKGLTRPEEIAELMGEDVARLIDLLLKTSEIYMRNTAINTANFEHFLLSIAEDIRVVLLIIADRSYLLRQAKDMVCAEERTALAAEVSYLYAPLAHRLGLYAIKSEMEDLCLKYTDRQTFDFIKRKLGETKRSRDAYIEAFIAPLRRRLDEALPNIPYEMKGRTKSINSIRNKLRQQGIEFESIYDLFAIRIILDVPVKDEKAACWHVYSIITDMYQPNPQRMKDWISIPKSNGYESLHVTVMGPQNRWVEVQIRSRRMDEVAERGLAAHWKYKGIKSESGLDEFLTSVRETLEARDHSSDDSAETVKNFKMNLFTDEIYAFTPTGELIKLPQGASVLDFAFAIHSRIGCQAVGANVNGKNVPLKHKLENGDSVSIITSAQQTPKKDWLSYVVSSKARNKIKQQLRLQMESSIGVVKELLNRRLKNRKLPFEEAVFTRVVRRKGFKHLTDFYMEIAADRLDVQEVLELYSHELEEEQRRDAGSGAARRSADTFVAHPPKEEEIVKGGKSDVLVIDNNMTGVEYSFGKCCNPIYGDSVFGFVSNSGIKIHRTDCPNAPDMFSRYGYRIIEARWSGKGSTGYEATLHVIGQDNLAIVTNITSVINKEPGVSLRAYSINSKDNLFEGVFTVEVPDTSTLSILLRKIRATHGVKSAERH

SEQ ID NO: 41656 - protein, 374 aa, Crossosoma bigelovii
ALSIAGAVQSQKLAVRAISHLQSLPSGDIKLLCDTVVENVRELTGYDRVMVYKFHEDEHGEVVAESKRPDLVPYIGLHYPATDIPQASRFLFRQNRVRMIVDCNATPVKVIQDESLMQPLCLVGSTLRAPHGCHAQYMANMGSNASLAMAVIINGNEEEGVGGRSPMKLWGLVVCHHTSARCIPFPLRYACELLMQALGPQLNMELQLASQSSEKRVLRTQTLLCDMLLRDSPTGIVTQSPSIMDLVKCDGAALYYQGKYYPLGVTPTEPQIKDIVEWLLAFHGDSTGLSTDSLADAGYQGAATLGDAVCGMAVAYITKRDFLFWFRSHTAKEIKWGGAKHHPADKDDGQRMHPRSSFKAFLEVVKSRSLPWEN

SEQ ID NO: 41657 - protein, 723 aa, Oryza sativa (japonica cultivar-group)
MLCLIRFYLRGYAAADLGAWKNTRQQYSPSSPISLGSSVFSESSLELSTTTADGSTANAVLAAIVASIGNLLQGWDNAAIAGAIMYIKNEFNLQNDPMMEGLILAMSLIGATIITALSGMITNSIGKRPLLSVAAILYSISALIMFQASNEYMLLLARLIYGFGSGLVVTYAPLYISETAPTNMRGLLNTLPQFNGSLGMLLSYIMVFLMSLTLNPNWRIMLGSLSIPSFVFLLLCIFYLPESPVFLVSKGKIEEAKNVMKRLRGTNEVSSEIAFLIQGLTVDQDNYIEDYMIGHNNDEFDDQSISNTETTKLYGHEEGVTWFARPFKGKNVVESDHSPIPNLLDPIVTLFDSIHGNILNTPEFTSSGNMSNDIEQPKTDLESQEDLDTDYEDDLGHPLLFHQGSYMEGIDDACVNGGWHIAWKFVQRENEFGQTQDDFQQIFLQGDILQAGRVSHATALVSTPSFHHSIGPAMVHPSKFNLSTEGQSWSDLLQPGVKQGLIVGVTIQILQQLAGISGILYYTPQILEQAGAGILLKWFNVSSSSSSILTSALTTFTMLPSIGIAMKCMDRYGRRSLLLYTIPMLIVSLIILIVVNVMNLEAIFGAILSTFGVIIYVCCFVMGFGPIPNVLCSELFPPSCRNRCMSICTLTFWIVSIIVTYAFPVMLSSIGLIGVCGIYAVVCIVSFIFVLIKVPETKGMPLAVIANSLAVGARLSVKRNENI

SEQ ID NO: 41658 - protein, 476 aa, Ajellomyces capsulatus
MALNEAPTASPVAETAAGGKDVVTDAARRPNSEPKKVHITDTPITLANWHKHISWLNVTLIIAIPIYGLVQAYWVPLHLKTALWAVVYYFMTGLGITAGYHRLWAHCSYSATLPLKIYLAAVGGGAVEGSIRWWARGHRAHHRYTDTDKDPYSVRKGLLYSHIGWMVMKQNPKRIGRTEITDLNEDPVVVWQHRNYLKVVIFMGIVFPMLVSGLGWGDWFGGFIYAGILRIFFVQQATFCVNSLAHWLGDQPFDDRNSPRDHIVTALVTLGEGYHNFHHEFPSDYRNAIEWHQYDPTKWTIWIWKQLGLAYDLKQFRANEIEKGRVQQLQKKIDQRRAKLDWGIPLEQLPVIEWDDYVDQAKNGRGLIAIAGVVHDVTDFIKDHPGGKAMINSGIGKDATAMFNGGVYNHSNAAHNQLSTMRVGVIRGGCEVEIWKRAQKENKEVESVRDEYGNRIVRAGAQVTKIPEPITTADAA

SEQ ID NO: 41659 - protein, 205 aa, Brassica napus
AARRGGRELPMEDVCYYKWPLPGANKFGLFCVCDGHGGAGAAQSAVKIIPEVLVNILSDSLKKEKVLSQGDASDVLRDVLVKTEARLDDHQYEGCTATVLLVWKDSEEHLFAQCANLGDSACVINHDGRYIQMTEDHPVTSLTERRRIQEAGLSLRDKETGIFGINLARMLGDKFPKQQDGRVSAEAIYKVSLLRIDQSSKDAFA

SEQ ID NO: 41660 - protein, 274 aa, Synechocystis sp. PCC 6803
MRFRPSIVALLSVCFGLLTFLYSGSAFAVDKSQLTYDDIVNTGLANVCPEISSFTRGTIEVEPNTKYFVSDFCMEPQEYFVKEEPVNKRQKAEYVKGKVLTRQTTSLEQIRGSIAVGADGTLTFKEKDGIDFQPITVLLPGGEEVPFFFTVKNFTGTTEPGFTSINSSTDFVGDFNVPSYRGAGFLDPKARGLYTGYDNAVALPSAADKFRTNKKETPLGKGTLSLQVTQVDGSTGEIAGIFESEQPSDTDLGAKEPLDVKVRGIFYGRVDTDV

SEQ ID NO: 41661 - protein, 1095 aa, Oryza sativa (indica cultivar-group)
MSTRLELLVVFVFIVAPALAATKPSYIVYLGGRHSHGDDGGVISPEEAHRTAAESHYDLLGSVLGDREKARDAIFYLYTKNINGFAARLEAEEAAAVAERPGVVSVFPDRGRRMHTTRSWQFLGLERPDGSVPPWSPWEAARYGQNIIIGNLDSGVWPESLSFNDRELGPIPNYWKGACRNEHDKTFKCNSKLIGARYFNNGYAKVIGVPLNDTHKTPRDANGHGTHTLATAGGSAVRGAEAFGLGGGTARGGSPRARVAAYRVCYPPFNGSDACYDSDILAAFEAAIADGVHVISASVGADPNDYLEDAIAIGALHAVKAGITVVCSASNFGPDPGTVTNVAPWILTVAASTMDRAFPAHLVFNRNRVEGQSLSPTWLRGKTFYTMISAANAAVPGYPPADALLCELGALDGKKVMGKIVVCMRGGNPRVEKGEEVSRAGGAAMILVNDEASGNDVIADAHVLPAVHINHADGHALLAYINSTKGAKAFITRAKTVVGVKPAPVMAAFSSQGPNTVNPEILKVRNFSWRELDVAPRAHERRVAFNAQSGTSMSCPQVSGVAGLIKTLHPDWSPAAIKSAIMTTATELGNDMRPIMNSSMSPATPFSCGAGHVFPHRAMDPGLVYDLTVDDHLSFLCTIGYNATALALFNGAPFRCPDDPLDPLDFNYPSITAFDLAPAGPPATARRRVRNVGPPATYTAAVVREPEGVQVTVTPTTLTFESTGEVRTFWVKFAVRDPAPAANYAFGAIVWSDGNHQLDQEYSNSYQISYVYESSMSLTDKMRKLKELLHKSENRICADCSSPDPKWASANIGVFICLKCSGIHRSLGTHISKVLSVTLDEWTDDEINSMLEVGGNSYANAIYEAFLPGGYHKPHPDSSQEERADFIRSKYELQEFLKPSLRIVSNKSSLQAMDSRKDIGNASNSYSFKSEAGMVEFIGIIKVKVIRGTKLAVRDILSSDPYVVLTLGQQKAKTKVIKSNLNPVWNEVLTLSVPQKYGPLKLQVYDHDVLSRDDIMGEAEVDLQPMITAAMAFGDPGLLSDMQIGRWLMSRDNALARDSAVSVVGGRVKQEVSLRLQNVECGEVDLELEWIALNQ

SEQ ID NO: 41662 - protein, 323 aa, Prochlorococcus marinus str. AS9601
MNTVTELLQPVENDLDDLILELKNLIGAGHPILQAAAEHLFSAGGKRLRPGIVLLISKAISPEFCLTTKHKRLAEITEMIHTASLVHDDVVDEASTRRGVDTVHSRFNTRVAVLAGDFLFAQASWHLANLDNVNVVKLLSRVIMDLAEGEIKQNLNRFDSAQSFSKYINKSYCKTASLIANSCKAAGVLSGINDENLTSLYDFGKNIGLAFQVVDDILDFTGNDKQLGKPAVSDLASGYLTAPVLYALEENKQLSVLINRELAEKDDLDDALSIIMNSKAIESSRKLAEDFAILSKEAIVWLPDSEYKRALMALPEFVLSRIY

SEQ ID NO: 41663 - protein, 306 aa, Vibrio vulnificus YJ016
MKQFKPNSINDVSLINQLGFYIISGGGKRLRPLLAVLSARALGYQGNAHTTAAAFIEFIHTATLLHDDVVDESDMRRGKATANAAFGNAASVLVGDFIYTRSFQMMTELGSMKILKLMSDAVNIIAEGEVLQLMNCNDPDTTEESYMQVIYSKTARLFEAATQIGAILNDAPAEVETALQNYGKYLGTAFQLIDDVMDYTSDGEEMGKNVGDDLAEGKPTLPLLHAMRHTNAENAQMIREAIENANGMERLDDILAVMQQAGSLTYTEAKAMEEADKAIAELQVLPESEYKQALIALAHMAVKRSK

SEQ ID NO: 41664 - protein, 352 aa, Oryza sativa (japonica cultivar-group)
MAVVQANNLLEDQSQVESGALSMAEPGPQGTFIGVYDGHGGPETARFINDHMFHHLRTRRGFATEHKCMSTDVIRKAFQATEEGFLSLVSKQWSLKPQIAAVGSCCLVGVICSGTLYVANLGDSRAVLGRFVKSTGEVVATQLSSEHNACYEEVRQELQASHPDDPQIVVLKHNVWRVKGLIQISRSIGDVYLKRPEYNREPLHSKFRLRETFKRPILSSEPAIAVHQIQPNDHFVIFASDGLWEHLSNQEAVDLVQNNPRNGIARRLVKVAMQEAAKKREMRYSDLKKIDRGVRRHFHDDITVIVVFLDSNAISKANWSRGPSVSLRGGGVTLPANSLAPFSTPTVLSSTY

SEQ ID NO: 41665 - protein, 449 aa, Medicago truncatula
MEVEKKKYITSEELKKHDKEGDLWISIQGKVYNVSDWAKKHPGGEVVLLNLAGQDVTDAFIAYHPGSAWKHLDQFFTGYYLEDFKVSEVSKDYRRLVSEFVKMGLFEKKEHVALFTLTSVAIMLAIVVYGVVGCTSVWAHLGSGMLLGLLWMQSTYIGHDSGHYEVMSSRSYNKLAQILCGNCMTGISIAWWKWTHNAHHIACNSLDYDPDLQHIPVFAVSSRFFGSIKSYFYDRQLKFDALSRFLISYQHITFYPVLCFARLNLYLQTFLLLFSPSRNVPDRLYNIMGIGVFWTWFPLLLSALPSWPERLMFVLACFVVCSIQHLQFCLNHFAANVYLGPPSGNDWFQKQTAGTLDITCSTWMDWFFGGLQFQLEHHLFPRLPRAQLRKVSPLVIDLCKKHNLPYRSLSFVEANLWTLKTLRTAALQARDFTNSAPQNLLWEAFNTHG

SEQ ID NO: 41666 - protein, 267 aa, Glycine max
  misc_feature (215)..(215): Xaa can be any naturally occurring amino acid
  unsure (1)..(267): unsure at all Xaa locations
MAEASIGSKSSRWSLQGMTALVTGGSKGIGYAIVEELAQLGATVHTCARNEAELNESLNEWNTKGYRVTGSVCDVASRAERQDLIARVSNEFNGKLNILVNNVGTNVPKHTLDVTEEDFSFLINTNLESAYHLSQLAHPLLKASEAANIIFISSIAGVLSIGIGSTYGATKGAMNQLTKNLACEWAKDNIRTNCVAPGPIKTPLGDKHFKNEKTXNAFISQTPLGRIGEAEEVSSLVAFLCLPAASYITGQTICVDGGLTVNGLYIN

SEQ ID NO: 41667 - protein, 518 aa, Oryza sativa (japonica cultivar-group)
MAFIPPRDLVVVLPFLALLLPLYIYLRYSRSAKANPSLPTEWPLVGMLPSLVANIHNLFDYATALLAASGNSFEARGPPMSSLRFFVTCDPDNVRHIFINNFANYPKGEEFASFFDVMGDSFFNADGESWRRQRARVQHVMSNPRLLASMAACCRGKVEKGLLPILDRMASAGAPFDLQRLLTRFAFDVTAMAVFGVDTCRLSIDMPPLDVANAMDAVMEVGFFRHTVPVSCWKLMRSLRIGPERKLTAAQRLLRRFVAEMIEKRRVAGGACKATDDEQGGVPPPADIVSSYINDPEYVDEDGNPREFMYATFINYMVAGRDTVGTALSWLFFNLTEHPRVVARIREELEPIASSKAGGGGMVVFDPEETKPLVYLQAALFESMRLYPPGPIERKATLAEDVLPSGHTVRAGDNILIPVYSMGRMASVWGKDSGEYRPERWVTEDGKLRHVPAHRFMPFNAGPRLCLGKDISVLQMKSVAAAVAWNFDLEVVAGHAVEPKVSIVMQIKNGLMVKVKKR

SEQ ID NO: 41668 - protein, 207 aa, Hyphomonas neptunium ATCC 15444
MKTVDDMITGYRRFRSGVYAEQVELYRQLGEGQDPDIMLIGCADSRAEPSDIFNAAPGQMFVVRNVANLVPPYQPNGGLHGVSAALEFAVNILKVKIIVVMGHGGCGGISASLTKNDSPLIGEFVAPWVKLLDEARERVLATQPVNPQFALELEGIETSIQNLMTFPFVREKVEAGTLEIHGAWFAIKHGELHWRNPRSQRFEIVAP

SEQ ID NO: 41669 - protein, 404 aa, Polaromonas sp. JS666
MNAALPQPIEAASPHVMNTYGRLPIALSHGQGCRVWDVNGKSYLDALGGIAVNTVGHNHPKLVPALQEQIGRLIHTSNYYHVPLQETLAAKLVELSGLENVFFCSTGLEANEAALKLARKFGHDKGIERPEIVVYEKAFHGRSIATLSATGNPKVQAGFGPLVEGFIRVPLNDLEALKAATVGNPNVVAVFFEAIQGEGGINSMKDEYLREVRALCDERDWLLMIDEVQCGMGRTGKWFAHQWSGIKPDVMPLAKGLGSGVPIGAVVAGPKAAHIFSPGNHGSTFGGNPLAMRAGVETLRIMEEEGLLANAVKVGDHLRAALTRELADEPGLKEIRGRGLMLGIELTKPCGELLARAAEKGLLLSVTADTVIRLVPSLIMTTAEADEVVAIVVPLIKQLLKEKA

SEQ ID NO: 41670 - protein, 196 aa, Staphylococcus aureus subsp. aureus Mu50
MKVNPNNIELIISAVKEEQYPETELSEVALSGRSNVGKSTFINSMIGRKNMARTSQQPGKTQTLNFYNIDEQLIFVDVPGYGYAKVSKTQREKFGKMIEEYITKRENLQLVIQLVDLRHDPTQDDILMYNYLKHFDIPTLVICTKEDKIPKGKVQKHIKNIKTQLDMDPDDTIVSYSSIQNNKQQQIWNLIEPYIS

SEQ ID NO: 41671 - protein, 303 aa, Synechococcus sp. CC9605
MVSSQTADTRELRQRAAVMSPRDRLPARQRKFKMGTTSFMLVMHVLATVALLPHFWSWQGVVAFGVLYWLTVLGVTLGLHRLVAHRSLVVPVWVERILVLMGTLACQSGPIEWVGLHRHHHRFSDQPTDHHDAGRGLWWAHSEWMLHDIPALKELDRYAGDLQCDPFYRWLDRWFLLLQIPLGLGLYWFGEAAQVHGGGLGLVLWAIPLRLVVVYHVTWLVNSATHAFGYRNFDCPDLSRNCWWVALLSFGEGWHNNHHAHPASARHGLRWFEFDLTWQHVRLLKRLGLASRIRTARYVPGAS

SEQ ID NO: 41672 - protein, 195 aa, Glycine max
  misc_feature (95)..(95): Xaa can be any naturally occurring amino acid
  misc_feature (118)..(118): Xaa can be any naturally occurring amino acid
  misc_feature (148)..(148): Xaa can be any naturally occurring amino acid
  misc_feature (170)..(170): Xaa can be any naturally occurring amino acid
  misc_feature (173)..(173): Xaa can be any naturally occurring amino acid
  unsure (1)..(195): unsure at all Xaa locations
MSSEKSPSSASASASSSSSYELSKGINGLDKVILRDPRGSSAEVYLYGAHVTSWKNEQAEELLFLSSKAIFKPPKPIRGGIPICFPQFSNLGTPXLDSHGFARNQFWTIDDSPPPFPXKVALGPGGDLLMTSRIRNTNIDGKPFSFTXAYHTYFSVSDISEVRVEGLETXDYXDNLQKRERFTEQGDALTFESEA

SEQ ID NO: 41673 - protein, 170 aa, Burkholderia pseudomallei K96243
MSSRRIVVRRSGVHGKGVFAAVPIKAGERVVEYKGERISWKEALRRHPHDPDDPNHTFYFALEEGGVIDGKINGNSARWINHSCAPNCEAEEVGGRVYIHALRDIDEQEELFYDYGLVIDARLTKKLKREYACHCGAATCRGTLLATSEEDEGKKKKKAKKGGKDKKKKK

SEQ ID NO: 41674 - protein, 107 aa, Arabidopsis thaliana
MGRKKGLPEFEESAPDGFDPENPYKDPVAMVEMREHIVREKWIHIEKAKILREKVKWCYRVEGVNHYQKCRHLVQQYLDATRGVGWGKDHRPISLHGPKPVAVEEAE

SEQ ID NO: 41675 - protein, 307 aa, Zea mays
MAEQPRINSALVEVIRMAKISKNPNSAGSAVPYHYLRNDDRPDKAFTTDRAKRAGKANASSGQIFVTIAPDHFGPILAENDPRRNMGVRVGETWEDRLECRQWGAHFPHVAGIAGQSTHGAQSVALSGGYEDDEDHGEWFLYTGSGGRDLSGNKRTNKEQSSDQKFEKLNAALRISCLKGYPVRVVRSHKEKRSSYAPESGVRYDGVYRIEKCWRKIGIQGKFKVCSDDHGDRPRPLPKIKELQGATDITERKGRPSWDYDDKDGWKWVVPPPVSRKPVLSGDPETDKQIRRATKRVHLSVAERLLK

SEQ ID NO: 41676 - protein, 206 aa, Kluyveromyces lactis
MNSEYDYLFKLLLIGNSGVGKSCLLLRFSDDTYTNDYISTIGVDFKIKTVELDGKTVKLQIWDTAGQERFRTITSSYYRGSHGIIIVYDVTDRESFNGVKMWLQEIDRIATSTVLKLLVGNKCDLKDKRVVEYDVAKEFADANKMPFLETSALDSTNVEDAFLTMARQIKESMSQQNLNETTQKKEDKGNVNLKGQSLTNTGGGCC

SEQ ID NO: 41677 - protein, 547 aa, Magnetococcus sp. MC-1
MSSLTQLPQWQALQTHLEENRSVQMRDLFDQDSQRFSRFSLQQGELLFDYSKNRITAETMARLLDLARAQDVEGWRDRMFAGEAINETEGRAVLHVALRNRSGRPIRVAGEDVMPAINQVLQQMRQFSEAVRSGAWKGQSGQAITDVVNIGIGGSDLGPVMVCEALKPYHQPGLSVHFVSNVDGTHMAETLKGLNAETTLFIVASKTFTTQETLTNAHTARDWLVAQLGEAAVRKHFVALSTNAEAVSAFGIDTDNMFAFWNWVGGRYSLWSAIGLPIAIAVGFEGFMALHDGAYAMDEHFRTAPLASNMPVIKALIGIWNHNFLGAESFAVLPYDQYLHRLAAYLQQADMESNGKYVTRDGARVDYTTGPVLFGEPGTNGQHSFYQLIHQSTRLVPADFIAAAHTHNPVGDHHAKLLSNFFAQTEALMTGKTAAQVRQELEAAGLHGAALEALVPHKVFDGNRPTNSILVRQFTPYTLGQLIALYEHTIHVQGMVWGINPYDQWGVELGKQLAKKILPELTTPGEVHSHDGSTNGLINHYKAWLAE

SEQ ID NO: 41678 - protein, 499 aa, Vigna unguiculata
MARKMLIDGEAESVPGVEQGTNFDFDLFIIGAGSGGVRAARFSSNYGAKVGICELPFNPISSETIGGVGGTCVIRGCVPKKILVYGASYGGELEDARNYGWELNEKVDFNWKKLLQKKTDEINRLNGIYKRLLSNAGVKLFEGEGKIVGPNEVEVTQLDGTKLSYTAKHILIATGSRAQRPNIPGQELGITSDEALSLEDLPKRAVVLGGGYIAVEFASIWRGMGSEVDLVFRKELLLRGFDDEMRAVVARNLEGRGINLHPRTNLTQLIKTENGIKVITDHGEELIADVVLFATGRAPNSKRLNLEAVGVEVDKAGAIKVDEYSRTSIPSIWAVGDVTNRMNLTPVALMEASCFAKTVFNGQASKPDYSNIACAVFSIPPLSVVGLSEEQAIEQTKGDLLIFTSTFNPMKNTISGRQEKTEVMKLIVDAETDKVLGASMCGPDAPEIIQGIAIALKCGATKEQFDSTVGIHPSAAEEFVTMRTVTRRVTGSGKPKTNL

SEQ ID NO: 41679 - protein, 428 aa, Pasteurella multocida subsp. multocida str. Pm70
MSELTAKLTLSDGREYDLPVHKGSLGYDAIDVQSLVKNKLFTFDPGFMSTACCRSEITYIDGDNGVLLHRGYPIAELAKNADYLEVAHLLLFGERPSPEEYKNFTQLVRRHTLVHEQISRFFHGFRRDSHPMAIMCGVSGALAAFYHDSLDINDITHREITAIRLLAKMPTLAAMCYKYSIGQPFMFPQNHLSYSGNFLYMMFATPCEPYIVNPVLERAMDRIFILHADHEQNASTSTVRTAASSGANPFACIAAGIASLWGPAHGGANEACINMLEEIGTVDRIPEFIARAKDKNDPFRLMGFGHRVYKNYDPRAKVMRQTCHEVLKELNIQNPLFDVAMELERIALSDPYFIDHKLYPNVDFYSGIILKAIGIPTSMFTVMFALARTVGWIAHWKEMFKPGNMKIVRPRQLYMGEKERSFEAMDKS

SEQ ID NO: 41680 - protein, 444 aa, Rubrobacter xylanophilus DSM 9941
MIEQRRPAVLPPELSDGSVTSVRVLYADLHGVARGKDVPIGEFERAVEHGLAFCSAIMGTDLRHTPVVGGEEGYPDLVAYPDLSTMTLVPWEPGVACCLADLRPVGDHAPPADPRGAVRRAVAAFEELGLSPVVGPELEFFLCERDPAGGVRRYVDNLSMVYTVGPQADPRGIVREIAEMLSGMGLGAFAANHEFMNSQYEINLHHADALAAADRAFRLKCAVKDVAAMRGLVATFMGKPFNDQGGSGFHIHFSLERGGENAFAGGEEGGVTGLLRHFVAGVLEHASGLMAFLNPTINAYRRLVPDSLAPTHANWGWDNRTAFVRIPPERGGATRVEVRVGDGSANPYLATAATLFAGLHGVRERLPLGPPVGGDAYALAGEKAGPPLPATLEEALDALEADEVLRGAMGEQIVGTFLALKRYEAERHRTWVSDWEISEYLHHL

SEQ ID NO: 41681 - protein, 213 aa, Oryza sativa (indica cultivar-group)
MADVNCRCSRVVYVGNIAFHASEAELRDACELIGPVRSLRLAAADPATSKRKGYAFVEYADDETARSALRNLHGHLLRGRELRVGLAARPSTRRRGVGDAEREPVGMEDAVHAASLVVSGRPLASVTRYLAARSRQEVREMVAALEATEQLKIPGLGTAMEQAQRLLEMFAADEEEVARKKLKRASDEEHAKQSKVVGVDGVVKASSRIVPCF

SEQ ID NO: 41682 - protein, 181 aa, Oryza sativa (japonica cultivar-group)
MSLSRTPAGGGAAAWGEAAAGRRPAAVGRRAAERCWSPNPSPKRPIQPPASTHRTTNHRPPRRRGERKEEREMEAAAAAGVQLGTSKPQIATQAEMSEARLPLPYRDQCAHLLIPLNKCRVAEYYLPWKCEPERHAYEKCQYELVMERMIQMQKIREAQEAKSKGAATIGVPLIPSTAKLS

SEQ ID NO: 41683 - protein, 570 aa, Saccharomyces pastorianus
MSHVNASYAHSQGSSTSVSRVEMEKPATKEVFEDPTPKKFELDDDEAGKTSSVFNPDLNLEEEVRALDELGDSFKRDRSFWGKMKALEFEVEFENKKNMVLMLGTFAAFAGILSGIDQSIISGASIGMNKMLHLSTHEASLVSSLMPLGAVAGSILLTPFSEYFGRKKSLAISCVFYTIGAIVCAAASNHHEMYAGRFLIGVGVGLEGGGIGVYIAESVPSSVRGSLVSLYQFNIALGELFGYIVGVIFFDVKGGWRYMVGSSLVFSTTLFIGLLFLPESPRWLMHKGRVGESWNVWKRLRDVKEEGNKIEFLELRDVASHDRELHANESRFQSLFDLVRVPRNRRALVYSCMMIGLGQLTGINAIMYYMSTLMKNIGFDDKQSVAMSMVGGAALLIGTVPAILWMDRFGRRTWAMTIIIFIVGLVLVGVGYQINLKTHMAAAEGVYLTGQIIYNMAFGSYAALTWVLPSESFSLGTRSAGMTVSSALLYLFAFTVTYNFEKMKEAMTYTGLTLGFYGGIALAIGIPYQLLCMPETKNRTLEEIDDIFEKPTSQIIKENIAYLKKGQLSY

SEQ ID NO: 41684 - protein, 389 aa, Oryza sativa (japonica cultivar-group)
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSEHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPQHYPDFTWADLMRFTQRHYRADTRTLDAFTRWLAPPAADAAATAQVEAAS

SEQ ID NO: 41685 - protein, 488 aa, Rubrobacter xylanophilus DSM 9941
MTTAAERVRVAGVEVSPDHFIGGERVASPRRFEDISPITNEPIAEVSRAGEAEVDAAVRAARDAFPGWAALGPAGRAPYLHRLADLIDANVERLAAVECMDMAMLLRSLRARVIRRGARNYRAYADLAASYEERDWRSQGTWNRVQRMPAGPAAIITPWNAPFMLSTWKTAPALAAGCTVVLKPAEWSPLSCSLLADLVAEAGFPPGVFNVVQGIGEEAGAALVAHPLLRRVSFTGSPETGRSIGVAAAKNLVPFTAELGGKGPLIVFEDADLDAAARRAAGQYDDAGQVCLAGTRLLVQESVAEEFLELFHRYADEHVLGDPRSEHTTVSPLIHPDHLRRVEGFVERARREGHRVLRGGRRSPAGPLFYQPTLIEPLSNDAEIVQREVFGPVLTLQTFADEEEAVSLANSTEYGLSGIVYTSSMGRADRVGRAVRAGVVWVNTFLVRDLTAPFGGMGISGIGREGGDYALDFYSDLKTLQILEGSTR

SEQ ID NO: 41686 - protein, 240 aa, Prochlorococcus marinus str. AS9601
MTFTKFQYNNFCYWPSNPKKIVEFIGGSYLASKPDLTYRRFIESLINKNYAVHAYKYTPQFDHQQLAIKAWKDFKNCRISLSKRIGASIPSIRIGHSLGCKLHLISPDGGRNCEKFISISFNNFSANKSIPLLKQISQKLEFNSEFSPSPERTLRLIEKTYNQKNNFLIKFNQDELDQTDNLFSCLKARKEDNSKGVMLKGTHTIIASAGLRENFLGDWADDEFKRNTIKKISNLIDESI

SEQ ID NO: 41687 - protein, 357 aa, Frankia sp. EAN1pec
MDAVMLVGGQGTRLRPLTMSAPKPMLPVAGVPVTAHMLARARDAGITRVVLATSYRAEVFEEHFGDGSGHGLELEYVTETEPLGTGGAIRNVASRLRSGADEPVVIFNGDILSGLDIGALVERHTTADAAVTLHLTRVDDPRAFGVVPTDPAGRVTAFLEKTPDPPTNLINAGCYVFRRSLIDTIPAGRPVSVERETFPSLLAAGVPVVGYPDDTYWLDLGTPAAFVLGSRDLVTGRMPSSALPGPVGDRLVLPGSTVATDAKIGGGSTIGAGASVGTGARIDGSVLFDRASVGAGAYVRDSVVGREAVIGNGVVLENVVIGDGAVIEPGNELRAGARVFPGAVLGAGAVRFSSDRA

SEQ ID NO: 41688 - protein, 379 aa, Oryza sativa (japonica cultivar-group)
MPKKGTKSRKGTDDEPKQEEKNKLPEHLEVQRTRVVCKGDAPVNTEGFQYAGAFAAMGIDNSVSADKFCKNFKVVVNRLTEDDMEFDMIGIDASMANAFRRILIAEVPTMAIEKVLMADNTSVIADEVLSHRLGLIPLDADPRLFEYISENDVPTERNTIVYKLHVSCKKGSPRLTVKSGDLEWLPEGSQLPLASPAQSGDKQKTYTSFSQSQKDILEKPLGVKFKDITIARLGPGQAIELEVHAVKGIGKVHAKWSPVATAWYRMLPEVVLREEIKDADAEMLVAKCPVNVFDIEDLGNGEKRAVVARPRACTLCRQCVMGPTGEVMGPTVEQVELRRVRDHFIFTIESTGALPPEMLFTEAVRILEEKCERVISELS

SEQ ID NO: 41689 - protein, 634 aa, Mycobacterium smegmatis str. MC2 155
MVAPLTLQSKKRVHPVDEVPPVGKLATYGFQHVVAFYAGAVLVPILIATAIDLPTQDLVKLITADLFTCGIASIIQAVGFWKVGVRLPLLQGVTFAGVSPIIAIGLAHGGGAPSLLYVYGAVIVAGIFTFLIAPVFIKLLRFFPPVVTGTLITIIGLCLVPVGAHDAVTNPHTGEVDPTNLRWFLYALGTIAVIVAIQRIFSGFLATIAVLLGLVIGCVVAYALGDMNFDDVAQANMFGFTQPFLFGMPKFDFVACLTMIIVLMITAVESTGSTYATGEIVGKRIKASDIGNVLRADGLATTIGGVFNSFPYTAFSENVGLVRLTGVKSRWVVAAAGVIMILLGFLPKVAAVVSSIPQPVLGGAALTLFATVAVVGIQTLGKVDFTDHRNLIIVTTSLAAALWATSYPDVAQALPAGIDLLFGSGISIGAISAILLNVVFFHLGGRGARVAGSGTITLDEVNAMTEQRFKEVFGRVVQNVPWVLERVYTSRPFTDTNALRQAFQDALLAGSADQQLELVRAFPDLGAEDETGHALAVDHVALSNLDEDDHNDVVQLATAYREHFGFPLIICARETQHFDRILQNGWSRIDNSPAAEKSFALIEIAKIVKYRFDDLVADANPIAAARFGRLTELR

SEQ ID NO: 41690 - protein, 380 aa, Triticum aestivum
TLGANPRTPSTFLAPLASPAMSRIARSRLALTLRSSAAPFSTISPAAAGASLASKEAPAAADASSAPKEAAAAGDPSPAPPSGARSSFGLLKAGIFTAVTAALGATGYVTYAYSVDEVDQMTREFRKNSKLPISEDLSGFEKFKATAYSETMKVPAAAIDLYLDVRSQIEDQIQGFVEPSSEKLLPDLPPQEQHVFTIVLDLNETLVYSDWKRERGWRTFKRPGVDAFLEHLAKFYEVVVYSDQLSMYVDPVMERLDTKGCVRHRLSRVATKYVNGKHYRDLSKLNRDRARVIYIRGHALESCLQPENCLPIKPWKLEAEDTQLIDLIPLLEYVATARVSDIRPVLASFEGRDIAAEFLERSRRVFEQKQQHASGRIWRR

SEQ ID NO: 41691 - protein, 454 aa, Phaeodactylum tricornutum
MSVNGDLDKLIENLPAFLREHLNQHDSKDQLIEIVLDLGRRPEARFITGPQYLSQKIISWQDIDYMTKRVSKFSNENRAGIERTLHRISCIRNRQFLINGLTCRVGRAVFGTISAIRDLLESEKSILILGKPGVGKTTIIREIARVLADEMEKRVIIIDTSNEIAGDSDIPHSGIGRARRMQVAKTELQHQVMIEAVENHMPQVIIIDEIGTELEVLAARTIAEKGVQLVGTTHGNCLDNLIKNPSLADLIGGIQYVTLSDDEAKRRGTQKSILERKAYPAFEIIIEINNQSSWTIHEDVKTSVDLFLRGSFFVGQIRQFALSEKINIKAQKFLNQQNLLLKKDSTDNLTLLEKNWISINQSRYEKSLNLKSKTLIIYPYSLSNNLLKEVLLKMRVKFVLTNEIRKANLIIGLKKHLNQNFKLTNLAKQKNIPIYSLNQVSFYQVSKLIQFLCS

SEQ ID NO: 41692 - protein, 446 aa, Vibrio sp. Ex25
MFGFLRSPKFTQPSLSKEQIDQRYRHWRLHIMLGMYIGYAGFYFTRKTFNYAAPAMITDLGLDKGDLGLIGTLFYITYGCSKFISGTISDRSNPRYFMGLGLIATGLVNIAFGFSSSLAAFITLWILNAWFQGWGWPSCSKLLTTWYSRSERGFLWAIWNTAHNVGGALIPILVGYLTLHYSWREGFILPGIIGVLLGLFVCWRLRDKPTTMGLPSVGQWRNDALELAQENYGRGLTYREILKSYVFNNEYIWLLAFSYVLVYIVRTAINDWGNLYLTEQHHYSLINANAALSMFEIGGFVGSLVAGWGSDKLFGGNRGPMNLLFAIGIFLSVSALWLMPLTNFAFQAAGLFSIGFFVFGPQMLIGMAAAECSHKDSAGAATGFVGLFAYMGAALSGYPLALILEEYHWTGFFITISVCAAVIGLLLLPFLQAQPSRKPLEPKPRL

SEQ ID NO: 41693 - protein, 415 aa, Methanococcoides burtonii DSM 6242
MRPTQVEYAKNGTITPEMEYVAEHESIYVETVMSRVADGSLVIMVRDGCPPVAIGRGAKTKINVNLGTSSASIDPDAELEKVKIAEKYGADTITDLSMGGDISAIRKIVFDNTTLPITTVPVYQAVVECGMKDTSSDDVLSYLKKQVDEGVSSVVVHCVEKQMLEKLKGTGRIMGMVSKGGSFTSVLMLKDGCENPYLENFDEVLSILKKNDVVLSLGNTMRSGCVHDVCDNPQMMEIRTNAKLAKQANEAGVQVIIEGMGGHVQANDIVPHIQAHRALSDFPLFVAGPLPTDVGMGYDHISGAVGASIASGNGADYLCYITPAEHLSLPTPEQVREGLIAFKIAAHIGDSMKYGLDERDKLLADRRANFDWEGQMALALDPDKPKGMCPMTGPCSMCGEYCAIKIMADYLSEGV

SEQ ID NO: 41694 - protein, 420 aa, Vibrio sp. Ex25
MPKLNQDNPVQSSALSDIETSSKIQSALEPKFHKPEKRLCLSPGLSDKHLARRWQVLEHVTNKDHILDPFTQSHCDAYSNNIEHFIGTVNVPVGIAGPLRVNGLYANDDFLVPLATTEAALVASYNRGANLITAAGGASALLLSEGVSRTPVFAFNNLADAGQFVSWVVTQFDAFRQIAESTTSHGKLKDINVNIEGNHVYLVFEYVTGDASGQNMVTIATNEVFHHILATSPIKPTQAFLDGNLSGDKKPNAHTLRSVRGKKVSAEVTIPAELVEKYLHTTPESMVQFGKMTTVGGLLSGTIGVNAHYANALAALYIACGQDAACVAESAIGITRMDVDAQGNLYACVTLPNIMVGTVGGGTSLLTQKACLDILGLHGNGNAKALAEVAAALCLAGELSIVGAFCADHFSRAHHKLARK

SEQ ID NO: 41695 - protein, 504 aa, Oryza sativa (japonica cultivar-group)
MAFSSILQLTLCFLCFSVFYYYHIKSKRKNPAIPVCWPLVGMLPDLLVNRHQLHDWITSFLTASQLNFRFIGPTMSSNMRFFFTCDSANVRHIFTSNFANYPKGPDFAEIFDDTLGDGIFNVDGDSWRRQRAKTQLLMYNHRFQSFVSRCSSDKVENALLPLLSHFAGTGERCNLQDVFMRLTFDMSTMLASGEDPGCLAISLPMPKVPFVRAVDYTTRVLLVRHIIPLSLWKLARRLGVGFERKMAEALRTINQFIYETIVKRRAKKANEGIEDSEDLLSSYLKDDDENADTFLRDTTMTLIAAGRDTIGSALSWFFYLLTKNPHVASKILEELDSVERATTTPDGMVTFDPDELKSLVYLHAAVCESLRLYPPVPLDHKGVVAADVMPSGHKVRPGDKIVVSIYAMGRTESVWGSDCMEFRPERWISDDGKLRYVPSYKFTPFITGPRTCLGKDMALVQLKVVAATVVKNFEIEAVPGHIVEPKLSMVLHMKNGLMVRVKRR

SEQ ID NO: 41696 - protein, 394 aa, Oryza sativa
MRMEGGGGGGHGHHGGGGGGHGHHGGIGGGEAQIKGTLTHGGRYVQYNVYGNLFEVSSKYVPPIRPVGRGACGIICAVVNAQTRQEVAIKKIGNAFDNQIDAKRTLREIKLLRHMDHDNVISIKDIIRPPRRENFNDVYIVYELMDTDLHHLLRSNQPLTDDHCQYFLYQVLRGLKYVHSANVLHRDLRPSNLLLNAKCDLKIGDFGLARTTNETDFMMEYVVTRWYRAPELLLNCSEYTAAIDIWSVGCILGEIVTREPLFPGKDYVHQLRLITELIGSPDDSSLGFLRSDNARRYVRSLPQYPKQQFRARFPTMSSGAMDLLERMLVFDPSKRITVDEALCHPYLASLHEIYDEPVCPAPFSFDFEQPSLTEEDIKEIIWREALKFNPEPIH

SEQ ID NO: 41697 - protein, 492 aa, Campylobacter coli RM2228
MRQKCILVITDGIGFNKEKDFNAFEAAKKPNYERLFREVPNSLIKTSGLAVGLPEGQMGNSEVGHMCIGSGQIIYQNLVRINKAIESCELEKNANLKKLLQKCKRVHVIGLYSDGGVHSMDTHFNALLEICAKNGNEVFAHAITDGRDVSPTSGLEFIRKLKNHCEEIGVHFATLCGRFYAMDRDKRWERVKEYYDCLLGKSKGVSNWVDYIEECYQNETTDEFIQAAKNENYKGMQEDDGLIFVNFRNDRMKQLIEVLNSQNFKEFEREKVFENLLTMSVYDDKFNIPVLFEKEEIKNTLSETISKAGLTQLHTAETEKYAHVTFFFNGGKEELLENETRVLIPSPKVKTYDEKPEMSAFEVCDVVKKGIEKGEDFIVVNFANGDMVGHTGDFNAAVKAVEAVDVCLGEVVECARKHDYAFIITSDHGNCEAMQDKKGNLLTNHTTFDVFVFVEAKGVDKLKENMGLSNIAASVLKILNLEIPKEMNEALF

SEQ ID NO: 41698 - protein, 247 aa, Campylobacter coli RM2228
MKFSGKNVLITGASKGIGASIAKTLASFGLKVWINYRSKPELADVLKDEILAQGGNAAVIKFDASKEDEFENGIKTIVESDGELSYLVNNAGVTNDKLALRMKLEDFTSVVDTNLSSAFLGCREALKTMSKKRFGAVVNIASIVGEMGNAGQTNYSASKGGMIAMTKSFAKEGASRNLRFNCVTPGFIKSDMTEILSDEIKQAYQDNIPLKRFAEPEEVANCVAFLLSDYASYVTGDVLKINGGLYM

SEQ ID NO: 41699 - protein, 498 aa, Ostreococcus tauri
MLHAVVRPELAFTFLRSLPGVRRIVERSKRQILLELEVSLKSGAKEQKICELPTSGLSVEDILKTAARLKNGDYKQLFYASKLTGTIYASDTRHRDLCNTVYCDFAHTNPLHSDAFPSVGRMELEIVHMTSRLLSSDSRIEICGTVTSGGTESILTAIRASRDFICHTKGITNPEMYVFIKRHINVSVTSVYKAAEYFKIKIRRVPMDENGRMNILAVKKALRRQTVLVYASAPTYPHGTIDPVDDLSNIALQHGCCLHVDACLGGFVLPFLSDVEHESRVPKFDFSLPGVTSMSVDTHKYGYAQKGSSVILYSTAIMRQFQYTSVADWSGGLYISPTPAGSRSGGLIAQTWAAMLHMGYEGYSKAAHDIFAGAKKLREAIAATEGLELIGTHITMIVAWHTSTGSNIYVLNDILTSKGWRLAVLQNPKALHFCITPANLSAIDELITDLRSAVRLSQTLKTVPGGKAPIYGLAHGLPDRGVIKALLKDVQDVMLNNM

SEQ ID NO: 41700 - protein, 955 aa, Arabidopsis thaliana
MRLRHQGGQYLARGMEPVYWSNKVDSTHDLYDNYTLGSYQNNSYNILAHTGFGYDHEFQIYEINSNSWRIIDATLDFKLGYIGRGVSLKGKTYWIASGEEEKRLGKFLISFDYTTERFERLCLPNKYPCYATLALSVVREEKLSMLSQRGIKSKAEIWVTNKIGETQVVSWSMVLALDLQPKRCIGESGSFLVDEKKRVVVCCDNIRDQGKTTFDSNLPRYHRQKKKGRMIIVFDVESMRLPVTVKATKPSFLVIWIRYSSAASSPTVSLNPSGRLQQTLAGSVEVKGKSLHSGKFSTVKLNPEIAGAGRFFEFRSRFIPASIEFAQESPLCTTLLKDELKIRTVEHLLSALEAKGVDNCRIQIESESSDDREVEVPIFDGSAKEWVDAIQGVGINAAQNHDGESVEKMVAHVNKPVYVCKNDTFVAAFPALETRITCGIDFPQVPAIGCQWFSWRPIHESSFAKDIASSRTFCVYEEVERMREAGLIKGGSLDNAIVCSAEHGWMNPPLRFDDEACRHKILDLIGDLSLVSRGGNGGLPVAHIVAYKNEEEEVRSSTEENENVRSSTEENEYVRSSTEAGRGEDPHEDSDNISESGAIHLQIMERFNQRSGSGKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 41701 - protein, 341 aa, Staphylococcus aureus subsp. aureus Mu50
MSTNIAINGMGRIGRMVLRIALQNKNLNVVAINASYPPETIAHLINYDTTHGKYNLKVEPIENGLQVGDHKIKLVADRNPENLPWKELDIDIAIDATGKFNHGDKAIAHIKAGAKKVLLTGPSKGGHVQMVVKGVNDNQLDIEAFDIFSNASCTTNCIGPVAKVLNNQFGIVNGLMTTVHAITNDQKNIDNPHKDLRRARSCNESIIPTSTGAAKALKEVLPELEGKLHGMALRVPTKNVSLVDLVVDLEKEVTAEEVNQAFENAGLEGIIEVEHQPLVSVDFNTNPNSAIIDAKSTMVMSGNKVKVIAWYDNEWGYSNRVVDVAEQIGALLTSKETVSAS

SEQ ID NO: 41702 - protein, 172 aa, Zea mays
MDEKRTTAFGLMQIDEEWRIIEFAKKPKGEQLNEMIVDTTILGLDDVRAKAMLYIASMDIYVFSQDVMLQLLREQFPRANDLGSEVISGATSIGKRVHAYLYDGYLEDIGTINTFYNANLIILHTKCWTAQLSNLWMGNGCYVYGELCFIWKPPWPGLICVQERVLLQFDAL

SEQ ID NO: 41703 - protein, 93 aa, Brassica napus
  misc_feature (65)..(65): Xaa can be any naturally occurring amino acid
  misc_feature (74)..(74): Xaa can be any naturally occurring amino acid
  misc_feature (81)..(82): Xaa can be any naturally occurring amino acid
  misc_feature (86)..(86): Xaa can be any naturally occurring amino acid
  misc_feature (88)..(88): Xaa can be any naturally occurring amino acid
  unsure (1)..(93): unsure at all Xaa locations
MASSMLSSAAVVTSPAQATMVAPFTGLKSSAAFPVTRKANNDITSIASNGGRVSCMKVWPPVGKXKKFETLSYXLPDLTEXXWRKXGXYLFPQ

SEQ ID NO: 41704 - protein, 298 aa, Frankia sp. EAN1pec
MVISSRDRAEPAGPGPHAGRAAVLGSPIGHSLSPVLHTAAYERLGLDWTYTAIECDEAGLPGMLDRLRDEPGWAGVSLTMPLKTAAVDLLDDVEPTAALLGAVNTVVVREDGRLAGFNTDVDGVGYALRRLTGGVAPVQPLVLGAGGTARAVVAALARVGATRVAIVARRPDAVAELVGIGARLGVSVTALPWDILSGGMPAGPDLVVATTPAGVTDELARRPWPVTCALLELLYHPWPTALAACAYRGGARVVGGLEVLAGQAVGQVCHFTGRPVDERVLLAAGHAALSARVASRIG

SEQ ID NO: 41705 - protein, 290 aa, Magnetospirillum magnetotacticum MS-1
MFKGSITALITPFRNGSVDEKAFQDLAAWQIAEGTHALVPCGTTGESPTLSHDEHHRVVELCIEVARGKVPVIAGTGSNSTDEAVALTRHAKKAGADAALVVAPYYNKPSQEGLFRHFEAIATSVDIPIIVYNIPGRSVIDISVETFVRLSALPNIAGIKDATADLARPLRIRAALGERLCQLSGEDATAIAFNAQGGVGCISVTSNIAPKLCSQMQNAWAARDFATCDALNKKLMPLHDALFCETSPAPVKYAASLLGKSTPDVRLPLVPASENARHRVEAAMKAAGLI

SEQ ID NO: 41706 - protein, 523 aa, Pasteurella multocida subsp. multocida str. Pm70
MNNIHNHKILILDFGSQYTQLIARRVREIGVYCELWAWDVSEADIREFNPTGIILSGGPESTTEENSPRAPEYVFNAGVPVLGICYGMQTMAMQLGGLTETSTHREFGYASVNLKAADALFAQLNDDVTSSQPKLDVWMSHGDKVTRLPDHFQVTAMTSTCPIAAMSDERRRFYGVQFHPEVTHTKSGLELLTNFVVKICGCERNWTPENIIEDAVARLKAQVGDDEVILGLSGGVDSSVTALLLHRAIGKNLHCVFVDNGLLRLNEAEQVMEMFGDKFGLNIIHVKAEDRFLDALKGIDEPEAKRKMIGKVFVDVFDDESKKLTSVKWLAQGTIYPDVIESAASKTGKAHVIKSHHNVGGLPDYMKLGLVEPLRELFKDEVRKIGLALGLPAEMLNRHPFPGPGLGVRVLGEIKKEYCDLVRLADAIFMEELHASGWYYKVSQAFTVFLPVKSVGVMGDGRKYDWVVSLRAVETIDFMTAHWAHLPYDLLGKISNRIINEVNGISRVVYDVSGKPPATIEWE

SEQ ID NO: 41707 - protein, 387 aa, Candida albicans
MGFSLSNFTSDPFAISTVSFGIMAWVVAIAGAASSKQENFPHFSWWGISYQIVIILIIFVLYANNNIELYKFTLVGLVSIAFIYTTNSTNNLIYNSNSAGNLCCAAGCILLSILNLIWILYFGGHPESPTNQFIDSFSLRGQGHEQLGSGSHNHNANNANNNIPIGAGNAIIGKGEMSPYDDRFAASGVNQPTSESLRLASGPQMGNGPFTTTGAIINPNLQQPLSDSIGGSAHHTPINVNNNNNNNNNTGYMTSSHLTGLENFSSPHVPGSGTGAGLGVGAGRDLTHNSNGGGGSGGGPASANNSNNTNKRNTIYTDSETGTGITFRYKAKALYSYDANPDDINEISFVKDEILEVDDIDGKWWQARRANGQVGICPSNYVKLLDT

SEQ ID NO: 41708 - protein, 363 aa, Vibrio vulnificus YJ016
MTDKTYKIAVLPGDGIGPEVMAQAHKVLDAIEKKHAIHFEREEHDVGGIAIDNHGCPLPQSTVTACEESDAVLFGSVGGPKWEHLPPNDQPERGALLPLRKHFQLFCNLRPAQIHSGLEAFSPLRADISGRGFDIVVVRELTGGIYFGQPKGREGEGANEKAYDTEIYHRFEIERIAKIAFESARLRRKKVCSIDKANVLQSSILWREVVEEIAKDYPDVELSHMYIDNATMQLIKDPAQFDVMLCSNIFGDIISDECAMITGSMGMLPSASLNESKFGLYEPAGGSAPDIAGKNIANPVAQILSAALMLRYSLGEEAAAQDIENAVSQALAAGELTADLAGDKPALSTAEMGDKIAQYILNS

SEQ ID NO: 41709 - protein, 510 aa, Glycine max
  misc_feature (287)..(287): Xaa can be any naturally occurring amino acid
  unsure (1)..(510): unsure at all Xaa locations
MGSDNHQNLEFLKEIGLGSSNIGSYINGQWKATGSSVTSVNPSNNQSIAQVTEATLQDFEEGLRACSEAAKTWMTIPAPKRGEIVRQIGEALRAKLDPLGRLVSLEMGKILPEGIGEVQEIIDMCNYGVGLSRQLNGSIIPSERPDHMMFEVWNPLGIVGVITAFNFPCAVLGWNACIALVCGNCVVWKGAPTTPLITIAVTKLVAEVLERNKLPGAIFTSFCGGADIGQAIAKDTRIPLVSFTGSSKVGLMVQQTVNERFGKCLLELSGNNAIIVMDDADSNWLYXYFVCCCGSTGQPVYTWPCRRLFLHESIYTDVLDQLVEVYKQVKIGNPLEKGTLVGPLHTRTSVENFQKGISVIKSQGGKILTGGSVLESGGNFVQPTIVEISPDAPVVKEELFGPVLYVMKFQTLDEAIALNNSVPQGLSSSIFTQRPGTIFKWIGPRGSDCGIVNANIPTNGAEIGGAFGGEKATGGGREAGSDSWKQYMRRSTCTINYGSELPLAQGINFG

SEQ ID NO: 41710 - protein, 626 aa, Oryza sativa (indica cultivar-group)
MAAAAVADEVTEAMEQVEGEREEADAVADEAAEVMEQAEGEREEAIDAVAGEAGEVMKEVVEGEREEANAMADEADEAMEPEGEREEEADAVADEATEPMEQVEGEGEDGDAATQRTALTLGRVKRIIRVDRDIKKKCQHTACLMSDNNLISTDNTNSLEIFCWTELLLNLHYIHDKVADVLREAGCTFMVSGPWFLNMNFLITCDPATVNHCFNANFKNYPKGSEFAEMFDILGDGLLVADSESWEYQRRMAMYIFAARTFRSFAMSTIARKTGSVLLPYLDHMAKFGSEVELEGVFMRFSLDVTYSTVFAADLDCLSVSSPIPVFGQATKEAEEAVLFRHVIPPSVWKLLRLLNVGTEKKLTNAKVVIDQFIYEEIAKRKAQASDGLQGDILSMYMKWSIHESAHKQKDEQFLRDTAVGFIFAGKDLIAVTLTWFFYMMCKHPHVEERILQELKGLQSSTWPGDLHVFEWDTLRSAIYLQAALLETLRLFPATPFEEKEALVDDVLPNGTKVSRNTRIIFSLYAMGRIEGIWGKDCMEFKPERWVSKSGRLRHEPSYKFLSFNTGPRSCLGKELSLSNMKIIVASIIHNFKVELVEGHEVMPQSSVILHTQNGMMVRLKRRDAA

SEQ ID NO: 41711 - protein, 506 aa, Cytophaga hutchinsonii ATCC 33406
MSKQNYDSKFCGSLPISFVNQIQDYGFLLVCDPALIVLQVSDNAEAFTRISYQSFIDKNLKELLTADSFQLLQEKLSSKAQKRFTCTLEFYGGVRTSFLTLIHVKEEYILFEFEPSDDTDIKGFREVYQQIHEASAAIQQSQELGESLSIAVKELKTFSGFDKVMIYKFDEDWNGHVLAEAMEPGMESYLGITFPASDIPKQARELYLKNPYRLIPDREYKPSKLYPVINPASSGFVDLGVCNLRGVIKVHLEYLTNMNVKSSMSTRILKDNTLWGLIACHHREKKFLNFDQCSVFEMFSNVVSTRLSALETEQNLTKTTENQALMNSIIEELYSQTMLINAIDNCAALIMQLLDCTGLVHIRESKVKSFGACPSASSIHELVIWLQMKNFTTLYATAALTEAYEDAAAIASVASGLLAFPVIPDKGEYILCFRAEILQRIDWGGNPNEAIRFNEDMKTYHPRHSFEIWKEEIKSTSQPFQEYEMNFAKELQRIFIETRLKEQNRR

SEQ ID NO: 41712 - protein, 505 aa, Oryza sativa (indica cultivar-group)
MELLQWLLGFVVKYPEIMASAACFLLLFCRFRRRSKRIPTNWPVVGALPAIVANAGRVHDWVTEFLRAAAMSHVVEGPWGSPGDVLITADPANVAHMFTANFGNYPKGEEFAAMFDVLGGGIFNADGESWSFQRRKAHALLSDARFRAAVAASTSRKLGGGLVPLLDGVAASGAAVDLQDVFMRLTFDLTAMFVFGVDPGCLADDFPTVPFGAAMDDAEEVLFYRHVAPVPWLRLQSYLKIGHYKKMAKAREVLDASIAELIALRRERKAADANATGDADLLTAYLACQDEIGMDGAAFDAFLRDTTLNLMVAGRDTTSSALTWFFWLLSNHPGVEARILAELRAHPPSPTGAELKRLVYLHAALSESLRLYPPVPFEHKAAARPDTLPSGAAVGPTRRVIVSLYSMGRMEAVWGKGCEEFRPERWLTPAGRFRHERSCKFAAFNVGPRTCLGRDLAFAQMKAVVAAVVPRFRVAAAAAPPRPKLSIILHMRDGLKVKVHRRQED

SEQ ID NO: 41713 - protein, 361 aa, Burkholderia pseudomallei K96243
MSEKVYRIAVIPGDGIGVEVMPEGLRALDAVSRRFGLRFAYEPIEWASCDYYAKHGQMMPDDWKTQLSGMDALLFGAVGWPETVPDHISLWGSLIKFRREFDQYVNLRPARLFDGVPCPLAGRKAGDIDFMIVRENTEGEYSAVGGTMFEGTEREFVVQQAVFTRHGTERVLKFAFELAQRRAKRLTVATKSNGIAISMPWWDARAAEMAARYPDVAWDKQHIDILCARFVMQPDRFDVVVASNLFGDILSDLGPACTGTIGIAPSANLNPERNFPSLFEPVHGSAPDIAGKHIANPIAMIWSAAMMVDFLGAGTGPAREAHDAIVAAIEHVLKHGPRTRDMGGRASTREVGDAIVAHLLG

SEQ ID NO: 41714 - protein, 392 aa, Ostreococcus tauri
MRRALPRYGSFDSRWKTNSSTKLLPVRGQITRSKLHFPTSAVYAGWMQTEQEVIGFVSICLSALLMSKFASGEGRRGLSREEVGKPRGALKAGLDLDWGVCDDMGPRECMEDTYQVMKGRDHIFASVYDGHGGSGSSQYLRSNFYGFISSVLMKNRRLLSDATVTVDELHDITKNLFTDVFETADSALIDHIASLGDPECWSGSTATMCLVGSLRLTCANVGDSKAVLCRAGKPIELSVDHRPTTLTTSGRGEIKRVVEAGGWVSQSRVCGVLAVTRALGDYEFKGGRFELLAELQDMDDRQAATATMQTPPVISIPHCVTLARSSEDEFLILATDGLWDTMNGAQAVTFVRTELKKTPDKSMQAVADALVARALRCRTQDNVACIVIKLNK

SEQ ID NO: 41715 - protein, 483 aa, Pseudomonas fluorescens Pf-5
MSDNHHNYIAGQWLKGASEIENRNPSDTRDLIGLYAQASRAQLDSALAAASEAQRIWARSGLEQRYKVLMAIGQELMQRSAEIGRTLSREEGKPMAEGAGEVYRAGQFFTYYAAETLRQLGQTADSVRDGIEIDIRREPIGVVAIISPWNFPMATACWKIAPALAFGNAVVWKPANLTPASAVILSEIIARQDLPAGLFNLVMGAGSEIGQALIEHPGINAISFTGSVDVGKGIAASAAANLTKVQLEMGSKNALAVMDDADLDLAVSCAVNGAFGGTGQKCTASSRLIVHAGIHDAFVEKLLAATQALKVGHALEAGTQIGPVASAAQLEANLANLQLGQQEGAELLTGGQRLELESPGYYQAPALFIGGSNAMRINREELFAPIACVIKAGSYEEALSLVNDTRFGLTAGIMTRSLARASHFRRNARVGCVMVNLPTAGTDYHVPFGGRGESSYGPREQGRSAVEFYTHVKTGYIAAGAPL

SEQ ID NO: 41716 - protein, 373 aa, Staphylococcus aureus subsp. aureus Mu50
MAELQRGLEGVIAAETKISSIIESQLTYAGYDIDDLAENAQFEEVIFLLWNYRLPNEEELAHLKGKLNQYMTLNPRVYTHFEEYVTDHVHPMTALRTSLSYIAHFDPDAENESDENRYERAMRIQAKVASLVTAFARVRQDKEPLKPNPDLSYAANFLYMLRGELPTDIEVEAFNKALILHADHELNASAFTARCAVSSLSDMYSGIVAAVGSLKGPLHGGANEQVMTMLSEIGSIENVDAYLDEKFANKDKVMGFGHRVYKDGDPRAKYLREMSRQITKDAGREELFEMSVKMEKRMAEEKGLIPNVDFYSASVYHCMEIPHDLFTPIFAVSRSAGWIAHILEQYKDNRIMRPRAKYIGETNRKYIPLEERK

SEQ ID NO: 41717 - protein, 323 aa, Triticum aestivum
SDFIATMVAREHERSSCITYDCVGDDTVDLLVEGDLDVVSAVAALAAARPASAVGVSHRDALQACAHHARLWLARADEPIHPGSSVTYAAVRAKLDRIMASDYYTAAAVGGGSYGAEGVQAQESMTASPEASAVEENLAAEDHKEEKEDSHATEIYNDHQSDSADVQNVDREAPVNPPEEYPSVQAEQEKFDMEEQDERDAEPKEQQFQHPRRSHQNQRGGGRGRRGAYPNGRGGRGGGRGMGGGYQNGRGYQGGGGGYQGGGGGYQNGRGGGGGYYNNNEEGYYQPRNFNNRGRGGRSGGGNSYYSNQGGGHAYAERVEANA

SEQ ID NO: 41718 - protein, 610 aa, Oryza sativa
MKSHGSRDKLQAAASSSHRRVLLLLFATCFALATFVTFVYNTSHFASASGSGAAADSSGGGASAGSGTGAVSALPLPVFDALVHFASISNAAPPAALFIIGVEISERFAFGGISGNLITYLTGPLGQSTASAAAAINAWNGAALLLPLLGAAVADSWLGRYRIIICASLLYILGLGMLTLSPVLVPHQQAESGDNADNNASSSMDIHVAFFYLSLYIVAFAQGGHKPCVQAFGADQFDENDPEECASRSSFFNWWYFGIYGGNVITVSILNYIQDNIGWQLGFGIPCIAMSLSLAVFLLGTKSYRFYPLRSNTSLFDQVGKSLLAKIRWWCASWCSKSSGDLHCTQASSSQGDHNDAEKACFPDEATAVLKLFPIGATCLIYAIVFAQWITLFTKQASTLDRWIGKVHIPAAALQSLISVSIVISVPIYDRILVPLTRRYSKNPRGITTLQRIGIGLIISVILMVVSALVETRRLMVARDFGLVDNPEATIPMSFWWVVPQFILTGLADMFTMVGLQEFFYDQVPDGLRSLGLALYLSIFGIGSFISSFLVYAIDKVTSMTGDSWFSDNLNRGHLDYFYWLLAVLSVLGLAAYLHFSRVYVHKKKGISVQ

SEQ ID NO: 41719 - protein, 302 aa, Synechococcus sp. CC9605
MGWSAADIPNQQGRIALITGANSGLGLETARALKRCGATVVLACRSPRKAELAKQELLQERDGGAVDLVDLDLADMTSVERAAATVGERYGCLDLLINNAGVMAPPRRTTAQGHELQFGVNHLGHMALTQALLPLMQNRPDPRVVTVTSGAQYFGKIRWDDPSWSKGYDRYGAYGQSKLANVMFALELDARLHKKGSPIRSLAAHPGIARTELQPTAIANVGNRFEALAYRLMDPLFQSAGMGALPQLHAATAATAQGGEHYGPEQFGGLRGAPALCRVAPAASQPAERQRLWSLSEELLSA

SEQ ID NO: 41720 - protein, 336 aa, Colwellia psychrerythraea 34H
MTIKIGINGFGRMGRLSMRAAFDWDDIEIIQINDPAGNAETMAHLMTFDSIHGRWHHEATHEGDSIVINGKAISYTQNTATSDTDWSQCDVVIEASGKIKTKTLLEAYLAQGVKRVVVTAPVKEEGVLNIVMGVNEELYDKAIHPIVTAASCTTNCLAPVVKVIHEKIGIKHGSMTTIHDITNTQTILDAPHKDLRRARACGMSLIPTTTGSATAITHIFPELKGKLNGHAIRVPLANASITDCVFELARGTSVEEVNQLLKEAAEGELKDIMGYEERPLVSIDYKTDPRSSIIDALSTMVVNDTQVKLYVWYDNEWGYANRTAELALMVGLADKV

SEQ ID NO: 41721 - protein, 307 aa, Staphylococcus aureus subsp. aureus Mu50
MNAAVRAVVRTAIYNEIEVYGVYHGYQGLLNDDIHKLELGSVGDTIQRGGTFLYSARCPEFKEQEVRKVAIENLRKRGIEGLVVIGGDGSYRGAQRISEECKEIQTIGIPGTIDNDINGTDFTIGFDTALNTIIGLVDKIRDTASSHARTFIIEAMGRDCGDLALWAGLSVGAETIVVPEVKTDIKEIADKIEQGIKRGKKHSIVLVAEGCMTAQDCQKELSQYINVDNRVSVLGHVQRGGSPTGADRVLASRLGGYAVDLLMQGETAKGVGIKNNKIVATSFDEIFDGKDHKFDYSLYELANKLSI

SEQ ID NO: 41722 - protein, 430 aa, Campylobacter coli RM2228
MKTQMLYAKEGIFTKEMEIVAQKEEVSKDFLLENIACGKIIIPANINHKSLDPNGIGLGLRTKVNVNLGVSNDCVDYSEEMKKVELAHKFGIEAIMDLSNYGKTSRFRDELIVVSKAMIGTVPVYDAVGFLEKDLKQISARDFLDVVYHHAKSGVDFMTIHAGINSRAARVFKESKRLTNIVSRGGSVLYAWMVMKEAENPFFEYYDDLLEICLKYDVTLSLGDALRPGSTHDASDAAQISELIELSLLTQRAWEAGVQVMIEGPGHMAINEIEANMQIEKRICKGAPFYVLGPLVTDIGAGYDHISGAIGGAVAAAAGADILCYVTPAEHLRLPNLNDVRDGIVATKIAAHAGDLAKLPKERKRDDEMSKARQDIDWEKMFKLAIDGEKAKKMFNERRPDDLNSCSMCGKMCAMNTMNQVLKGENVSLV

SEQ ID NO: 41723 - protein, 459 aa, Zea mays
LYAARERRGPSAKKTPHRPLHRPITRRRAMAAATATGDSVKEPLLHRAYPSQVASASSPALPSALPGSAGRRFPGVLDVPNLKKRGGGTRSWIRVEAVTASVQTLEIDKATMMRRCELPARDLRLLDPLFVYPSTVLGRERAIVVNLEQIRCVITADEVLLLNSLDSYVLQYAAELQRRLLQRAEGDQLPFEFRALELALEAACSFLDAQAAELEIEAYPLLDELTSKISTLNLERVRRLKSRLVALTRRVQKVRDEIEQLMDDDGDMAEMYLTEKKMRMESSVFGDQSLLGYNSAGAAGASVSAPVSPVSSPTESRKLEKAFSLCRSRHDSTKSSDNTTTDHIQELEMLLEAYFVVIDSTLNKLTSLKEYIDDTEDFINIQLDNVRNQLIQFELLLTTATFVVAIFGVVAGIFGMNFETSVFKIENAFQWVLVITSVVGVFIFCSFIWFFKYKRLMPL

SEQ ID NO: 41724 - protein, 364 aa, Brexia madagascariensis
VQSQKLAVRAISRLQSLPGGDIKLLCDTVVESVRDLTGYDRVMVYKFHEDEHGEVVAESQRPDLEPYIGLHYPATDIPQASRFLFKQNRVRIIVDCHASSVRVIQDDGLMQPLCLVGSTLRAPHGCHAQYMENMGSIASLAMAVIINGNDEEVIGGRNPTRLWGLVVCHHTSARCILFPLRYACEFLMQAFGLQLNMELQLAAQLLEKHVLKTQTLLCDMLLRESPTGIVTQSPSIMDLVKCDGAALYYQGNFYPLGVTPTEAQIKDIVEWLLAFHGDSTGLSTDSFADAGYPGAALLGDAVCGMAVAYITNRDFLFWFRSHTAKEIKWGGAKHHPEDKDDGQRMHPRSSFKAFLEVVKRRSLP

SEQ ID NO: 41725 - protein, 119 aa, Triticum aestivum
HYRTSLYKKAGWYRSGIPGISSTHASELSAMELGKHKIRVNAVCRGLHLGDKFPVSVGEEKAEKATGEVMPLRRWLDPEKDLASTVLYLVGDDSRFMTGTTIYVDGAQSIVRPRMRSFL

SEQ ID NO: 41726 - protein, 213 aa, Glycine max
MKGSFLHDLANGISVASTYHVGKSSKRYLLPDSCGKYSKSITKSKQNRAPFHHKSGFLQRFREHVRLGPKITDTVKGKLSMGARILQVGGVEKVFMQLFSVREGEKLLKASQCYLSTTSGPIAGLLFISTHKVAFCSDRSIKISSPNGDDVRVHYKVSIPLTKLKSVNKSQNVEKPSQKYIEIVTVDNFDFWFMGFFNYQKALRCLQQAVPQA

SEQ ID NO: 41727 - protein, 961 aa, Magnetospirillum magnetotacticum MS-1
MLIKKRDGEARKSALSQTLASVSGGSMDRRAFLRRSGLTAGGAALLGGIGAGTVRKAEAVPAASDPKAEVKKAICTHCSVGCTVNAEVSNGVWIGQEPAFDSPINLGSHCAKGAAVREHAHGDRRLKYPMKLEGGKYKRISWEQAITEVGDRLLKIRETAGPDSVYWLGSAKFSNEQAYLMRKFAALWGTNNIDHQARICHSTTVAGVAQTWGYGAMTNSYNDIHNSKAMFFIGSNAAEAHPVAMLHILKAKEQNKAPLIVCDPRFTRTAAHADEYVRLRPGTDVPLIWGIMWHIFENGWEDKEFIRKRVWGMDQVRAEVAKWTPEETERVTGVPGAQLKRVAQILATHKPGTVVWCMGGTQHTVGNANVRAYCNLQLALGNVGVAGGGTNIFRGHDNVQGATDMGLDVTTLPAYYGLAAPAWKHWARVWGLDYDYIKGRFKTPELMEAPGIPVSRWYDGVNEAKENIAQPEPIKAMVYWGHAPNSQTRQPELKKAMEKLDTLVIIDPYPTVSAVLHDRTDGVYLLPAATQFEVDGSRTASNRSIQWSEQVIKPMFECKADQEIMYLFAKKFGFAAELCKNIKVEGDKPQAEDILREINRGAWTIAYTGQSPERLKAHMANQQTFDKTTLKAVGGPCDGDYYGLPWPCWGNAEMKHPGTPNLYDPSKPVKDGGLNFRALFPEYKGESLLATDSWPEGSELPAGHPGFTYGMLKKLGWDKDLTADELAVIQKIGGEKADDVAWTIDLSGGIQRVAVMHGAAPFGNGKARAVVWNFPDPVPLHREPLYTPRRDLVEKYPTHADKKMMRLPFLYKTIQDKDVSKEFPIILTSGRLVEYEGGGDETRSNPWLAELQPDMFVEVNPFDANNAGVRAGDYVWVFGPEGGKVKVKARITERVGRGVAFMPFHFGGWFQGKDLRSKYPEGASPIVLGESTNTAQTYGYDSVTGMQETKVTLCRIEKFQA

SEQ ID NO: 41728 - protein, 90 aa, Zea mays
PKPAPSPYVRALKELQVSEEHTLVLEDSPVGIRVGVAACTPVVGVAMRNPHKSLVKAGPALLVKEYKDHKLWAALEEIHEEEDKPKKVSE

SEQ ID NO: 41729 - protein, 518 aa, Nicotiana tomentosiformis
MVFPVEAIVGLVTFTFLFYFLWTKKSQKPSKPLPPKIPGGWPVIGHLFYFDDDGDDRPLARKLGDLADKYGPVFTFRLGLPLVLVVSSYEAIKDCFSTNDAIFSNRPAFLYGEYLGYNNAMLFLANYGSYWRKNRKLIIQEVLSASRLEKFKHVRFARIQTSIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHIKKREKIMEVGTEGNEQDFIDVVLSKMSNEYLGEGYSRDTVIKATVFSLVLDAADTVALHINWGMALLINNQNALKKAQEEIDTKVGKDRWVEESDIKDLVYLQAIVKEVLRLYPPGPLLVPHENVEDCVVSGYHIPKGTRLFANVMKLQRDPKLWSNPDKFNPERFIARDIDFHGQHYEYIPFGSGRRSCPGMTYALQVEHLTMAHLIQGFNYRTPTDEPLDMKEGAGITIRKVNPVKVIITPRLAPELY

SEQ ID NO: 41730 - protein, 168 aa, Oryza sativa (indica cultivar-group)
MAAVMVARQGRELQRYSDNTGGRMVVGCIPYRVRGDGGGVEVLVISSQKKGAAAGDVVMFPKGGWELDESVDEAARREALEEAGVLGEIGASLGRWCYRSRRYDATYEGFVFPLRVTDELDRWPEMAARRRSWVSPQQAMDRCPHWWMREALQRFADLFPQSTALSLL

SEQ ID NO: 41731 - protein, 359 aa, Synechocystis sp. PCC 6803
MLTAERIKFTQKRGFRRVLNQRVDAYFAEHGLTQRDNPSMYLKTLIIVLWLFSAWAFVLFAPVIFPVRLLGCMVLAIALAAFSFNVGHDANHNAYSSNPHINRVLGMTYDFVGLSSFLWRYRHNYLHHTYTNILGHDVEIHGDGAVRMSPEQEHVGIYRFQQFYIWGLYLFIPFYWFLYDVYLVLNKGKYHDHKIPPFQPLELASLLGIKLLWLGYVFGLPLALGFSIPEVLIGASVTYMTYGIVVCTIFMLAHVLESTEFLTPDGESGAIDDEWAICQIRTTANFATNNPFWNWFCGGLNHQVTHHLFPNICHIHYPQLENIIKDVCQEFGVEYKVYPTFKAAIASNYRWLEAMGKAS

SEQ ID NO: 41732 - protein, 445 aa, Oryza sativa
MAIEKIQARMVLDSRGNPTVEVDITTEKGLFRAAVPSGASTGIHEAVELRDGDKNAWMGKGVSKAIDNVNNIIAPELIKSGLPVTSQKEIDDFLIKLDGTANKGKLGANAILGVSIAVAKAGAGEQGLPLYKYLANLSGVKAPYVLPAPAMNVINGGSHAGNALAFQEFMIVPTGAKSFTESVKIGTEVYHNLKKVINTKYGIDATNVGDEGGFAPNVQSADEALEILTEAIAKAGYEGQVHISLDVASSEFYKEGKYDLDFKNPNSDSSKWLTGKELADVYLGFIKKYPITSIEDPFDQDDWEAWSHLRANAGITIIGDDLTVTNPLRIKTAIEKKACNGLLLKINQIGTISESIQAAQLAQSDNWGVMVSHRSGETEDVTISDLVVGLGVGIIKTGAPCRSERTAKYNQLLRIESLEPSAVYAGIDGFTQGETAPKVITNKSA

SEQ ID NO: 41733 - protein, 397 aa, Arabidopsis thaliana
MMKKRKRKVSKENVALTISSSVGEYGENSGTLPTDLMVEILSRVPAKSAARFRCVSNDWNSLLRSPYLTNLFLKRSSARPHLLITFQAEGKWSFFSSPEYLISDQNSNLVVVDNHMDVPKDYSFGVCVPVCGLMCTSNEWVLSRKRDARMMICNPSTGQFKSLPKVRSCRGNVITYIGYNPIEKQYKVLCMTIREKPFKFKAEEHQVLTLGTGKLKWRMLECSVDHYPYYHGSICINGVLFYLAMKSESKEYMTVSFHMKDENFMFIPNQDLLSTLINYKGRLGGIRHKSFGFMDGGDVGFELWILDVVNQEWIRSIHVLPPMWKDVVGETRVYFVGIIGSCEVVFSPFVKSNPFYIFHLDMKSNSITRVEIKGTGPLEGQAVYTFVNHIENVNLIM

SEQ ID NO: 41734 - protein, 750 aa, Cryptococcus neoformans var. grubii
MAVSQSHPNIVDGWFREINTQWPGQAMTLKVKQILHQEKSLFQDVLVFESETYGNVLVLDGVIQATERDEFSYQEMITHLPMASHPNPENVLVIGGGDGGVIREVLKHKSVKKVTLCDIDEAVIRVSKQWLPLMSDCYKDSRVEVHIGDGFKFLPEHKNEYDVIITDSSDPVGPAEALFQPPYFQLLKEALKEGGSVSTQAECLWVHLPLIKTLKETCSKLFPVVKYGFTTIPTYPAGQIGIMVCSKDSTRDLTVPLRAVPDTRYYNSEVHRAAFTIPEFGRAMLEDGVNVLPKFSGARPTPTTTKKKVLLLGSGLVAGPAADYIARHNHELTIACRTLASAQDLASGLPNATPMSVDVSSADALRQAIKGHDVVVSLIPYTYHAQVMEAALEEKVHVVTTSYVNPQMRALEQKFKDAGLICFNEIGVDPGVDHLWAIKVFDEVKKAGGKIKSFYSFCGGLVEPAAADNALGYKFSWSPVGVLMALNNDGKYLKDGKVVEVAGKDLMSTAKPYYFTPAYNLVAYPNRDSTVFREFYGLEGVQNLCRGTMRYAGFCEVITAWKEIGLMSDAQVDYLAQGAAPITWIKVVSQLLGVEAKEAAVIEKLKTLKSFETESRVLITKFRDLGLFSEEQVAQRGSVMRALSALLEEKCAFKEGEVDLVLLQHTFEIINADGSEQTITSSLEAYGDRNGGPSAMAKLVGVPCGMAVQFILEGVLNKPGVFAPYDEETCKLFRERLEKEEGITMVEKLV

SEQ ID NO: 41735 - protein, 228 aa, Methanosarcina acetivorans C2A
MCKNMTKEYVKGDLPEKAAILQRDGETYAIAPHIPGGIVYPETLRKIADIAEKYGAAALKVTSAQRIAIVGLKEENLDAAWGELGMSPGAAIGLCVRSIKICPGTTFCKRGKQDSVGLGLKLDKKYHGMQLPSKFKMAVSGCPNSCSETSIKDLGIMGTAKGYNLTVGGSAGPSPRLGDLVAKDLSEEQVLDLVEKIINFYKGYGKPKRLGKVIDEIGIEKFKEEIGL

SEQ ID NO: 41736 - protein, 385 aa, Cytophaga hutchinsonii ATCC 33406
MKAAVFHKPGHISVDTVEDPKIEKSDDIILKVTSTAICGSDLHIYDGFFPQARPLIMGHEFMGIVEEVGNAVTHLKAGDRIVVPFPIACGHCYFCNHDMQPNCEHSNPEHYGPEGDVLSGKGGGLFGYTDLYGGYAGGQAQYVRVPYADYSPRLVPESLSDEQVLFLTDIFPTGWSAIDWAQLKGGETVAIFGSGPVGLMAQKAAWLKGAGRVIAIDPLNYRLAKAKMVNNVETLNPHEVDVIEAIRAMTNGRGADVCVDAVGVEAERTFFDKVKAVVRFEKGTDKVLENCFKAVRRGGTVTVVGVYGTPYDNFPLHTMFDKGLTVRLGQAPVQKYIDHLFTLVQNEKVVLNDIVTHVLPLSHASHAYDIFKNKQEDCVKVILKP

SEQ ID NO: 41737 - protein, 300 aa, Burkholderia pseudomallei K96243
MANGTQDGIQIRGSVPAIVTPMLEDGGLDLAAFRKLIDWHIEEGTDALVVVGTSGESATLSVDEHVLMIETAVKHAAKRIPIVAGAGGNSTTEAIELSKHAKAVGADATLQVVPYYNKPTQEGIYRHFKAIAEAVDLPVILYNVPGRTVADMSNETTLRLAQVPGIIGVKDATGNIDRAAQLIKAAPAHFSIYSGDDPTAIALMLLGGHGNISVTANVAPRAMSELCRAALAADVKTAREIHMKLLSLHKHLFIEANPIPVKWALQQMGKIAGGIRLPLTPLDERCHETVRGALREAGLL

SEQ ID NO: 41738 - protein, 131 aa, Hyphomonas neptunium ATCC 15444
MTPFPPPLSGSAQDETPELRPRFDENGLIAAIAQDAGTGEVLMLAWMNAEALQKTIETGRATYWSRSRGALWVKGETSGHTQEVIELRVDCDQDAVLLKVRQTGGACHTHRESCFYRRIEGGVLSFTGKAD

SEQ ID NO: 41739 - protein, 365 aa, Cytophaga hutchinsonii ATCC 33406
MFSILSCSEHAEKKTTTEVIQKETKDSIVKENKKKDLKPAGEAPEWGKSMTPEMLVVIEKLKSLGGKPIETLDAKEARQQPTPADAVLAVMKDYDMTMPPALCDTVNKQIPVTGGTTTIRIYTPKQGTAPYPVIVYYHGGGFVIADLDAYGASAQSLCEQSGAVVVSVEYPKGPEHKFPAAHNVCFDAYKWIIKNAASLNADASKIALVGESAGGNIAINVSILARDKKIQMPLYEVLIYPVVNNDLNAESYVTYAAAKPLNKPMMEWFVKNYLNTPKQSEDPRISVVRANLNGLPPTLIIGAEIDPLQSEGELLNKKLKDAKVDSQYELYKGVTHEFFGMAAVIPQAKDAQALAVKKIKAAFDK

SEQ ID NO: 41740 - protein, 409 aa, Staphylococcus aureus subsp. aureus Mu50
MSLRDEALEMHKRNQGKLEVKPNVKVTNKEELSLAYSPGVAEPCKDIYEDKRKVYDYTIKGNTVAVITDGTAVLGLGNIGPEASIPVMEGKAVLFKSFAGINGVPIALNTTDTEEIIKTVKLLEPNYGGINLEDISAPRCFEIEERLKKETNIPVFHDDQHGTAIVTMAGLVNALRVVNKDIAKIKVVLNGAGAAGIAIVKLLYAYGVRNMVMCDSRGAIFEGRSYGMNPTKDVVAKWTNKDKIEGSLEEVVKDADVFIGVSVANALSQDMVKSMADNPIIFAMANPNPEIIPDDAKAAGARVVGTGRSDYPNQINNVLAFPGIFRGALEVEATHINEEMKKAAVEAIADLIDSSELNEDYCIPGPFDKRVAPSVARNVAKAAMESGVARIEVDPQDVYDKTMKLTDLQ

SEQ ID NO: 41741 - protein, 436 aa, Polaromonas sp. JS666
MKLADNKATLSFSNGSPSVDLPVYHGSVGPDVVDIRKLYAQTGMFTYDPGFLSTASCQSAITYIDGDKGELLYRGYPIEQLATTCDYMETCHLLLYGELPNGDQKKDFVSRVTNHTMVNEQMQFFLRGFRRDAHPMAIMTGLVGALSAFYHDSTDITNPEHREIAAIRLIAKMPTLVAMAYKYTVGQPYMYPKNNLSYAGNFLHMMFATPCEEYKVSPVLERALDRIFILHADHEQNASTSTVRLCGSSGTNPFAAIAAGVACLWGPAHGGANEAALNMLGDIQKNGGVEKIGDFIKQVKDKNSGVKLMGFGHRVYKNYDPRAKLMQETCKEVLHEMGLENDPLFKLAMALEKIALEDDYFVSRKLYPNVDFYSGIVQRAIGIPVPLFTAIFALARTVGWIAQLNEMIGDPEYKIGRPRQLFTGSIPRDVKPMAQR

SEQ ID NO: 41742 - protein, 348 aa, Zea mays
MSDLSRTVPQEQLVSQDLLHLSPTPVINLGHLSLDDSVTRSGVINQIARACHDLGYFQVTNHGISQSVMDCAVEAASDFFQLPSEAKEQFASQDLRKPVRYDTSSKDSISMSRAFLKHYAHPPRDWIQYWPDKPPIYREYMGKYAVEVRRVALHLMQAILEGLGLGKEYMNEKFQQGSQLLSVNCYPKASQDAMTIGLAPHSDYGFLTILLTSCQGLEVVDRSSNNWKTVQQLPHALHVHVGDHMEVLSNGQIKTVVHRAVLNPEEARISIASIHGFELHEKVACAKELVDEQNPPKYKESSFTDFLDHLTANMDNKNRNFLESLRMLTGALISEKADRAKVYCHMLN

SEQ ID NO: 41743 - protein, 482 aa, Bacteroides fragilis NCTC 9343
MNHTNEGSKLYLYSITSVAILGGLLFGYDTAVISGAEKGLEAFFLTATDFQYDKVMHGITSSSALIGCVLGGALSGIFASRLGRRNSLRLAAVLFFLSALGSYYPEFLFFEYGKANMNLLITFNLYRILGGIGVGLASAVCPMYIAEIAPSNIRGTLVSCNQFAIIFGMLVVYFVNYLILGDHQNPVILKDAAGTLSVSSESDMWTVTEGWRYMFGSEAFPAAFFGMLLFFVPKTPRYLVMIDQDQKAYSILKKVNGATKAQEILAEIKATSQEKTEKLFTYGAAVIVIGILLSVFQQAIGINAVLYYAPRIFENAGAEGGGMMQTVIMGIVNIVFTLIAIFTVDRFGRKPLLIIGSVGMAVGAFAVALCDSMGIKGILPVLSVIVYAAFFMMSWGPICWVLISEIFPNTIRGKAVAIAVAFQWIFNYIVSSTFPALYDFSPMFAYSLYGIICVIAALFVWRWVPETKGKTLEDMSKLWKKR

SEQ ID NO: 41744 - protein, 489 aa, Oryza sativa
MVEDEDYGGGRRRLGQRGQRMSSLLQAVCEHLGVDLCEGDDSPRRLGTFSSSPTPHAAASTSSPPLSFPNADLVLRLDPCPDYEVDFDVSEDHHSSIDLHVSSAPLLHSHYFGALLSDRWSPAPTSIARREERRRQRENSIRSIAKSSKTLQRGNHSIHSIAQPSKTLRRRDYLVVGEDEEATLPCTSWAPPAVRPSGTPQVLQGVAGPPSRAPPAAHLGRCRPSVQGVAGSPSRALAASVQVTIDCQSRDRRQSVPLRPPRLSTTLSTMPVEDDMSNQLDENGMSSEPVTQQFPTIERTTVARPNQKRSKNFSEQEDKILVSAWLHVSLDPVLGTNQTRAAYWTRIYEHLYKTSKSTPDRSQNSLMHRWKTIQENVNKFCGYLSQIEGRRQSGVSIHDKIAQAIAVFKELEDKPFQFLHCWTLLRSQSKWHDKMKQITSQKPCATKKQKASTDGLGKAIPTNDDTTNHVDEDNEPTETEEPKIKYLAA

SEQ ID NO: 41745 - protein, 637 aa, Solibacter usitatus Ellin6076
MLPTSRTAEESRSLADVHSSVGTSQVSFWKRMFAFAGPAYLVSVGYMDPGNWATDLEGGARFGYKLLWVLVMSNLMAVLLQTLSARLGIVRGRDLAQACRETYPRAVNLALWALCEIAVAACDLAEVIGAAIGLNLLFHIPLLMGVLITSADTLLLLWFQSFGIRTIEAVVLALITVIAACFCIEIFWARPAVSELFTGLVPRLNGSSLYVAIGILGATVMPHNLYLHSALVQTRNIGQSEAAKRTACKYNFIDSVVALNGALLVNAGILVMAAAVFFRRGIVVTEIQQAHLLLAPLLGTGLAGVLFAIALLASGQSSTLTGTLAGQIVMEGFLNFRMRAWLRRLITRTIAVAPAAFTIWYAGEKSTYQLLILSQVILSMQLPFAVIPLIHFTSDRQRMGNFANALWVRILAWLTAAVIIALNIRLAAAAIADWLDAAGRWKPLVIAGLVPVLGGFLLLLLWVSFEPLLSGRTGKYGRSPVSLPEPAGAEVPAPIYQRILVPLDHTDLDRLAISHAVAMGKLYGARVYLLHVEEGVTSQIYGGDASSAEEEAGQRYLERVAQSLRDQGVTVETAIRHSSSPTKEILSYAREVGPDLVIMGAHGHGGLKDLIFGTTISPVRHHLQVPMLIVRPGKPKN

SEQ ID NO: 41746 - protein, 678 aa, Oryza sativa (indica cultivar-group)
MARGGNSNNGEQGHPCPIFYENPSSNGVIFSRESNGKYSIFQSFFMVAVMASSALICDTEQWKGLQAHYDFVFRHACGGEQAHVGAIQKTHLRNLMDDAERCKAMTAEYEGIFLDYSRQRATGETMEKLFKLAEAAKLKEKIEKMFSGDKINSTENRSVLHVALRAPRDEVIKSDGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPAILPYSQALEKFAPHIQQLSMESNGKGVSIDGVQLSFETGEIDFGEPGTNGQHSFYQLIHQGRVIPCDFIGVVKSQQPVYLKGEIVSNHDELMSNFFAQPDALAYGKTPEQLHSENVPEHLISHKTFQGNRPSLSLLLPSLSAYEIGQLLSIYEHRIAVQGFLWGINSFDQWGVELGKSLASQVRKSLHASRMEGKPVQGFNSSTASLLTRYLALLSIYEHRIAVQGFLWGINSFDQWGVELGKSLASQVRKSLHASRMEGKPVQGFNSSTASLLTRYLAVEPSTPYNTTTMPKV

SEQ ID NO: 41747 - protein, 374 aa, Catha edulis
ASSIAGAVQSQKLAVRAISQLQSLPGGDIKLLCDTVVESVRDLTGYDRVMVYKFHEDEHGEVVAESKRPDLEPYIGLHYPASDIPQASRFLFKQNRVRMIVDCRASPVRVIQDDGLMRPLCLVGSTLRAPHGCHAQYMENMGSLASLAMAVIINGNDEEVTGGRNPTRLWGLVVCHHTSARCIPFPLRYACEFLMQAFGLQLNMELQLAAQSLEKHVLKTQTLLCDRFLRDPPTGIVTQSPSIMDLVKCDGAALYYQGNYYPLGVTPTEVQIKDIVEWLLAFHGDSTGLSTDSLADAGYPGAALLGDAVCGMAVAYITNKDFLFWFRSHTAKEIKWGGAKHHPEDKDDGQRMHPRSSFKAFLEVVKSRSLPWEN

SEQ ID NO: 41748 - protein, 478 aa, Colwellia psychrerythraea 34H
MTSSEPDNSIQKLHDTEEVQTSFLYVLFISSVAAIGGFLFGFDSGVINGTVTALGNAFNASDVASGFNVASVLLGCAVGALMAGPISDRFGRKPIMIITAIIFAISAFGSGISSSSAEFIFYRLIGGLGIGAASVLAPAYIAEVAPAALRGRLATLQQLAIVLGLFAAFLSNFLIASVSGGAEAMLMLDIAAWRWMFWVELLPAVLFLVGVIFIPESPRYLVAQGKIEEARTIFKRIATGVENEQIEEVKKSLHGDKKPSIRDLFIDGKKKIHPIIWIGIGLSVFQQFVGINVVFYYGAELWQAAGFDESQSLFINLIAGTTNIISTFIAIALVDKIGRKPLLLVGSVGMFISLGALTFIFGTGGLDEAGKLALSDTTGTVALIMANLFVVFFGLSWGPIVWVLLGEMFNNRIRGAALAIAASAQWLANFAITMTFPILLGSFGLAGAYGLYTVSALLSIFFVIKYIKETRGIRLEEM

SEQ ID NO: 41749 - protein, 897 aa, Bradyrhizobium sp. BTAi1
MTTVDPKLRTVRTACPYCGVGCGVLATPDGSGGAAISGDPVHPANLGRLCSKGSALGETLGLESRLLYPMVRCKHGLERVAWSDALDHVASRLKHIVARDGEDAVAFYLSGQMLTEDYYVANKLMKGFLGSANVDTNSRLCMASSVAGHRRAFGSDTVPGSYEDLDQADLLVFVGSNAAWCHPVLYQRMLANKQGRGAKFVVIDPRRTDTASEADLFLGLKPGTDAALFSGLLVHLADSGALDRDYIARHTSGFDETLARARSLAGSAAATALATGLSETDVAAFFKLFRETPKVVTLYSQGVNQSAQGTDKVNAILNCHLATARIGRPGMGPFSLTGQPNAMGGREVGGLANQLAAHMSFTPPEIDRVRRFWKAPDIATHEGLKAVAMFEAIARGQIKALWVIGTNPAVSLPDADLVRAALKKLELFVVSENVRSNDTVDAGVHVLLPAQAWGEKSGTVTNSERRISRQRAFMAPAGEARPDWWILSEVGKRLGFAQAFNYNSAADVFREHAALSAFENEGSRDFDIGALATLTDEEYEAMAPVQWPARAGKPPEPRVFADGSFFTNDRKARFVAPDVPALRSETTAARPLRLNTGRIRDQWHTMTRTGLSPRLSAHLPEPFVEVHPDDALRYGLMHDGFAKVTTEHGQCILKVVVSERQQRGMLFAPIHWNATNSSHGRVGALVAAHTDPFSGQPEAKATPAAISPYEYVFRGFILSRSELPLPPNLWWVRATVPGGFGYLFADNGDLMRWPAWFKARASDDVADYMDVGGGVYRAASFAGDRIETCMFVGPGHDAGDWNVVKTMFAADSLDDEQRRMLLSGRAPDGTGGGPIVCACFGVGRDTICDAIASGARTPAAIGARLKAGTNCGSCIPEMKRLIAQTATQAADAVKVAS

SEQ ID NO: 41750 - protein, 373 aa, Celastrus scandens
ALSIAGAVQSQKLAVRAISRLQSLPGGDIKLLCDTVVESVRDLTSYDRVMVYKFHEDEHGEVVAESKRPDLEPYFGLHYPSTDIPQASRFLFKQNRVRMIADCRASPVGVIQDDGLMQPLCLVGSTLRAPHGCHAQYMENMGSKSSLAMAVIINGTDEEVIGGRNATRLWGLVVCHHTSARCIPFPLRYACEFLMQAFGLQLNMELQLAAQLSEKHVLKTQTLLCDMLLRDSPTGIVTQSPSIMDLVKCDGAALYYQGKYYPIGVTPVEAQIKDIVEWLLTFHGDSTGLSTDSLADAGYPGAALLGDAVCGMAVAYITKKDFLFWFRSHTTKEIKWGGAKHHPEDKDDGQRMHPRSSFKAFLEVVKSRSLPCE

SEQ ID NO: 41751 - protein, 439 aa, Bradyrhizobium sp. BTAi1
MDPRGRRSLDRGLRHAVRLHDFGSLWQRTGSGVGPLSEPLVIVGNGMAAAKLVEELSQTALGRYAIAVIGEEPRLAYNRVLLSSVLAGEAASHEIELKPAAWWRERGVTLKYGARVTRIDVGRRELEVENEENMAFSRLVLATGSLPLRLPVPGADLAGVHTFRDSRDTDVLLSLAAKKSRVVVVGGGLLGLEAAYGLARAGAKVTLLHLMDRLMERQLDASAAALLKVLVERKGIEVLLQASTAAIHGELRVERVELADGRSLAADAVIFAAGIRPNVALAKEAGLAVNRGIVVDDALQSSVPGISALGECAEHRGTCYGLVEPAYEQARVLARHLAGRKAAYQGSVVATNLKVSGVAVFSAGDFVGAPGSEAIVLNDARRGIYKKLVIADGRLTGAVLIGDTQDALWYRDLIRNREPIASIRTEMMFGRAGARPRAA

SEQ ID NO: 41752 - protein, 176 aa, Glycine max
  misc_feature (115)..(115): Xaa can be any naturally occurring amino acid
  misc_feature (136)..(136): Xaa can be any naturally occurring amino acid
  misc_feature (143)..(143): Xaa can be any naturally occurring amino acid
  misc_feature (153)..(153): Xaa can be any naturally occurring amino acid
  unsure (1)..(176): unsure at all Xaa locations
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFLYHEHNRSPXYYDGRYWTMWKLPMFGCADAXKWLKDLXDAKTGYPDGXVRIMGCDTFGSADRELICYNLPR

SEQ ID NO: 41753 - protein, 104 aa, Zea mays
  misc_feature (24)..(24): Xaa can be any naturally occurring amino acid
  unsure (1)..(104): unsure at all Xaa locations
MASSMQSSYLPATTESVANAQEAXDASESISILYHVLDDPSSSAHALRVKDLAITNLTNYLTKENRADDLPNLLTQLKPFFALIPKAKSVNIERAIIDAVAQVP

SEQ ID NO: 41754 - protein, 334 aa, Geobacillus stearothermophilus
AVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASATTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 41755 - protein, 388 aa, Arabidopsis thaliana
MTTISDLPYDLVKEIFSWVPFTSLRAVRSTCKTWNALSKNQIFGKKSVARNQFLELMILDSRVCSLRFDLQKIRNEDEEDLVDPSMKQISIPNNDDQVEISRVYHCDGLLLCIPKDNSSLMLWNPYLGQTKRIRPKNTFHRDDSFALGYNNRNHKILRLNEENESHIDVYDFSSDSWRTVPDDNPYRDELIYQSGVSLKGNAYFFDREVTTEAEVGTEDLLITGIEDYLRCFDFTTERFGPRLPLPFILPSPSFEYLALSWARDDKLAVLYSHYDTFDIIEIWISTKIEPNAVSWSTFLKVDMSLINGLTDDFLIRFEPKSFFIDEEKKVAVLFDTKVTETCRYQMAYIVGDDGYFKSVNIGVISNSHWIGGELVRSSYVPSLLQLQV

SEQ ID NO: 41756 - protein, 484 aa, Burkholderia sp. 383
MMAHPRHDHPAFRAEALRWCGTRATRERTLDVMDPYTGTRVGTAPLASVDDVRAAFDYAMAYRPKLTRYERSQILERAAALLRERTEEASDLITLESGLSKQDSRYEIGRVADVLKFAAIEALRDDAQSFSCDLTPHGKARRVFSQRQPLDGVIVAITPFNHPMNQVAHKIAPAIATNNRVIVKPSEKVPLSAFYLADLLYEAGLPEPMLQVLTGDPREIADELVTHPHASLITFTGGVAIGKAIAARAGYRRIVLELGGNDPLIVLDDADLDRATSLAVLGSYRNSGQRCTAVKRMLVQRSIAPAFTELLVEKTRAWKYGDPFDPANEMGTVIDEEAARLFEARVEEAVAQGARLLTGNVRRGALYAPTVLDNVDPSMTIVREETFGPVSPVITFDTIDDAIRISNGTAFGLSSGVCTDSTAAVVRFVNELNVGTVNVWEVPGYRIELSPFGGIKDSGLGYKEGVQEAMKSFTNLKTFSLPWE

SEQ ID NO: 41757 - protein, 379 aa, Polaromonas sp. JS666
MLLPHQYGHEQPYKKIATMKIAILPGDGIGTEIVAEAVKVLNVLDLKFETETALVGGAAYEAHGHPLPEATLKLAKDADAVLFGAVGDWKYDKLDRPLRPEQAILGLRKNLGLFANFRPAICYPQLVEASSLKRELVAGLDILIIRELTGDIYFGQPRGRRVATDGHFPGAEEAFDTMRYSRPEIERIAHVAFQAARKRKASGGEGRVTSVDKANVLETFQFWKDVVTEIGLQYPDVALDHMYVDNAAMQLVRAPKKFDVVVTGNMFGDILSDAAAMLTGSIGMLPSASLNDKNQGLYEPSHGSAPDIAGKGVANPLATILSAAMMLRFSLNQPETAARIEKAVDAVLSQGLRTPDIYSEGTTKVGTVQMGDAVVKALR

SEQ ID NO: 41758 - protein, 244 aa, Cytophaga hutchinsonii ATCC 33406
MTLLKMYRHLDHFDSPGHFHHRELIHEKRNFKKRAFTVGIGGPVGTGKTAWLMQICKALRDKMNIAVVTNDIFTSEDAEFLIRNEALSKDRIIGVETGGCPHAAIREDVSQNMYALEELMKRFPDVELLFVESGGDNLAAHFSKELVDYSVYVIDVSGGDKIPRKGGPGITQADLLVINKIDLAHLVNADLSVMERDSKKMRGDGPFLFARAKDCFGIDEIINHILTAREKALEAKPVYSLRKE

SEQ ID NO: 41759 - protein, 256 aa, Triticum aestivum
  misc_feature (245)..(245): Xaa can be any naturally occurring amino acid
  unsure (1)..(256): unsure at all Xaa locations
RPVPGIVNSGVRTDSDSAVALLADHEKLNHPDPLVRTACIMGLGLAYAGSNREDILEHLQPMISDSSCDMQISAMAALSCGLIFTGSSHPEISEAIVTTLMDDDRKSQLTDKWTRFLALGLGLLFFGRQEEVDVILETLKAIEHPMAKSTAVMAEICAWAGTGAVLKIQELLHICNEHQEETDEKKGDELLQAYAVIGIALVAMGEDIGQEMVLRQFGHLMHYGEANIRKAVPLAMGLISPSNPXQMKVYDTLSRY

SEQ ID NO: 41760 - protein, 170 aa, Brassica napus
MDEVMTVADAGGSRALNGSPSSQNLLPHNLPLLSAFLAFALAQFLKVFTNWYKEKRWDSKKMISSGGMPSSHSATVTALALAIGLAEGAGSPAFAIALVLACVVMYDASGVRLHAGRQAELLNQIVCEFPSEHPLSTVKPLRELLGHTPIQVAAGAVLGCVVAYLMRSTS

SEQ ID NO: 41761 - protein, 78 aa, Zea mays
KGKLIAQKWRFEKWPHGLYSSVRLMLDKPQFGVPVIKLKQIGVPKKNKYGNSTVVENPEKGWRDFIFHGKRGMFGFGI

SEQ ID NO: 41762 - protein, 364 aa, Celastrus scandens
VQSQKLAVRAISRLQSLPGGDIKLLCDTVVESVRDLTSYDRVMVYKFHEDEHGEVVAESKRPDLEPYFGLHYPSTDIPQASRFLFKQNRVRMIADCRASPVGVIQDDGLMQPLCLVGSTLRAPHGCHAQYMENMGSKSSLAMAVIINGTDEEVIGGRNATRLWGLVVCHHTSARCIPFPLRYACEFLMQAFGLQLNMELQLAAQLSEKHVLKTQTLLCDMLLRDSPTGIVTQSPSIMDLVKCDGAALYYQGKYYPIGVTPVEAQIKDIVEWLLTFHGDSTGLSTDSLADAGYPGAALLGDAVCGMAVAYITKKDFLFWFRSHTTKEIKWGGAKHHPEDKDDGQRMHPRSSFKAFLEVVKSRSLP

SEQ ID NO: 41763 - protein, 344 aa, Thermus thermophilus HB27
MRAVVYKGPFQVAVEEVPEPRLEADTDALLEVELSAICGSDLHIYHGKIAGVLPGTVLGHEFVGRIVEKGPLVPFPVGERVVGSFQVACGECPACRKGQFFACSRGGVFGFGLALGNLPGAQAERVRVPFARHTLFPIGDLPAEEAILAGDILTTAYGGVRPFLTPGMSVAVVGSGPVGLMAQMVAHALGAGQVYAIDPEEARLEKAKALGSLPIHPKAEDPVARVRRETEGLGADLVVEAVGGDGEALKLALRLAGPGGVVSSLGVPTAERLDYPWLPAFSRGITLRSALANVPRWIGEVLALQKAGRLKGSFVFSHRLPLEEAPEGYRLFHERKATKVALVP

SEQ ID NO: 41764 - protein, 374 aa, Crossopetalum rhacoma
ALSIAGAVQSQKLAVRAISQLQSLPGGDIKLLCDTVVESVRHLTGYDRVMVYKFHEDEHGEVVAERKRPDLEPYIGPHYPATDIPQASRFLFKQNRVRTIVDCHASPVRVIQDDGLMQPLCLVGSTLRAPHGCHAQYMENMGSIASLAMAVIINGNDEEVIGGRNTTRLWGLVVCHHTSARCIPFPLRYACEFLMQAFGLQLNMELQLAAQLSEKHVWKTRTLLCDMLLRDSPTGIVTQSPSIMDLVKCDGAALYYQGNYYPLGVTPTEAQITDIVGWLLDFHGDSTGLSTDSLADAGYPGAALLGDAVCGMAVAYITNRDFLFWFRSHTAKEIKWGGAKHHPEDRDDGQRMHPRSSFQAFLEVVKSRSLPWEN

SEQ ID NO: 41765 - protein, 517 aa, Nicotiana tomentosiformis
MLSPIEAIVGLVTFTFLFYFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 41766 - protein, 478 aa, Vitis riparia
MRPIFCGNFDYDARQSDLERLFRRYGKVDRVDMKTGFAFIYMEDERDAEDAIRGLDRTGFGRKGRRLRVEWTKQERGIRRPSGSRRSSTNLRPAKTLFVINFDPYNTRTRDLERHFDPYGKILNIRIRRNFAFIQYESQEDATRALEATNMSKLMDRVISVEYAVRDDDERRNGYSPDGRRRDKSSERSYDKGRSLSPYRRERGSPDYGRGSSPSAYRRERASPDYGRDPSPSPRRRDRAMPDHGRSRSPSHHRRERTSHDSARGPSRSPYRSERSDRAIPDYGRGRSPSPGRREKIMPDYPDRPSLSPERKEKTGRSEKAIPDYGRGASPSSPRRERTNSDYVRANSRSRSRSQSQSPRQRERTKPDYGHERSVSPEQREKANPDHGRGPSRSSPRREYDRGPSQSPQQGERALPDYARGPSDSPYQRESISPDYDRGPSPNSKREERDSPNYGGSASPMNGRYRSRSPPARERSRS

SEQ ID NO: 41767 - protein, 374 aa, Crossopetalum rhacoma
ALSIAGAVQSQKLAVRAISQLQSLPGGDIKLLCDTVVESVRHLTGYDRVMVYKFHEDEHGEVVAERKRPDLEPYIGPHYPATDIPQASRFLFKQNRVRTIVDCHASPVRVIQDDGLMQPLCLVGSTLRAPHGCHAQYMENMGSIASLAMAVIINGNDEEVIGGRNTTRLWGLVVCHHTSARCIPFPLRYACEFLMQAFGLQLDMELQWRAQLSKKHVWKTRTLLCDMVLRDSPTGIVTQSPSIMDLVKCDGAALYYQGNYYPLGVTPTEAQITDIVGWLLDFHGDSTGLSTDSLADAGYPGAALLGDAVCGMAVAYITNRDFLFWFRSHTAKEIKWGGAKHHPEDRDDGQRMHPRSSFQAFLEVVKSRSLPWEN

SEQ ID NO: 41768 - protein, 374 aa, Cuervea integrifolia
ALSIAGAVQSQKLAVRAISQLQSLPGGDIKLLCDTAVESVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDGIGGRNPTRLWGLVVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIRDIVEWLLAFHGDSTGLSTDSLADAGYPGATLLGDAVCGMAVAYITNRDFLFWFRSHTAKEIKWGGAKHHPEDKDDGQRMHPRSSFKAFLEVVKSRSLPWEN

SEQ ID NO: 41769 - protein, 715 aa, Arabidopsis thaliana
MSLFLSFFISILLCFFNGATTTQFDFSTLAISNLKLLGDARLSNGIVGLTRDLSVPNSGAGKVLYSNPIRFRQPGTHFPTSFSSFFSFSITNVNPSSIGGGLAFVISPDANSIGIAGGSLGLTGPNGSGSKFVAVEFDTLMDVDFKDINSNHVGFDVNGVVSSVSGDLGTVNIDLKSGNTINSWIEYDGLTRVFNVSVSYSNLKPKVPILSFPLDLDRYVNDFMFVGFSGSTQGSTEIHSIEWWSFSSSFGSSLGSGSGSPPPRANLMNPKANSVKSPPPLASQPSSSAIPISSNTQLKTSSSSSCHSRFCKENPGTIAGVVTAGAFFLALFAGALFWVYSKKFKRVERSDSFASEIIKAPKEFSYKELKAGTKNFNESRIIGHGAFGVVYRGILPETGDIVAVKRCSHSSQDKKNEFLSELSIIGSLRHRNLVRLQGWCHEKGEILLVYDLMPNGSLDKALFESRFTLPWDHRKKILLGVASALAYLHRECENQVIHRDVKSSNIMLDESFNAKLGDFGLARQIEHDKSPEATVAAGTMGYLAPEYLLTGRASEKTDVFSYGAVVLEVVSGRRPIEKDLNVQRHNVGVNPNLVEWVWGLYKEGKVSAAADSRLEGKFDEGEMWRVLVVGLACSHPDPAFRPTMRSVVQMLIGKADVPVVPKSRPTMSFSTSHLLLSLQDTLSDCNTVALNSSRSSSWSVPEHNVIIRSDDDHLV

SEQ ID NO: 41770 - protein, 322 aa, Dendrobium hybrid cultivar
MEKLNNYMAVLRDACENWGFFSHFQATLSHELMDKVEHISERYIKKFREQKFKDICSHNSGNFCNTQVNDIDWESTFYLRHRPTSNISKSPEDLDDQYRKLMKEFAAQIERLSEQLLDLLCENLGLEKAYLKNAFYGANGCNPTFGTKVSNYPPCPKPELIKGLRAHTDAGGIILLFQDDTVSGLQLLKDEEWIDVPPMRHSVVVNLGDQLEVITNGKYKSVMHRVIAQTDGNRMSIASFYNPGSDAVIYPAPTLVEKEKETYPKFVFEDYMKLYVRQKFEAKEPRFEAMKTMDAVISSQPIPTAPLPLEAIRGGGYPGDLL

SEQ ID NO: 41771 - protein, 287 aa, Brassica napus
  misc_feature (172)..(172): Xaa can be any naturally occurring amino acid
  unsure (1)..(287): unsure at all Xaa locations
MLKVPEHQVAGHIAKDGKLGPLVDNQGRFYKPLQGDARGENEAKFYESFSSNKNVPDHIRGYFPVYHGVQLVEASDGSGKLPHMVLEDVVSSYVKPSVMDVKIGSRTWYPDVSEEYFNKCIKKDSATTTVSLGFRVSGLKIFDCQESGFWRPDKRVVLAYKADGARTALRKXFVSSNSLADDSVPDCAYASEVYGGSNGILMQLLELKAWFETQTLYHFNSCSVLMVYENESGGDEERRPQVKLVDFAHVLDGNGVIDQNFFGGLCSFIKFIQDILESSDNRCENGH

SEQ ID NO: 41772 - protein, 552 aa, Candida albicans SC5314
MSVITLTKESHKNPEKFRIKHQDEVEILGPHRKDRFAINEDLPTITTTSKIAILGAGFGGMASAIKTMQKYNEQDIKIFERHDNFGGTWYANTYPGCASDIPALWYSFSFALTSNWSRVQPPQYEMEEYILRVAEQFKLREKTRFQTEINKFEWDDVNGEWTLYAHDVKTGQRILHKSKLLLACQGGLVHPLQLQAEGLENFKGAYMHSALWDHSVDFKGKKVIVIGNGCSANQTVPALLNNPDYSVGSLTQISRSKHYILKPLPRILYILYRLLSFNFIALYFVRLIVVFGAEMRVPLFKGDGFISKIVRWINTTASVSYMKGNAPEKFHDMIIPNYKIGCKRLIFDYNYIPSLNDPRVDIKNQGIDRVVENGILLKNGEHIEADIIVACTGYNLSKSYFNFEIVGRNGANISEEWKKDGPSAYRTLLVKQSPNLWTIGGTNSATGHASVVMAIENGVDYFLKTAKPIIEGKAKSVRVTDEAYDNWLTTIQKELKKSVFGTPFGGCVSWYSDAKVNSTVYPWSQFHYWWITHFPNYKDLVYEPLNEDKKRR

SEQ ID NO: 41773 - protein, 471 aa, Bradyrhizobium sp. BTAi1
MGAAAYSDQGRDDPGQLCRQSQGDKGAARPRPRQEHYTDPGHPDAARQGQRRPARAAVGQAGRPRGADALSLDSSRPCEQRSGEAIQRLKLGSGLRPSLAMTSPTHSHCEENMSSTNSLHIAVLPGDGIGPEVMAPALEVLRKVEAKAGLAFRFTEAQAGAGNYLATGVSIAESTIRLCEQADAILLGACGLPSVRYPDNTEIAPQIELRFHFDLYAGVRPARLIPGVPSPIVGAAERGIDFVVIRESTEGLFASMGKGVVTHEEARETLVITRKTSERLFNFSFKLAERRRARGRSGILGCVDKANVFKAFAYFRKIFDEVAELHPNVKAERLYIDACALMLVKRPWDFDVLVTENMFGDILSDLAAGLIGGMGMAPSADIGDRHAVFQPCHGTAPDIMGQGKANPTAMILSAAMMLDWLADTRGIEGAAEAAQRIEQAVDKVYASGLKPFEFGGSAGTLEVTKAVLEAL

SEQ ID NO: 41774 - protein, 427 aa, Burkholderia pseudomallei K96243
MSAIVDIIGREILDSRGNPTVECDVLLESGTMGRAAVPSGASTGSREAIELRDGEAGRYGGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILGDRGMSTAVGDEGGFAPNFGSNDECLSTILQAIEKAGYRAGEDVLLALDCAASEFYHDGKYQLAGEGLQLSSAEFTDYLATLADKFPIVSIEDGMHEGDWDGWKLLTERLGKKVQLVGDDLFVTNTRILKEGIEKGIANSILIKINQIGTLTETFAAIEMAKRARYTAVISHRSGETEDSTIADIAVGLNAGQIKTGSLSRSDRISKYNQLLRIEEDLGDIASYPGKSAFYNLR

SEQ ID NO: 41775 - protein, 431 aa, Escherichia coli
MVSLEKNDHLMLARQLPLKSVALILAGGRGTRLKDLTNKRAKPTVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 41776 - protein, 334 aa, Geobacillus stearothermophilus
AVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASSTTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 41777 - protein, 202 aa, Zea mays
MALALATTPLAHLALAPPSIFGSQSSLLLLPRRASPAPVSLSHRRIIAAVATKEPELGGGGSGAGDGAGGSGGGSDPRGGGQEGDGEEEKMGQGLSMSQKLTLAYAALVGAGGVMGYMKSGSQKSLAAGGISALVLYVVHTQLPVRPVLASSIGLGISAALLSVMGSRFKKSGKVFPAGVVSLVSLVMVGGYFHGILRSSHA

SEQ ID NO: 41778 - protein, 122 aa, Wolbachia endosymbiont of Drosophila melanogaster
MSNEVYDSDNIFAQILRGELPCEKVHENENVLAFHDKYPDAPVHILVISKNQYISYDDFILKAPEEEIADFFKTVREIAHKYNLEKTGYRLVTNYGENGEQVVPHFHVHILGGKKLGKHVNS

SEQ ID NO: 41779 - protein, 372 aa, Cytophaga hutchinsonii ATCC 33406
MKKKALFIDRDGTIITEPADEQIDSLEKLVFLPRVLTALSKIAVETDYELVMVTNQDGLGTNSFPEETFWPAQNKMLKTLEGEGIVFKRIHVDRSFPKDNLPTRKPGIGMLTEYMNGTYDLENSFVIGDRVTDVQLAKNLGTKAIYITPSTKALDWGLGELKYALATDDWMEIYKFLVKSERIARVNRKTNETDITIYLDLDGEGKGVMNTGLGFFDHMLDQLCKHSGIDLSVEVKGDLHIDEHHTIEDTALALGEAFLLALGSKRGIDRYGFLLPMDEALAQVAIDFSGRSWLVWDAEYKREKIGDMPTEMFFHFFKSFCDTAKCNLNIKVEGDNEHHKIEATFKAFAKAIKAAIRKDPANTRIPSTKGVL

SEQ ID NO: 41780 - protein, 280 aa, Synechococcus sp. CC9605
MSSWIDEEHRGVRYGLRGEVLVEETSPFQRISVIRSERYGRGLLLDGCWMTAEQQERHYHEALVHPALCSASSIARILVIGGGDGGTARECLRHPDVQWLDMVEIDGRVVELSQEHLPDIGGSAWSDPRFQLTVGDGIAWAAQADDQSYDVVLVDGSDPAGPAEGLFNRAFFENCRRLLKPGGVFGTQSESPEAFRDVHIAMVRLLREVFDHADPLYGWVPMYPSGWWSWTFAAMGTPRYCTPDLERSQAIAAGCEIWSPRWQRGAMDAIPAFIERELQS

SEQ ID NO: 41781 - protein, 400 aa, Deinococcus radiodurans R1
MTLIESSREPGDKLAVLSCRCDKSVTVHRVHWAHQRNHNQAGRVKFAAPGGRFLGGWPFFFGLEQFSELRRRRNSTATRSILRPARWFALAPLAKKRCTLFVKCSRVQSPGPALFMVGVMNTQQGAQDLTGRRILITGATGGIGLETARELAGRGAQVVIVGRDPGRTARVAAEVGAAGTLLADLSELVQVERAAAEYRERFGELDVLVNNAGALHRERQESREGIELTWALNHLAPFLLTRELLPLLRRSSETRRVPARVVTVASAAHVVGRIRFDDPEFRRGYAAWPAYAQSKLANILFARELARREPSVLSVSLHPGMVASGFGKNGGGRFAQAYGLLDRFSLTPEQGAQTSLHAVSAPVHTGGYYANARRVTPAPQALDDGAAARLWALSEGYLQV

SEQ ID NO: 41782 - protein, 451 aa, Burkholderia pseudomallei K96243
MTDLARQLDVQQFIDERRFSPYQWLILILCFLIVAADGFDTAAIGFVAPALAQQWHVTKAALGPVMSAALVGLALGALAAGPLADRIGRKRVLVGSVVLFGLFSIGCAFTQSVTELAVLRLLTGLGLGAAMPNATTLMAEYAPHAKRSFLVNTMFCGFTLGSSAGGLVAAALIPEHGWRSVFIVGGIAPLALGALLIALPESIRFMVLRGAPHERIAAVLRRIAPDAAFDGVRFVLHDDRGEQRRSGAAVVLSPRYRAGTAMLWLTYFMGLLVYYLMTSWLPTLIRDTGFTVRDAALVTALFPLGGGIGAIACGWLMDRIEPHRVIAFTYALTALFVWMIGLQAGHLALLATVVFVAGVCMNGAQSSLPALAAAFYPTSGRATGVAWMLGVGRFGGILGAFSGGLLLQAQLGFGTIFSMLAVPALIAAGALMVKRSAASRETQPDAPTRAA

SEQ ID NO: 41783 - protein, 363 aa, Cuervea kappleriana
SQKLAVRAISQLQSLPGGDIKLLCDTAVESVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDGIGGRNATRLWGLVVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIRDIVEWLLAFHGDSTGLSTDSLADAGYPGATLLGDAVCGMAVAYITNRDFLFWFRSHTAKEIKWGGAKHHPEDKDDGQRMHPRSSFKAFLEVVKSRSLPG

SEQ ID NO: 41784 - protein, 392 aa, Prochlorococcus marinus str. AS9601
MSQVNLSDRALSIEPSLTLQISAKANQLSAEGVDICNLSAGEPDFDAPKEVIDATSKAIFDGFTKYGPAAGNLDLRKAIANKLQIQNDLNYEFENVMVTNGAKQAIYNLFQVLLNTGDEVIIPSPYWLSYPQMVRLAGGKPIFTNSSAEDGFKINIEDLKSKISSKTKFIIINSPNNPTGRVMSKEELLQIADLARENPNINILSDEIYELILKKEFKHYSLSSLANDLKDRIFIINGFAKGWAMTGWRIGYLVGPKDVIKASSALQSQSTSNVCSFVQKGALEALKINNEFFSMINSHYDQRRRLLYEGLNNINGIYIEEPNGAFYAFPKLPNSSITSVDFCNKALQDYGLVVVPGKAFGADQCIRISCAASEIKIKDGLHRLEKAISEYY

SEQ ID NO: 41785 - protein, 651 aa, Zea mays
  misc_feature (611)..(611): Xaa can be any naturally occurring amino acid
  unsure (1)..(651): unsure at all Xaa locations
MTLQMEPPVPPPRRSVSTTCDLHPGETFTGFCAACLRERLAGLESTGGSAAAAAPGRRSTSAIRSLFTRPFAAAAGGAPSGSGAAALPDLRRCKSFSCGRGGDALAAGGRAAAEDDRQRVRDGTAFGAFPASSSAAAAALAAEVLPPPQPPPPACVPEMFSEEEIAVAEDSDEIVAVMEPVSVVGTSGEMETEVSAARDVRAMKDHIDLEASQSQQPRKLPPKDLKEMAGSFWLAASMFSKKWQKWRGKQKLKKQEAAGSKAAAAAMPPPEKPSKPSFLRRSRFRRGEAGSEFAGGRRSCDTDPRFSLDAGRMSVGDMGFSWDEPRASWDGYLFGAGAGAGIALGRAPPPLSRLPPILSAMEDSPAGIVERSDGQIPVEDDSQPEPDPDANVPGGSAQTRDYYMDTSSRRRRSLDRSSSVRRSFEVTDPKPVAVPVPVPVPATAPAAMVNGKESPLMGSSEFYHFHHAEDLFDHRFSTNSLVEDFSASLDAAFPGPAKKPPRRWRKAWSLWGLIHRRAAGRGNGADRAFSEPWPELRVRGHSGRMQRCNSNACARSSFSSNSGGGLGSSRRSYVVDAHGHAKRRREEGAALERNRSARHSPGPGTADSGMXLRLYLTPVRSASGRRTAVFPVKGRRPLRSPSLARTMLGLY

SEQ ID NO: 41786 - protein, 135 aa, Brassica napus
MFKKMMKSGSRKPSRNDAGFDPNSTNMVVNHASRPSPLPPPSPTTTKQPPLMHSIEPLPLLRDLPPPERQPLFLRKLQICSFHFDFTDPTKNAREKEIKRQTLLELVDYIQSGTAKIISELCQEEMVKMISSNIF

SEQ ID NO: 41787 - protein, 489 aa, Mycobacterium smegmatis str. MC2 155
MPLLADRQSQLLIDGKLVAGRKGVFDTVNPATEEVLGVAADATAEDMGDAIEAARRAFDDTDWSTDTELRVRCIRQLRDALREHVEELRDLTIAEVGAPRMLTSGAQLEGPIDDLAFSADTAENYPWRTDLGHATPQGIPTDRVIAREAVGVVGAITPWNFPHQINLAKVGPALAAGNTLVLKPAPDTPWAAAVLGQIITEHTDFPPGVINIVTSSDHSVGALLSKDPRVDMVSFTGSTATGRAVMTDAALTIKKVFLELGGKSAFLVLDDADLTGACSMAAFTVAMHAGQGCAITTRLVVPRARYDEAVEIAAGTLGSIKPGDPTSKRTVCGPVISARQRDRVQSYLDLAIKEGGRFACGGGRPADMDKGFWIEPTVIAGLDNNARVAREEIFGPVLTVIAHDGDDDAVRIANDSPYGLSGTVFSGDDARAQAVASRMRVGTVNVNGGIWYSADAPFGGYKQSGVGREMGLAGFEEYTEIKLIATLAG

SEQ ID NO: 41788 - protein, 1153 aa, Oryza sativa (japonica cultivar-group)
MLRSHSKARALPLDGTVEHLGCGQGVVIGAARQGEDQVGFLQELRSMPTTESMTVRTVRRKLRSAMAWGISEKASGLRSLSWTGWLRSPTTASSSACRPRREDVLVHEIAGELRRLGDHAPHLLHVVVVAGPPPAHHHARDDVAGDTHQRGVDVDVLGVGGTPAERADEARHLLAADMAEPEEERMEPPPPPPYIHIETNDFLHRRHKRQKEEDIAVCECQYNLLDPDSACGDRCLNVLTSTECTPGYCLCGVYCKNQRFQKSQYAATRLVKTEGRGWGLLADENIMVTEFTLILWSANVVKYIQAGQFVMEYCGEVISWKEAKRRSQAYENQGLTDAYIIYLNADESIDATKKGSLARFINHSCQPNCETRKWNVLGEVRVGIFAKQDIPIGTELSYDYNFEWFGGAMVRCLCGAGSCSGFLGAKSRGFQEATYLWEDDDDRFSVENVPLYDSADDEPTSIPKDILIKDEPNTQDGNNNTIQNTGIPIIASSSEFTPMNVEPSIASSNEFTPMNVEPLNVSSNELTPMTIEPLNAIPMGVDFTQNGSIEYGAQCAEDALQNSTRGVANLQNQSAPRDNNHTELVAVKRRPTLRGGKAKRGMRKQLNVVGICDRLASEVAREEILYCEEMKNEAAAEIDSLYDEIRPAIEEHERDSQDSVATSLAEKWIEASCCKYKADFDLFPLFRISRVMGKSEHGNLLVSLSDGLPHYSLAAAVGLAIGVAGLCKALHSSLVIPPVSQKKLLSNSDRLYYTGGLKNLGNNCFLNVILQALASCDGFVSSLDNLLGSEDVLPEEKSEKMPLIFALSSLIKVENKVLVPVTLVVSGITEQWWSGGIVTYCNTVNTLSLDFENFYCLPLSPVATINGDIINGCSLVDCLEHFTALEHLDNYRCDHCWHNVAAKYLSLKSEVDEEKINKLHTCVDYGTCSCRHIFTPEEMTCSISSQATKQLAITHFPKILCIHLLRASVGLDGEFVKRGGHISFPLLLDLSPFAGGALIPGQGPKPSAMNKQRHGQQTLHLWRQLNAEMPVNMFPAATDGDSSSHHCGDESINTLGRSFYVGNRDADSRFLSSSSLTDKLYGLSSVVEHYGVCGGGHYAAYRRVTPNSDSNEPVQSLASFRKEWLYVSDDHVSHVSECEVLAAEATLLFYERL

SEQ ID NO: 41789 - protein, 384 aa, Triticum aestivum
MLLFHKQLFSLRLPASPVIFSLRRALLSTSAATDAPPAPFAVDDYLVTTCGLTPEQALKAAKHVSHCKSTSNAESVLAYLAGPTLRFSKADIAHIVARDPRILNCSVDDTLKARVAILRGYGLSEDHVRTFLRMTPGVFRSVSIQEKLGFWLPFLGSPEKFIRILKGNYYLLTSDLERVVKPNIAVLRESGVSAADIAKMCVPNSRLLTSSPKTLMSILERADKLGVPRGSLMFRQAVTTTTSLGVETMAAKLKLFEEILGWSEAEVAKVVRMNPTVLRISGEKLRRVKEFLTKVVGVDTRYILTRPSILMYSLECRLVPRHYVMKVLQEKGLIQKDQSFYPMVTASENTFQLKYIDAHRHVLPGLADAYAAACQGKLPTEVAV

SEQ ID NO: 41790 - protein, 352 aa, uncultured bacterium
ITSANNLLAALLDNHIQQGNALGIDPRQILWKRCLDMNDRVLRNVVVGLGAKADGMVREDHFVITVASEIMAILCLANDMEDLKDRLGKIIVAYNFAGEPVTAADLHAVGSMAALLKDALKPNMIQTLEHTGALVHGGPFANIAHGCNSVRATKTALKLCDIVVTEAGFGADLGAEKFMDIKCRKAGIHPDAVVLVATVRALKYNGGVPKDQLSEENLDALKRGIVNLEKHIENIQKFGVPVVVTLNSFITDTEAEYAYIKRFCEDRGCEFALAEVWAKGGEGGMALAEKVLNTLENKRGDFKPLYTDEMPLKDKIGTIASEIYGADGVSYAPAASKALKRIEEMGFGNLPV

SEQ ID NO: 41791 - protein, 365 aa, Triticum aestivum
  misc_feature (236)..(236): Xaa can be any naturally occurring amino acid
  misc_feature (249)..(249): Xaa can be any naturally occurring amino acid
  unsure (1)..(365): unsure at all Xaa locations
TAPEIETPRYCCVAIEYSSYASNALGALPYGRPAGGRTSDFERPPGQVQGRLGFGWDAEPGAGVDELGNPTGGLFGTAVATMGGLGTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSGWACSAVGRTAQEVVTEVRRQFIERPGIMDYKEKPDYGRCVAIVXASASLREMIKPGXALAILSPMAVGIIFRILGHATGQPLLGAKVVASMLMFATVTGILMALFLNTSGGAWDNAKKYIETGALGGKGSEAHKAAITGDTVGDPFKDTAGPSIHVLIKMLATITLVMAPIFL

SEQ ID NO: 41792 - protein, 351 aa, uncultured bacterium
ITSANNLLAAMLDNHIHQGNALGIDTKRIVWKRCMDMNDRTLRNIVIGLGDKPNGVTREDHFIITVASEIMAILCLAEDMKDLKERIDKIIVAYNYAGDPVTAKDLKATGAMAALLKDAIKPNMIQTLENTPVLVHGGPFANIAHGCNSVRATKLALKLADIAVTEAGFGADLGAEEFFDIKCRKAGLKPDAVVIVATVKALKYNGGVPKQELSKPDMEALKNGIVNLDKHIENIHKYGVPVVVTLNSFVTDTDEEYEFIKKHCEELGCEFALSNVWADGGAGGIELADKVLASFDKKSDFKPLYEDELPLEDKIMTIAKEIYGADGVTYDSKAKKELDHITQMGFGNLPV

SEQ ID NO: 41793 - protein, 436 aa, Deinococcus radiodurans R1
MDSRSPSLPDDRPDPPEQHLDARAGATLRGTAGPRGVRRILPFLGPAVIASIAYMDPGNFATNIEGGARYGYSLLWVILAANLMAMVIQNLSANLGIASGRNLPELIRERWPRPLVWFYWIQAELVAMATDLAEFLGAALAIQLLTGLPMFWGAVVTGVVTFWLLNLQKRGTRPLELAVGAFVLMIGVAYLVQVVLARPDLAAVGAGFVPRLQGPGSAYLAVGIIGATVMPHVIYLHSALTQGRIQTDTTEEKRRLVRLNRVDVIAAMGLAGLINMSMLAVAAATFHGKNVENAGDLTTAYQTLTPLLGPAASVLFAVALLASGLSSSAVGTMAGDVIMQGFMGFHIPLWLRRLITMLPAFIVILLGMDPSSVLILSQVILCFGVPFALVPLLLFTARRDVMGALVTRRSFTVIGWVIAVIIIALNGYLLWELLGG

SEQ ID NO: 41794 - protein, 351 aa, uncultured bacterium
ITSANNLLAAMLDNHIHQGNALGIDTKRIVWKRCMDMNDRTLRNIVIGLGDKPNGVTREDHFIITVASEIMAILCLAEDMKDLKERIDKIIVAYNYAGDPVTAKDLKATGAMAALLKDAIKPNMIQTLENTPVLVHGGPFTNIAHGCNSVRATKLALKLADIAVTEAGFGADLGAEKFFDIKCRKAGLKPDAVVIVATVKALKYNGGVPKQELSKPDMEALKNGIVNLDKHIENIHKYGVPVVVTLNSFVTDTEEEYEFIKKHCEELGCEFALSNVWADGGAGGIELADKVLASFDKKSDFKPLYEDELPLEDKIMTIAKEIYGADGVTYDSKAKKELDHITQMGFGNLPV

SEQ ID NO: 41795 - protein, 141 aa, Brassica napus
  misc_feature (26)..(26): Xaa can be any naturally occurring amino acid
  misc_feature (66)..(66): Xaa can be any naturally occurring amino acid
  misc_feature (68)..(68): Xaa can be any naturally occurring amino acid
  unsure (1)..(141): unsure at all Xaa locations
MLTDRGRRVSICIGTLEYGNRKFRGXVGGGCYGGFVDRSSERCRDWSPSKSSASRILRISSPTTSXAXSSATSPVSLNCSFSNGAGYIEHRVSKFDTLAGIAIKYGVEVADITKLNGLVTDLQMFALKSLRIPLPGRHPPS

SEQ ID NO: 41796 - protein, 352 aa, uncultured bacterium
ITSANNLCAALLDNHIQQGNELGIDPRCVTWKRCMDMNDRVLRNIVVGLGSKVDGTVREDHFVITVASEIMAVLCLATDMKDLKERLGRMVVAYNYQGQPVTASDIKAVGSMAALLKDALKPNLIQTLEHTPALVHGGPFANIAHGRNSVRATKTALKMADYVITEAGFGADLGAEKFFDIKCRKSDLKPDAVVLVATVRALKYNGGVPKTELSAENLDALKKGIVNLEKHIENLHKYGVPVVVALNAFVSDTQAELDYIQKFCEDKGCEFALAKVWEKGGEGGIELAEKVLKTLETKKSNFHCLYETDQPVKAKIETIAKEIYGAGSVNYSAAANKQIAQLEQLGFGNLPI

SEQ ID NO: 41797 - protein, 361 aa, Elaeodendron orientale
QKLAVRAISQLQSLPGGDIKLLCDTVVECVRDLTGYDRVMVYKFHEDEHGEVVAESKRPDLEPYIGLHYPSTDIPQASRFLFKQNRVRIIVDCHASPVCVIQDDGLMQPLCLVGSTLRAPHGCHAQYMENMGSIASLAMAVVINGNDEEVIRGKNLTRLWGLVVCHHTSARCIPFPLRYACEFLMQAVGLQLNMELQLAAQLLEKHVLKTQTLLCDMLLRDSPIGIVTQSPSIMDLVKCDGAALYYQGNYYPLGVTPSEVQIKDIVEWLLAFHGDSTGLSTDSLADAGYPRAALLGDAVCGMAVAYITNRDFLFWFRSHTAKEIKWGGAKHHPEEKDDGQRMHPRSSFKAFLEVVKSRSLP

SEQ ID NO: 41798 - protein, 352 aa, uncultured bacterium
ITSANNLCAALLDNHIQQGNELGIDPRCVTWKRCMDMNDRVLRNIVVGLGSKVDGTVREDHFVITVASEIMAVLCLATDMKDLKERLGKMVVAYNYQGQPVTAADIKAVGSMAALLKDALKPNLIQTLEHTPALVHGGPFANIAHGCNSVRATKTALKMADYVITEAGFGADLGAEKFFDIKCRKSGLKPDAVVLVATVRALKYNGGVPKTELSAENLDALKKGIVNLEKHIENLHKYGVPVVVTLNAFVSDTQAELDYIQKFCEDKGCEFALAKVWEKGGEGGIELAEKVLKTLETKKSNFHCLYETDQPVKAKIETIAKEIYGAGSVNYSAAANKQIAQLEQLGFGNLPI

SEQ ID NO: 41799 - protein, 348 aa, Mesorhizobium loti MAFF303099
MRALVLEKKGELSLREIALPLDVGPDDVKIAIHTVGVCGSDVHYYTHGAIGSYVVRAPMVLGHEAAGTVVETGANVETFKAGDRVCMEPGVPNLSSRATKLGIYNVDPDVSFWATPPVHGVLAPYAVHPAAFTYKLPDNVSFAEGAMVEPFAIGMQAASRARIVPGDVAVVVGCGPIGIMIALAALAGGCSKVLISDFSAPKLKIAAQYAGIVPVNIGERSLVDAVAAATDKWGADIVFEASGSPKAFADLFDVVRPGGAVVLVGLPVEPVALNVPAAISKEVRIETVFRYANIFDRALQLIASGKVDLKPLITGTYDFADSIKAFERAAQGNPEDVKLQILLTGEKG

SEQ ID NO: 41800 - protein, 374 aa, Elaeodendron xylocarpum
ALSIAGAVQSQKLAVCAISQLQSLPGGDIKLLCDTVVESVGDLTGYDRVMVYKFHEDEHGEVVAESKRPDLEPYIGLHYPSTDIPQASRFLFKQNRVRIIVDCHASPVRVIQDGGLTQPLCLVGSTLRAPHGCHAQYMENMGSIASLAMAVVINGNDEEVIGGRNPTRLWGLVVCHHTSARCIPFPLRYACEFLMQAFGLQLNMELQLAAQLLEKHVLKTQTLLCDMLLRDSPIGIVTQSPSIMDLVKCDGAALYYQGNYYPLGVTPSEAQIKDIVEWLLAFHGDSTGLSTDSLADAGYPGAALLGDAVCGMAVAYITNRDFLFWFRSHTAKEIKWGGAKHHPEDEDDGERMHPRSSFKAFLEVVKSRSLPWEN

SEQ ID NO: 41801 - protein, 374 aa, Elaeodendron xylocarpum
ALSIAGAVQSQKLAVRAISQLQSLPGGDIKLLCDTVVESVRDLTSYDRVMVYKFHEDEHGEVVAESKRPDLEPYIGLHYPSTDIPQASRFLFKQNRVRIIVDCHASPVRVIQDGGLTQPLCLVGSTLRAPHGCHAQYMENMGSIASLAMAVVINGNDEEVIGGRNPTRLWGLVVCHHTSARCIPFPLRYACEFLMQAFGLQLNMELQLAAQLLEKHVLKTQTLLCDMLLRDSPIGIVTQSPSIMDLVKCDGAALYYQGNYYPLGVTPSEAQIKDIVEWLLAFHGDSTGLSTDSLADAGYPGAALLGDAVCGMAVAYITNRDFLFWFRSHTAKEIKWGGAKHHPEDKDDGERMHPRSSFKAFLEVVKSRSLPWEN

SEQ ID NO: 41802 - protein, 374 aa, Euonymus alatus
ALSIAGAVQSQKLAVRAISQLQSLPGGDIKLLCDTVVETVRDLTGYDRVMVYKFHDDEHGEVVAENKKPDLEPYIGLHYPATDIPQASRFLFKQNRVRMIVDCHASTVRVIQDDRLVQPLCLVGSTLRAPHGCHAQYMENMGSQASLALAVISNGNDEEVIGGRNATRLWGLVVCHHTSARCIPFLFRYACEFLMQAFGLQLNMELQLAAQVSEKHVLKTQTLLCDMFLRDSPTGIVTKSPSIMDLVKCDGAAFYYQGKYYPLGVTPAEAQIKDIVEWLLAFHGDSTGLSTDSLADAGYPAAASLGDSVCGMAVAYITNRDFLFWFRSHTTEEIKWGGAKHHHEDKDDGQRMHPRSSFKAFLEVVKSRSFPWEN

SEQ ID NO: 41803 - protein, 399 aa, Bacillus cereus ATCC 10987
MLENQINERSLLLHKELVGKIEITSKVEVNSADDLSLTYTPGVAESCKAIAADEETVYDYTARGNMVAVISDGTAVLGLGNIGPKAAMPVMEGKSILFKKFANVDAFPLCLGTTDVDEIVTLVKNLEPTFAGINLEDIAAPRCFEIEKRLKEETNIPVFHDDQHGTAIVVLAAVINALKVVRKQMDHVKIVINGAGSAGIAIGKLLLKAGAQHITLVSLEGIVCEGETWMNEAQIEVSKKTNREHVRGTLKEAIHQADIFIGVSAPNVLTKEFVQTMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVARITRIPSY

SEQ ID NO: 41804 - protein, 194 aa, Thermus thermophilus HB27
MREATVERATAETWVRLRLGLDGPTGGKVDTGLPFLDHMLLQLQRHGRFLLEVEARGDLEVDVHHLVEDVGIALGMALKEALGDGVGLERYAEAFAPMDETLVLCVLDLSGRPHLEFRPEAWPVVGEAGGVNHYHLREFLRGLVNHGRLTLHLRLLSGREAHHVVEASFKALARALHKATRRTGEGVPSTKGVL

SEQ ID NO: 41805 - protein, 526 aa, Burkholderia sp. 383
MHSDARPDSPRPSGSPPAKPTLHRALQARHLRMIAIGGSIGTGLFVASGASISQAGPGGAMLAYMVIGLMVYFLMTSLGEMAAFMPVSGSFATYGAKFVDEGFGFALGWNYWYSWAVTLAVELVAGQLVMNYWFPHVPGVWWSALFLTLIFALNALSVRGFGEAEYWFALIKVLTVLAFVGVGLLMIFGIMQGGPSAGWGNFTIGDAPFAGGWATMLGVAMIAGFSFQGTEMIGVAAGESENPRTTIPRAVSQIFWRILLFYVFAIFVIGVLIPYTDPSLLKSDVTDIGVSPFTLVFRHAGLAFAAGVMNAVILTAVLSAGNSGMYASTRMLYNLAVEGRAPKIFAKLSRGGVPRNALYATTAVGALCFLTSLYGDKTVYLWLLNTSGMAGFITWLGIAVSHYRFRKGFLKQGYRLDQLPYRSKWFPFGPLFAFALCAVVALGQDYQAFFSDKIDWVAVAATYIGLPFFLAIWLGYALVRKCRLVRYEDMEIAPWIERNATPEPAPQAETGYAGYVARPANPTPGA

SEQ ID NO: 41806 - protein, 647 aa, Zea mays
  misc_feature (456)..(456): Xaa can be any naturally occurring amino acid
  unsure (1)..(647): unsure at all Xaa locations
MSRDLDCPVQTQMAVAVLDRSFSSEYPGGSRTEGRQLSWKRVFVQTDNGSVLGIELERGENVQTVKKKLQIALNVPTDESSLTFGDLVLNDDLSSIRNDSPLLLKRNQIHRSNSTPCLSPTGQDVWQRDRSGPIEILGCSSPSSRMKQIAKDVIKAIMNGVDPVAINSGMGGAYYFKNIWGERVAIVKPTDEEPFAPNNPKGFVGKALGQPGLKRSVRVGETGFREVAAYLLDYDHFANVPPTMLVKITHTIFNVNDCVGCKSKVFCNKSESVSKIASLQEFIPHDFDASDHGTSSFPVSAVHRIGILDIRIFNTDRHAGNLLIKKVGPGADNFGEQTELIPIDHGLCLPECLEDPYFEWIHWPQSSVPFSVEELEYIAKLDPIKDAEMLRVELPMIREACLRVLVLSTVFLKEAAAFGLCLSEIGDMMSRQFTAKEEEPSQLELLCMETRKWVEXRELFLPDEAGVEDGDDDFTQFPLDSDAFEPPAFCKFGSVKTSSRNPLSKLDECDEEDGDLSEEEGEHGDVLTSGALPQKVPPISKLSSSMKGLGFIGKSKPYRTGGVPKGKVTGRTNYSGKASEHQSGSRSANELLPPSASFVKLSDMSRKEWSAFLEKFQELLPSALRTRKHSAGVGQRPMPRLGTSCQF

SEQ ID NO: 41807 - protein, 503 aa, Burkholderia sp. 383
MQFNDILAALDIDLAQWKGNALTARSPLDGATLAKLAVDTPADAERKIDAAHDAFLKWRTVPAPVRGELVRVFGNVLREHKAELGALVTLEAGKITSEGLGEVQEMIDICDFAVGLSRQLYGLTIASERPGHRMMETWHPIGVCGVISAFNFPVAVWAWNAALAFVCGDSVVWKPSEKTPLTAIACHVLLQKAIREFDKTHPGVAPAELSQLVLGMRDVGEVLTASKKVPVVSATGSVRMGQEVAKVLSQRLARGILELGGNNGMIVAPSADLDLVVRAVTFAAVGTAGQRCTTLRRLIVHRSLVEQLLPRIEKAYTSVKVGNPLEEGTLVGPLVDRASFDAMQKALGDAREQGGEVKGGERVDVGHADAYYVRPALVRMPKQSAVVERETFAPILYVMVYDNFDDAIELHNAVPQGLSSAIFTNDMREAEQFMSAAGSDCGIVNVNIGTSGAEIGGAFGGEKETGGGRESGSDAWKAYMRRATNTINYSRQLPLAQGVKFDV

SEQ ID NO: 41808 - protein, 120 aa, Thalassiosira pseudonana
MLNLDNQKAIDNLHQSFIKSDLPKIQIGDTLKLGIKIIEGNKERVQFYEGTVIAKKNSSINTTITVRKVLQGIGIERIFLIHSPKVASIEVIRHAKVRRSKLYYLRNLRGKASRLKQRFE

SEQ ID NO: 41809 - protein, 84 aa, Zea mays
ELRVRPVSPSGSSHRTLMPALSMRLHYAPLIELPGGTLLKGATLVAIRPSEDALREGQGVGAAGPAGTCWISEAFEEPYRTAAK

SEQ ID NO: 41810 - protein, 352 aa, uncultured bacterium
ITSANNLCAALLDNHIQQGNELGIDPRCVTWKRCMDMNDRVLRNIVVGLGSKVDGTVREDHFVITVASEIMAVLCLATDMKDLKERLGKMVVAYNYQGQPVTAADIKAVGSMAALLKDALKPNLIQTLEHTPALVHGGPFANIAHGCNSVRATKTALKMADYVITEAGFGADLGAEKFFDIKCRKSGLKPDAVVLVATVRALKYNGGVPKTELSAENLDALKKGIVNLEKHIENLHKYGVPVVVTLNAFVSDTQAELDYIQKFCEDKGCEFALAKVWEKGGEGGIELAEKVLKTLETKKSNFHCLYETDQPVKAKIETIAKEMYGAGSVNYSAAANKQIAQLEQLGFGNLPI

SEQ ID NO: 41811 - protein, 156 aa, Oryza sativa (japonica cultivar-group)
MMMTEVANHSKRNHNESYFTGKAAVTSSSEEFGSMTSKKPRNTSPRDAPVSPKEKKDKIGERVAALQQLVSPFGKTDTASVLQEASGYIKFLHQQLEVLSSPYMRAPPVPGAAPEDPDHYSLRNRGLCLVPVDQTLQLTQSNGADLWAPANTTRRR

SEQ ID NO: 41812 - protein, 352 aa, uncultured bacterium
ITSANNLCAALLDNHIQQGNELGIDPRCVTWKRCMDMNDRVLRNIVVGLGSKVDGTVREDHFVITVASEIMAVLCLATDMKDLKERLGRMVVAYNYQGRPVTASDIKAVGSMAALLKDALKPNLIQTLEHTPALVHGGPFANIAHGCNSVRATKTALKMADYVITEAGFGADLGAEKFFDIKCRKSDLKPDAVVLVATVRALKYNGGVPKTELSAENLDALKKGIVNLEKHIENLHKYGVPVVVTLNAFVSDTQAELDYIQKFCEDKGCEFALAKVWEKGGEGGIELAEKVLKTLETKKSNFHCLYETDQPVKAKIETIAKEIYGAGSVNYSAAANKQIAQLEQLGFGNLPI

SEQ ID NO: 41813 - protein, 424 aa, Deinococcus radiodurans R1
MQAVTEVMTSIWPFVQAHPEYAEHALLERLIEPERVISFRVTWVDDAGQVQVNRGYRVQHSSSIGPYKGGMRFHPSVNLSILKFLAFEQTFKNALTTLPLGGGKGGSDFDPKGKSDGEVMRFCQALMTELWRHLGPDTDVPAGDIGVGGREVGYLAGMMKKLANHAGGVFTGKGLSYGGSLLRPEATGYGTVYFVEHMLRDQRMEMEGLRVSVSGSGNVAQYAIEKALHLGAHVLTASNSGGTVVDEDGFTYDKLAVLMDIKNERRGRVEDYAREVGAEFRPGVRPWDVPVDVALPCATQNELGADDARTLIAGGVRVVAEGANMPCDLAAIQAFEEAGVLYAPGKATNAGGVATSGLEMSQNAQRLSWTREEVDQRLRSIMSAIHDSCLEYGRRPDRHVSYLDGANIAGFVKVATAMREQGVL

SEQ ID NO: 41814 - protein, 352 aa, uncultured bacterium
NTSANNLCAALLDNHIQQGNELGIDPRCVTWKRCMDMNDRVLRNIVVGLGSKVDGTVREDHFVITVASEIMAVLCLATDMKDLKERLGKMVVAYNYQGQPVTAADIKAVGSMAALLKDALKPNLIQTLEHTPALVHGGPFANIAHGCNSVRATKTALKMADYVITEAGFGADLGAEKFFDIKCRKSGLKPDAVVLVATVRALKYNGGVPKTELSAENLDALKKGIVNLEKHIENLQKYGVPVVVTLNAFVSDTQAELDYIQKFCEDKGCEFALAKVWEKGGEGGIELAEKVLKTLETKKSNFHCLYETDQPVKAKIETIAKEIYGAGSVNYSAAANKQIAQLEQLGFGNLPI

SEQ ID NO: 41815 - protein, 235 aa, Zea mays
  misc_feature (165)..(165): Xaa can be any naturally occurring amino acid
  misc_feature (208)..(208): Xaa can be any naturally occurring amino acid
  unsure (1)..(235): unsure at all Xaa locations
MAAAESARVQEAQKLAKSDPRKAEAIYKDIISKAPSTTSDAATREYETALVSLGEIYRDEKKTQELVNLVKESRTVFSSFAKAKSAKLVRQLLDLIKEIPDSTDIEISVTKDCIEWATAERRAFQRQDLEVRLVALQMAKQSYYEALGLINNLLRELKRLDDKLXLVEVQLLESRVYHAPGNIPKARAALTSARTSAASVYTPPMLQXNLDMQSGMLHAEDKDFNTAFSYFIEAL

SEQ ID NO: 41816 - protein, 411 aa, Rickettsia sp. DaE100R
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCNSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAVVLKETCKEVLKELGQLDNNPLLQIAIELEAIALKDEYFIERKLYPNVDFYSGIIYKAMGIPSQMFTVLFAIARTVGWMAQWKEMHEDPEQKISRPR

SEQ ID NO: 41817 - protein, 352 aa, uncultured bacterium
ITSANNLCAALLDNHIQQGNELGIDPRCVTWKRCMDMNDRVLRNIVVGLGSKVDGTVREDHFVITVASEIMAVLCLATDMKDLKERLGKMVVAYNYQGQPVTAADIKAVGTMAALLKDALKPNLIQTLEHTPALVHGGPFANIAHGCNSVRATKTALKMADYVITEAGFGADLGAEKFFDIKCRKSGLKPDAVVLVATVRALKYNGGVPKTELSAENLDALKKGIVNLEKHIENLHKYGVPVVVTLNAFVSDTQAELDYIQKFCEDKGCEFALAKVWEKGGEGGIELAEKVLKTLETKKSNFHCLYETDQPVKAKIETIAKEIYGAGSVNYSAAANKQIAQLEQLGFGNLPI

SEQ ID NO: 41818 - protein, 374 aa, Euonymus europaeus
ALSIAGAVQSQKLAVRAISQLQSLPGGDIKLLCDTVVESVRDLTGYDRVMVYKFHDDEHGEVVAESKRPDLEPYFGLHYPATDIPQASRFLFKQNRVRMIVDCHASPVCVIQDYRLIQPLCLVGSTLRAPQGGHAQYMENMGSKASLAMPVIINGNDEEVIGGRNATRLWGLVVCHHTSARCTPFPLRYACEFLLQAFGLQLNMELQLAAQLSEKHVLKTQTLLCDMLLRDSPTGIVTKSPSIMDLVKCDGAALYYQGKYYPLGVTPAQAQMKDIVEWLLAFHGDSTGLSTDSLADAGYPGAALLGDAVCGMAVAYITKRDFLFWFRSHTAKEIKWGGAKHHPEDKDDGQRMHPRSSFKAFLEVVKSKSLPWEN

SEQ ID NO: 41819 - protein, 352 aa, uncultured bacterium
IGAANNLLAAMLDNHIQQGNALGIDVKRICWKRCVDMNDRQLRNIVDGLGGRMQGVPREDGFDITVASEIMAVLCLASDIPDLKARLGRMVVGYTFDGKPVTAHDLKAEGAMAALLKDAPKPNLVQTLEGTPAFIHGGPFANIAHGCNSVMATRMAMRLADYAVTEAGFGADLGAEKFLDIKCRLAGLTPSAVVVVATVRALKNHGGVPKAELNTENLEALERGLPNLLQHVENITQVFGLPCVVAINAFPTDTPAELQLVEERCRALGVRVALSEVWAKGGAGGEALAQEVIRLCEQPNHFQFAYDTAESIEERLNDIARKIYHADGAVMTPAARKQARELEDLGFGGLPV

SEQ ID NO: 41820 - protein, 374 aa, Euonymus europaeus
ALSIAGAVQSQKLAVRAISRLQSLPGGDIKLLCDTVVESVRDLTGYDRVMVYKFHDDEHGEVVAESKRHDLEPYFGLHYPATDIPQASGFLFKQNRVRMIVDCHASPVRVIQDDRLIQPLCLVGSTLRAPHGCHAQYMENMGSKASLAMAVIINGNDEEVIGGRNATRLWGLVVCHHTSARCTPFPLRYACEFLLQAFGLQLNMELQLAAQLSEKHVLKTQTLLCDMLLRDSPTGIVTKSPSIMDLVKCDGAALYYQGKYYPLGVTPAEAQIKDIVEWLLAFHGDSTGLSTDSLADAGYPGAASLGDSVCGMAVAYITNRDFLFWFRSHTTEEIKWGGAKHHPEDKDDGQRMHPRSSFQAFLEVVKSRSFPWEN

SEQ ID NO: 41821 - protein, 339 aa, Haemophilus somnus 2336
MNKNIDWENLGFSYIKTDYRYIAYWKNGAWSKGELIQDNVLHISEGSTALHYGQQCFEGLKAYRCKDGSINLFRPEQNALRMQKSCQRLLMPEIPVEMFVDACKQVVKANADWLGPYGSGATLYLRPFLIGVGDNIGVSPAPEYIFSIFCCPVGAYFKGGMKPTNFIVSDYDRAAPQGTGAAKVGGNYAASLYPGKMAKTRHFADCIYLDPTTHKKIEEVGSANFFGITKDNKFITPLSPSILPSITKYSLLYLAKERLGMEVIEGDVYIDQLDQFKEAGACGTAAVITPIGGIQYGDHFHVFYSETDVGEITTKLYNELVGIQFGDVDAPKGWIVKVE

SEQ ID NO: 41822 - protein, 306 aa, Thermus thermophilus HB27
MRFFVLGDVSVDLLFFLERIPEPGEEVPSRRALMKPGGAGGTLAAQLASLGHRVFLAGRVGKDPFAELALSRVREVGVDLRHLQEDPEHTTSSVLILVVPGGERAMVSAEGASRYLDPALFKPRFLDQVDAVVLSAYALVGGPSRSYAAEVLEAARRRELPVFADLGAGAVRAAGKELLKHLRGVGWLLMNEGELKALTGASSISQGVARLRQEGFQHLAVKVGAMGSIVVTPEGEELIEPFPVEDIVDSTGAGDAYTAAFAHAILEGLSPVEAGRLANLAGALAATAIGAQGRLVTLEDLKVAAG

SEQ ID NO: 41823 - protein, 374 aa, Gyminda tonduzii
ALSIAGAVQSQKLAIRAISQLQSLPGGDIKLLCDTVVESVRELTGYDRVMVYKFHEDEHGEVAAESKRTDLEPYFGLHYPATDIPQASRFLFRQNRVRMIVDCHASPVRVIQDDGLMQPLCLVGSTLRAPHGCHAQYMENMGSKASLAMAVIINGNDEEVIGGRNATRLWGLVVCHHTSARCIPFPLRYACEFPMQAFGLQLNMELQLAAQLSEKHVLKTQALLCDMLLRDSPTGIVTQSPSIMDLVKCDGAALYYQGKYFPIGVTPTEAQIKDIVEWLLVFHGDSTGLSTDSLADAGYPGAALLGDAVCGMAVAYITKKDFLFWFRSHTTKEIKWGGAKHHPEDKDDGQRMHPRSSFKAFLEVVKSRSLPWES

SEQ ID NO: 41824 - protein, 319 aa, Arabidopsis thaliana
MDHHHHIASRNSSTTSELPSFEPACHNGNGNGWIYDPNQVRYDQSSDQRLSKLTDLVGKHWSIAPPNNPDMNHNLHHHFDHDHSQNDDISMYRQALEVKNEEDLCYNNGSSGGGSLFHDPIESSRSFLDIRLSRPLTDINPSFKPCFKALNVSEFNKKEHQTASLAAVRLGTTNAGKKKRCEEISDEVSKKAKCSEGSTLSPEKELPKAKLRDKITTLQQIVSPFGKTDTASVLQEAITYINFYQEQVKLLSTPYMKNSSMKDPWGGWDREDHNKRGPKHLDLRSRGLCLVPISYTPIAYRDNSATDYWNPTYRGSLYR

SEQ ID NO: 41825 - protein, 416 aa, Wolbachia endosymbiont of Drosophila melanogaster
MDKKVLLELSNGLKIELPVLSGTTGPDVLNIKDLYKMTGLFTYDPGFVSTASCSSTITFIDGDEGVLKYRGHNIADLAENNNFTAVIYLLLYGELPSSEQHKKFLLKIQESSKVSEQVTNVIKAFPKTAHPMSILVACFASLSASYHEKHGNNVNGEDLDFGISAIAQVSTIIAMIYRHINNQEFINANNELSYSENFLKMIFGDAVDNDKSALFAKALDKIFTLHADHEQNASTAAVRLVGSAGSNLFASLSAGVATLWGPAHGGANEAVINMLKEIEQSGDIDKFIEKAKDDKDPFKLMGFGHRVYKNYDPRARILEGACHEVLSKLEQNNELLKIAKKLEEIALKDEYFIVRKLYPNVDFYSGIIMNAIDIPSNMFTPIFALARTTGWVTQWYEMINDKETKICRPRQLYFGK

SEQ ID NO: 41826 - protein, 978 aa, Bacillus cereus ATCC 10987
MAEQTVRVTVDGKECSTSGEKTILQLFNESNLEHPQICHVPEVDPIQTCDTCIVEVDGKLMRACSTKLENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDNGVSINDSSCVSCGQCVTVCPCNALMEKSMLGEAGFMTGLKPDVLNPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEASWEEALEVVASNMQHIKSEYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHEQKLIVADLRKHEMAERADLFIHPRQGTDYVWLAGITKYIIDQDWHDKKFIAENVKNFDEYSTMLEKYTLDYTEEITGISKENLKEMARMVCEADGTCILWGMGVTQNTGGSTTSAAISNLLLVTGNYRRPGAGAYPLRGHNNVQGACDMATLPNWLPGYQAVSDDTLRAKFEKAYGTTIPKAPGLNNIAMLLAAEEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYESPSEIMDEIASLAPLYSQATYDRLEGWNSLCWGSHDGSDTPLLYVDGFNFPDKLARLSLDEWIPPVVAPDEYDLLLNNGRMLEHFHEGNMTNKSAGILSKVSEVFVEISPELAIERNVKDGGLVELASPFGKIKVQALITDRVTGKELYLPMHATINEEAINILTGTATDLYTCTPAYKQTMVKMRVLREKGNRPLPSSNPRDKKRNPQNGVEIEQKWQRKQYVSLVD

SEQ ID NO: 41827 - protein, 820 aa, Clostridium thermocellum ATCC 27405
MKAVIMAGGEGTRLRPLTCNRPKPMVPVVNKPVMEHIIELLKKHGFTDIAVTLQYLPDMIKDYFGDGSDFGINLRYYVEDKPMGTAGSVKNAEEFLDDTFLVISGDALTDIDLGKAVEYHYSKGSMATLVLKKVDIPLEYGVVVTDENGRITRFLEKPSWGEVFSDTVNTGIYILSPEVLKYFNKNEMFDFSKDLFPMLLKENKPMYGYITDEYWCDIGDLMAYSKAHMDVLDGKVKINIPGNKIKDRVWVGEGTVIEENVVIEEPCVIGANTRIKKDSVIGSYSVLGDNNIIGERSGIKRSILWKNNVLETNTQLRGTVVCSKVNIKEGVFAFENSVIGDDTQIGKNAVIKPSIKIWPNKIVEGGTEVNSNLVWGSKFVRSIFGFRGVAGEINVDITPEYASKLGAAYGAIFKGKGKIGVSSDDSAAAKMLKMSFMSGLLSAGLKVLDFGVLHLPVARSAVRFYGADGGIHISTSSTNFGRLTVDFLDKNGSNIKREVERKIENAFQREDFSRCEGEAIKDVEVIPDYTKYYLRNIINNTRSKDFGYRIALNSLSGFILETVGNLLETFGCTVEKTSLDLRNAKTMRNGNKSAEMTYFTDMIKMGNYDLGVSIEDTSEKMMLVDNNGRIVSDDMFTALISLIVFKTVQGGTVVVPISTSSVVDKLAEQNNGKVIRTKTSPQDIMNKMLGNETKENVYEQFTLHFDAIAGLVKILDFMKSENYSLSDLVNMIPDFYVSEKEVECSWNVKGKVIRQIIQENEGQSIETLEGVKIFKDGGWVLVLPDAEQPVCRIKSESYSAEFAEELTNFYVNKVREISQK

SEQ ID NO: 41828 - protein, 201 aa, Zea mays
APEIYLIGQSAGAHIAACALMEQAVKESGGNPVSWSLTQIKAYFGLSGGYNMHNLVDHFHERGLNRSIFLSIMEGEESLSRYSPEIVAKTSSAETIALLPLVVLMHGTEDYSIPSSSSQTFVDVLQQAGAEARLLLYEGKTHTDIFVQDPLRGGRDPLVEDVLSIIHADDANACQKIALAPTPRRLVFEWQLKLARKISPF

SEQ ID NO: 41829 - protein, 352 aa, uncultured bacterium
IGAANNLMAAMLDNHIYQGNALRIDPKRITWKRVVDMNDRQLRNIVDGLGRKVDGFTREDGYDITVASEVMAVLCLASDIIDLKERLGKMIVAYTYDDEPVTAADLKADGAVAALLKDALKPNLVQTLEHTPAFIHGGPFANIAHGCNSVIATKMALKLGDYTVTEGGFGADLGAEKFLDIKCRKAGLKPSAVVVVATVRALKHHGGVAKTELNNENLEALEKGLPNLLQHVENITTVFGLPCVVAINRFPFDSEAELQLIADKCKELGVNVALSEVWGKGGDGGVELAKEVVRLCETENNFQFCYDENLSIEEKLNTIVTKIYRGEGVELAATAKKQAKRLTELGFGNLPI

SEQ ID NO: 41830 - protein, 354 aa, uncultured bacterium
IGIANNLMSALIDNHIQQGNALNIDTRKIVWKRVVDMNDRQLRHIVCGLGGKASGVPREDGFDITVASEVMAVLCLASDLADLKSRLARMVVAYTRDDKPVTAHDLKAEGAMAAVLKDAIKPNLVQTLEHTPAFIHGGPFANIAHGCNSIQATETAMKLSEYTVTEAGFAADLGAEKFLDIKCRAGGFHPDAVVIVATVRALKYHGGVPKAELNSENLEALEKGLPNLLQHVDNVKNVYGLPCVVAINAFPTDTEAELKMVEEKCKEQGVNVRLSEVWAKGGEGGKALAEEVIRLCEEETSDTFQFVYDLDTTIEEKLNAIATKVYRADGVVVTAAAKKQIQQLTELGFDKLPI

SEQ ID NO: 41831 - protein, 213 aa, Mesorhizobium loti MAFF303099
MTQANGPLRIGIGGPVGSGKTTLTEKLCKALRDEFSIAVVTNDIYTREDAMMLARLQALPEDRIVGVETGGCPHTAIREDASINLQAIAELNRKFPDLDIIFIESGGDNLAATFSPDLADLTLYVISVCQGEEIPRKGGPAITRSDFLIINKSDLAPYVNVNLDVMESDAARMRGKRPFGFTDLSRGKGLREVIDFIVEHGGLRVGTATSTAA

SEQ ID NO: 41832 - protein, 346 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFELARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVTATVGI

SEQ ID NO: 41833 - protein, 133 aa, Zea mays
TPGHSENFETPGVEVTTGPLGQGIANAVGLALAEKHLAARFNKPDSEIVDHYTYCIVGDGCNMEGILTEACSLAGHWGLGKLIVFYDDNHISIDGDTGIAFTEDVSGRFEALGWHTLWVKNGNDGYDEIRKAI

SEQ ID NO: 41834 - protein, 344 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFELARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVGMGI

SEQ ID NO: 41835 - protein, 147 aa, Bradyrhizobium sp. BTAi1
MTTVRNALAQKSDALIHVRSRDMVVEALQKMRDNRVRSVLVIDDGVLVGIVTQGDCAIKVLLPGLDAKQTQVGQVMTANPVTVKPDHPLDGCMAMMSQRGFRHLPVLDAGKVVGVISIGDVVKNIIRDLEHNVDDLMGFIMKDGPGG

SEQ ID NO: 41836 - protein, 168 aa, Solibacter usitatus Ellin6076
MAATPWDSDLARELKERFGEGISETSTYLGQNFLVARPDSVIPILEYLKLEADFDYLVDVTAVDWPKRAERFDLVYILYSFSRNERVRVKAFIADGYKPETAVGVHLTANWLEREVFDMFGIEFAGHPDMRRILMPEEWQGYPLRKDYGILQQDARWVQENLEIESGQ

SEQ ID NO: 41837 - protein, 175 aa, Streptococcus vestibularis
RFVLSAGHGSMLLYALLHLSGFKDLSIEELKQFRQWGSKTPGHPEFGHTVGVDATSGPLGQGIATAVGMAQAERFLASRYNKEGFPIFDHYTYVIAGDGCFMEGVSGEASSYAGLQKLDKLIVLYDSNDINLDGETKDSFTEDVRARYEAYGWNTEFVQDGTDVEAINAAIESAK

SEQ ID NO: 41838 - protein, 398 aa, Wolbachia endosymbiont of Drosophila melanogaster
MNIPSIENCDLHNKTVLLRVDFNVPIKDGEIRDVTRILRALPTIQYLVNASAKIIIISHFGRPKARDNNLSLKNVIDTLSQLLNKKVKFIDDCFGEKVQRAVSVMDAGDIILLENLRFYKEEEQSDSNFAKQLASLADIYVNDAFSCSHRAHASISRITEFLPSYAGFCLQDELKYLEKAVSFKAKPITAIVGGAKISTKIKVLMKLTEKVNYLVLGGAIANNFLSFSKVNIGKSFFQNGVDDLLHNILETANKNNCKIVVPEDVLVAVNSDYSTSISRRTESILDGDIILDIGPQTLSTISSIIASSKTLLWNGPIGVFEHSAFASGTIGVMKIVSDLTHKGKLTSIIGGGDSLSAISAAGLADKDFTYVSTGGGAFLDWLSGDEMPGVAALQKRLD

SEQ ID NO: 41839 - protein, 541 aa, Brucella abortus
MTVKTIATTPYQDQQPGTSGLRKKVPVFQQPNYAENFIQSIFDVLEGFKGKTLVVGGDGRFYNREVIQKLIKIAAANGFGRIMVGQGGILSTPAASNMIRKYKAFGGMILSASHNPGGPTQDFGIKYNIGNGGPAPEKITEAIFARSKVIDQYKIADAADIDKIGTSKIGDTEVVIFDPVADYAELMESLFDFAAIRAMIKGGFQMKFDAMHAVTGPYAKEIFERRLGAPEGSVVNFVPLPDFGGHHPDPNLVYAKDLYDLLMSSHAPDFGAASDGDGDRNLILGRGIFITPSDSLAMLAANAHLAPGYKGGIKGIARSMPTSAAADRVAEKLGIGMYETPTGWKFFGNLLDSGKVTICGEESSGTGSDHVREKDGLWAVLLWLNILAVRKESVKAIADDHWARFGRNYYTRHDYEAVDSDIATKLVADLRGKLAGLPGTSVNGLRIEKADDFAYHDPVDGSTSEHQGIRIYFEGGARIVLRLSGTGTSGATIRIYIERYEADPAKHNLDTQATLAPLIDAAEQIAEVKKRSGRTEPSVVT

SEQ ID NO: 41840 - protein, 133 aa, Methanothermobacter thermautotrophicus str. Delta H
MFTVTLMDPLANALTNIRNNEIRGNVKCRITPASKLIGRVLRTMQKEGYIGEFEYVDDGRAGKFIVELEGNINHCGVIKPRHAVKKDEFEKFEKRYLPAKNFGIIIVSTPEGIMTHKEAKDRGIGGRLLAYVY

SEQ ID NO: 41841 - protein, 228 aa, Lactuca sativa
CFRPWETYQADLSIDLKKHHTPTTFLDKLAYWTVKSLRFPTDVFFQKRYGCRAMMLETVAAVPGMVGGMLLHCKSLRRFEPSGGWIKALLEEAENERMHLMTFMEVSKPRWYERALVFTVQGVFFNAYFLAYLASPKLAHRIVGYLEEEAIHSYTEFLKELDKGTIENVKAPAIAIDYWRLPADSTLRDVVMVVRADEAHHRDVNHFASDIHYQGLELKDSPAPIGYH

SEQ ID NO: 41842 - protein, 175 aa, Streptococcus vestibularis
RFVLSAGHGSMLLYALLHLSGFKDLSIEELKQFRQWGSKTPGHPEFGHTVGVDATSGPLGQGIATAVGMAQAERFLASRYNKEGFPIFDHYTYVIAGDGCFMEGVSGEASSYAGLQKLDKLIVLYDSNDINLDGETKDSFTEDVRARYEAYGWNTEFVQDGTDVEVINAAIESAK

SEQ ID NO: 41843 - protein, 275 aa, Oryza sativa (japonica cultivar-group)
MSRFGRSGPPPIRDTYSLLVLNITFRTTADDLSPLFEKYGEVVDIYIPRDRRTGDSRGFAFVRYKYEDEAQKAVDRLDGRVVDGREIMVQFAKYGPNAERIHKGKIMETVPRSRGRSRSRSPRRGYRDDYRERDYRKRSRSRDRYGRDRYRERDYRRRSRSRSYTPDDYRRRGRDSVSPARRSLSRSRSRSYSPDDYRKRGKHSQSPVCKSPSAKRSPSMSPARRSPSASPARRSPSASPVRRSPSRSPRRTPSSQEGSPVKRYDEPRRSRSPST

SEQ ID NO: 41844 - protein, 291 aa, Zea mays
  misc_feature (21)..(21): Xaa can be any naturally occurring amino acid
  misc_feature (211)..(211): Xaa can be any naturally occurring amino acid
  misc_feature (228)..(228): Xaa can be any naturally occurring amino acid
  misc_feature (251)..(251): Xaa can be any naturally occurring amino acid
  unsure (1)..(291): unsure at all Xaa locations
TSKEMRIAHFVVKEPMVIFHXCAGVVEEVGAGVTHLAGGDRVALEPGVSCWRCRHCKGGRYNLCEDMKFFATPPVHGSLANQVVHPADLCFKLPDGVSLEEGAMCEPLSVGVHACRRSGVGPETGVLVVGAGPISLVSLLAARAFSAPRVVVVDVDDHRLGVARSLGADAAVRVSPRAEDLAEEVERILPGMGSDINISLDCARVNKTTVXRPLEVTPALLETCTLVXMGHIQMTLPLTAGGAQKRGMLGXFRYKYTWPLGLSFSAIGKGPIALPPTPWLSHRERREGLRA

SEQ ID NO: 41845 - protein, 84 aa, Yarrowia lipolytica CLIB122
MAGGRGLRKGINKPTIRRLARRGGVKRISSNIDPDSRDIVKDVIKQVLGDALFYTHHARRNTVTGVDVVHALKRQGRPLYGFDA

SEQ ID NO: 41846 - protein, 851 aa, Oryza sativa
MALLQFGGTLAPKLGEKPQLLPRSPALTRVIYADPRFLVSKSGSGGRLKHLVSPTASLQSRTSSRLFNHAPSPRFRHRRSSRFIVRADADFYSTLGVSRNASKSEIKSAYRKLARSYHPDVNKDPGAEQKFKDISNAYEVLSDDEKRSIYDKYGEAGLKGAGMGTGDYSNPFDLFESLFEGFGGMGGMGGRAARNRPMQGDDEAYNLVLNFKEAVFGVEKEIEITRLEGCNTCDGTGAKPGTKPTTCKTCGGQGQVVSSTRTPLGIFQQVSTCNTCGGTGEFSTPCNTCGGDGRVRKTKRISLKVPAGVDSGSRLRVRSEGNAGRRGGPPGDLYVFIDVLSDPVLKRDGTNILYTCKVSYIDAILGTTVKVPTVDGMVDLKIPSGTQPGTTLVMSKKGVPLLGKSNARGDQLKHQTILIVIEIDIVQNIGRQAAAAVAGGVGEKARWWWLCRRRGVAATGWAVVHGRISGWLMAVATLFAGDGPGGGGLHEGRRMMILDNFETSGRRRRQRGSRALHDLRLPNPSRLLARRPRLPSPRLPLAPISILLAEVAPASSCSRRIRILIHPIRPRPRISSPRPPLAPIPILRAEVAPGVLLLPPHRRSPEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEVPLSVCEWFKDYQPIAPGKQEVEHAYEFVKKKFEELYFQSSKPDRVDRVFKIYRTTALDQKLVKKTFKLIDESMRRSREGT

SEQ ID NO: 41847 - protein, 541 aa, Deinococcus radiodurans R1
MSRLTDLPAWQALEDHYYELQGTHLRELFAADPERGEKMNAEGAGLYLDYSKHRVTDETLRLLRELAQATGVEARRDAMFRGEKINVTEGRAVLHTALRAPRDAVIEVDGKNVVPEVHEVLDRMATFADAVRSGEWLGYTGKPIKNIVNIGIGGSDLGPVMAYEALKHYAQRDLTVRFVSNVDGTDLTEKTRDLDPEVTLFIVSSKTFTTQETMTNARSARKWLLGSLKDDAAVTRHFVAVSTNAEEVQKFGIDTANMFGFWDWVGGRYSMDSAIGLSLMVAVGPEHFREMLAGFHDMDEHFRTAPAEQNLPMLMGLLGVWYGDFFGAESLAVLPYDQYLASFPAYLQQLDMESNGKHVTLGGEPVDYQTGPIVWGQAGTNGQHAFYQLIHQGTKLIPCDFIGFCQTLNPLPPHHDLLMANVFAQTEALAFGKTLEQVLADGVAPEVAPHRVFEGNRPTSTILADRLTPRTLGALIALYEHKVFVQGAVWDINSFDQWGVELGKVLAKKIDGELQSEGEPELQHDSSTNALIRRYRARRQG

SEQ ID NO: 41848 - protein, 183 aa, Shewanella sp. MR-7
MAMNTETLSLIKQSIKTIPNYPKEGILFRDVTSLLENAVAYKATIDLLVEQYRNKGFTKIVGTEARGFLFGAPLALELGIGFVPVRKPGKLPRATISQSYELEYGHDSLEIHTDAITANDKVLVVDDLLATGGTIEATVKLIRQLGGEVQDAAFVISLPDLGGEARLTALGLELVKLCEFEGE

SEQ ID NO: 41849 - protein, 229 aa, Glycine max
MAGAGAGGGYGDANQRIDYVFKVVLIGDSAVGKSQILARFARNEFSLDSKSTIGVEFQTRTLVIDHKTVKAQIWDTAGQERYRAVTSAYYRGAVGAMLVYDITKRQTFDHIPRWLEELRNHADKNIVIILTGNKCDLENQRDVPTEDAKEFAEKEGLFFLETSALEATNVETAFITVLTEIYNIVNKKNLTADENQGNGNSASLSGQKIIVPGPAQEIPAKRNMCCQSS

SEQ ID NO: 41850 - protein, 370 aa, Solibacter usitatus Ellin6076
MPDSTFLDSTELVLNMGPQHPSTHGVLRVILKLDGEKVLGTDCIIGYLHRGVEKIAENRTYAQFNPYVDRMDYVAAVSNGLGYCLAIEKLLNVEAPPRAQCIRVILTELNRIASHLLWLGTHALDIGAITPVFYCLREREEALKIFEKYCGARLTTHAFRIGGLLYETYDGFEQEIRDFCKMFIPKVDEYEELLTNNRIWVGRLKDVGILSADECKEFGVTGPVLRAAGVKWDLRKAQPYSGYEKYDFEIPTRVNGDTYDRYIVRMEEMRQSVRIMQQAVDGIPEGPIMGKVGKVIKPPIGEAYVSIEAPKGELGYYAVSDGSTQPYRIRVRPPSFVNLQALDRMIRGGLIADVVAVIGTLDIVLGEIDR

SEQ ID NO: 41851 - protein, 151 aa, Solibacter usitatus Ellin6076
MIELLKKIFLVDLFQGLFVTFRNQNPKYIYTEQYPAERPKVAERYRGAPRLNINPDNGETLCISCNLCALACPENLIVVTSERSEVTKRKELVTFTYDTSRCMFCGLCEDACPVDALELTQDFEMASYTREGQIWDRQALEEGPRPTQYKC

SEQ ID NO: 41852 - protein, 370 aa, Arabidopsis thaliana
MQKQSTTMLSDLPKDVAEEVLSKFPVTSLRRVRFTCKKLNTLSKDMSFTRKHIDKEEAKKKQSKEFHVVMMLDFRVSLFSLNLLNPNPIERLGQLVSLDGGAQVDISNIFHCEGFLLCTTKDISRVVVWNPCVGQTIWIKPRNSFNKWDRYALGYDVMKNHKVLRFVDDGEYGRRHLLCEFEIYSFESDSWEVLDVNPDWEIDFVHRGLSIDGNSYWFARDKVVPYGGQDPSYFLLCFDFTTERFRPPLPLPFQPYFGDTVALSSVGDNQIAVLCQRSSSPYTLKIWISSKVEPNAVSWNKLFLKVDMKPLTGNSFSYSGGSFFVDEEKKMAVVLDKNIGGGFDPTRNIAYIIGKEGYFKKVDLGESRHL

SEQ ID NO: 41853 - protein, 255 aa, Populus deltoides
MGRGRVQLKRIENNISRQVTFSKRRTGLLKKAHEISVLCDADVAVIVFSTKGKLFEYSTDSSMESILERYERCSYAEQQFVPHGPEHQGSWFLEHPKLRARVELLQRNLRNYTGQDLDPLSYKELHHLEQKIDTALKSVRSRKNQLVHESLAEMQKKEKALQDQNNILVEQVKKKLKALTEQAQWEQQNLGQNSSSFMLPQAQPPLQPSMLSHPPPTLGGSFQIRGFLNGNKDVEVQTQPSTMPHWMLRHVNDRI

SEQ ID NO: 41854 - protein, 297 aa, Mycobacterium smegmatis str. MC2 155
MHEYLRAAELRGRRAALRGMVSRQIPALAAVPATRFAMAVATVDGAEACIGEASTAFSIQSLSKLFALCALLRHEPDVWTDVGWVPTDAGYGSVADLERNHWRPRNPFVNSGALVVTDRLMTHAGDAVGATIEVLQAGDPDAPVRSDPAVALSESEADHRNSAIAHVLAEHGRLVNDIDRVLPQYFAQCAIAASVRTIARAALFLADRTGERTVLDDDSVRRVNAVLLTSGMYGAAGDIAYRIGLPAKSGIGGGVLAVMPGHGTVCVWSPPLDDDGNSAGGVAAIEEFARLAGWSVF

SEQ ID NO: 41855 - protein, 454 aa, Wolbachia endosymbiont of Drosophila melanogaster
MPIEILMPALSPTMSKAGGKIVKWHKKEQDKVEVGDVIAEIETDKAIMEFESIDEGVLAKILVTEGTSGVPVNQPIALMLEEGEDESALNNYTSTSINSAVKKEVTKSAVDNQKSEHQDLNGKPISHSSVSFQRVTLESNPSMSSQCLTLGSRKEEWIPVSATQMTEGYAEGRTKISPLAKKIAQNEGVNVQQLKGTGPYGRIIKADVLEFLGSGIHTESPEKDTIVEVSNMRQVIAQRLTESKQNVPHFYLTVDCQVDKLISLKNEINSADENNKVTINDLIIKAAAFSMKKFPDINSSWIDNKILRYSNIDISIAVALEDGLITPIVKNADKKGILSISKEVKDLVSRARSGKLKPEEFQGGGFTISNLGMFGIKAFSAIINPPQSCIMAVGASKKQPIVMNEKIEIAEIMTVTLSVDHRAVDGALGAKFLNAFKHYIENPLVMLIETAVIY

SEQ ID NO: 41856 - protein, 350 aa, Citrus unshiu
MADNHNPTSGAGSKDLSASMDGGSGAYDRLVVCFGEMLIDFVPTVGGVSLAEAPAFKKLLCAPANVAVGISRLGGSSAFVGKLGDDEFGYMLANILKENNVDTSGVRYDSTARTALAFVTLRADGEREFLFFRHPSADMLLCESELDKNLIKQGSIFHYGSISLIAEPCRSTQLAAMNLAKESGSILSYDPNLRLPLWPSEEAAREGIMSIWDQADIIKVSDDEITFLTGGDDHNDDHVVLEKLFHPNLKLLIVTEGSKGCRYYTKEFKGRVPGVKTKAVDTTGAGDSFVSGILNCLAADQNLIKDENRLREALLFANACGALTVTERGAIPALPTKEAALKLLHTVAAL

SEQ ID NO: 41857 - protein, 502 aa, Xylella fastidiosa 9a5c
MHNGFDALQLHANRLRGVTIPDLLAAELKRPEQYARQVGPLYFNFARQKYDCVALEALFALARNHNVAGAFQRMFCGEQVNVTEGRAVLHTALRGDLSGTSVAVAAYTAAAKVRERMYALIAGLDASEVTDIISVGIGGSDLGPRLVVDALRPISQGRFRVHFVSNVDGAAMRRTLDMLDPSRTAGILISKTFGTQETLLNGRILYDWLGGSERLYAVSANPERAAHAFDIVPTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDPYTENHFALNANLLAQIEVLANGQLSDDPHRVYPGGNPSTLILLDALTPQALGGLIAMYEHSVYVQSVIWGINAFDQFGVELGKHLAVQLLPALKGESVEVVDPVTRAVLVRLRG

SEQ ID NO: 41858 - protein, 448 aa, Nostoc punctiforme PCC 73102
MVVSLENNAPHRVVIVGGGFGGLYAAKALNAANVNVTLIDKRNFHLFQPLLYQVATGTLSPSDISAPLRSVFSKSKNTKVLLGEVNNIDPKAQQVILGDEIVPYDTLIVATGANHSYFGKDHWEKVAPGLKTVEDAIEMRRRIFGAFEAAEKETDPEKRCAWLSFVIVGGGPTGVELAGAIAELAYKTLKEDFRSIDTSETKILLLQGGPRILPHMVPELSASAAVSLQKLGVELHTHTRVTNIEGDVVTFKQDNEFTEIASKTILWAAGVQGSPMGKVLAESTGVECDYSGRVIVEPDLSIEGYDNIFVIGDLANFSHQDSKVLPGVAPVAKQQGEYVGKLIQRRLKGKTLPQFHYNDVGSLAMIGQNLAVVDLSLIKLTGFIAWAFWLLVHIYFLIEFDTKLLVVFQWAWNYITRNRRSRLITGREAFVEAKTANNRVQEPSGTAL

SEQ ID NO: 41859 - protein, 275 aa, Pseudoalteromonas tunicata D2
MSLTVVITGASKGVGAACAKIYAAQGANLVLVARGLSALEQLAHDLKQQYPNSQILTLGADIAKLDDCQTIISAAVKRFGKINVLINNAGLHHRGEFSAQSADQMAAMVDVNLRAPIYLCALALPHMPKPTTADHQNAIVMVGSLAGRAPLQGAATYSATKAGLRAFTYALHDELIQKNINVAVVSPGPIDTAFIMEEIDVVEDIVYSQPMSTPEQVAENVLTLSKSIRTEIAMPWFSGKLTTLGYLLPSFRRATRGLLYKIGKKNKQKYRNRID

SEQ ID NO: 41860 - protein, 382 aa, Vibrio sp. Ex25
MTVEIKPGQTHIKSKAMVAWAAGEPLKMEEVDVQLPKAGEVLVRIVATGVCHTDAFTLSGDDPEGIFPSILGHEGGGIVEMVGEGVTSVEVGDHVIPLYTAECGECKFCKSGKTNLCQAVRETQGKGLMPDGTSRFSINGETIFHYMGCSTFSEYTVLPEISLAKVNKDAPLEEVCLLGCGVTTGMGAVMNTAKVEKGDTVAIFGLGGIGLSAIIGARMVGASRIIGIDINESKFDLAKQLGATDVINPQKFDKPIQEVIVEMTDGGVDYSFECIGNVNVMRQALECCHKGWGESVIIGVAGAGQEISTRPFQLVTGRVWRGSAFGGVKGRSELPEIVNRYMAGEFGLQEFITHTMGLADVNKAFDLMHEGKSIRTVIHMDQ

SEQ ID NO: 41861 - protein, 178 aa, Bacillus subtilis
MIFDFVVIRENSEGEYSEVVGRIHRGDDEIAIQNAVFTRKATERVMRFAFELAKKRRTLVTSATKSNGIYHAMPFWDEVFQQTAADYSGIETSSQHIDALAAFFVTRPETFDVIVASKLFGDILTDISSSLMESIGIAPPDINPSGKYPSMFEPVHGSAPDIAGQALPIRSARFGQRS

SEQ ID NO: 41862 - protein, 125 aa, Arabidopsis thaliana
MREQTMFKKALELSTLCNIEVCVIYYGRDGELFKTWPEDESKVRDMAERFTKLNERERRKKRTNLSLFLRKKILDDNKLSGKVLEMKDSLERGLRVLQDKLLLLQPENQTKSLTRSVSSLDYVFV

SEQ ID NO: 41863 - protein, 362 aa, Arabidopsis thaliana
MEQQEKKKRKVYRRRRLQSKPTSSFPLDLASEILLRLPVKSVVRFRCVSKLWSSIITDPYFIKTYETQSSTRQSLLFCFKQSDKLFVFSIPKHHYDSNSSSQAAIDRFQVKLPQEFSYPSPTESVHGLICFHVLATVIVWNPSMRQFLTLPKPRKSWKELTVFLGYDPIEGKHKVVCLPRNRTCDECQVLTLGSAQKSWRTVKTKHKHRSTNDTWGRCIKGVVYYIAYVYHTDVMINYEGRLACVDKLYTLNNDGIRLWILEDAEKHKWSSKQFLARYVHNDLRTNTISKLTGVTHAGEFVYISTQYLKSFVLFCDPKKNRFRKVEFNGIVDEEFRLSNGVGRGRIYALYNFPNHCESLMSL

SEQ ID NO: 41864 - protein, 139 aa, Wolbachia endosymbiont of Drosophila melanogaster
MAIERTLSILKPDAVKNNITGNINSYIEQSGLKITAQKMMLLTKKQAELFYEIHKDRPFFGELVEFMTSGSVVVQVLVGENAVSKYRQIMGATDPKQADKGTIRGDFADDISENRVHGSDSLENARKEIAFFFAECELV

SEQ ID NO: 41865 - protein, 578 aa, Zea mays
MAAAGLRKGNARLPPEVNRVLYVRNLPFNISSEEMYDIFGKYGAIRQIRLGNAKDTRGTAYVVYEDIYDAKNAVDHLSGFNVANRYLIVLYYQPAKMSKKSDIKKKEDEITRLQENETGSSMVSSTENKMNELVSPVARAAKPSRQLNFIDISCLATFEVLKNTCRQILVASLSLASFSVARGRSPHSTTSSATTTLNAYFFLRFSDECVLLVAAASLSSLPRSMAMKPVDDAPSNYPTTVVDVSTLRTNHAVGQTQIAPSDDHARTPCTSHAEGLIPNLVDVSEDVPLVDWSTLHIVESYDEEGRLAVMADEQMYASLGLMIDDEIGANQGGVIQEIDAHGCSAHDVGGYIHETEYPNQAEDLTPSNSLFIYDKDNPKIELGTMFPDMKAFRLALRQYAINKEFELATEKSCKTKFRGHCKQKTNDCPWQIVGAKMKILPTIKVTLLVDEHKCTSSSRILTTMPSQAWVADKALPLLRKNPNMGAKAMQIYLQDEYNVTIGYDTVWRGRERALHELYGGWNESFSLLLNWKADVEKRSPGSVVEIDTKIVDEKNPTGGSGQAIFAGEGMADKDQSHD

SEQ ID NO: 41866 - protein, 409 aa, Chromobacterium violaceum ATCC 12472
MHAFDNRQLADIARQYGTPLWVYRADTIRERIAELKAFDTIRYAQKANSNTHILRLMRAEGVKVDAVSLGEIERALAAGYRGGGEPSDIVFTADVLDRPTLAKVIAENIPVNAGSIDMLRQLGEAAPGHPVWLRINPGFGHGHSQKTNTGGENSKHGIWHGDLDEALQAVRRFNLRLIGIHMHIGSGVDYGHLEQVCGAMVELVARLECDIEAISAGGGLSIPYRDGDARIDTAHYFQLWDAARRRIEAHLGHPVQLEIEPGRFLVAEAGALLSEVRAVKNMGSRHFVLVDAGFNDLMRPSLYGSYHRISLLDADGAEKTGAVDTVVAGPLCESGDVFTQQEGGTVETRPLPPAQVGDLMVFHDAGAYGATMSSNYNSRPLLAEALVDGGAVRQIRRRQTIAELLALEA

SEQ ID NO: 41867 - protein, 315 aa, Triticum aestivum
  misc_feature (57)..(57): Xaa can be any naturally occurring amino acid
  misc_feature (236)..(236): Xaa can be any naturally occurring amino acid
  misc_feature (265)..(265): Xaa can be any naturally occurring amino acid
  misc_feature (274)..(275): Xaa can be any naturally occurring amino acid
  misc_feature (280)..(280): Xaa can be any naturally occurring amino acid
  misc_feature (282)..(283): Xaa can be any naturally occurring amino acid
  misc_feature (289)..(289): Xaa can be any naturally occurring amino acid
  misc_feature (293)..(293): Xaa can be any naturally occurring amino acid
  misc_feature (295)..(295): Xaa can be any naturally occurring amino acid
  misc_feature (297)..(297): Xaa can be any naturally occurring amino acid
  misc_feature (302)..(302): Xaa can be any naturally occurring amino acid
  misc_feature (304)..(304): Xaa can be any naturally occurring amino acid
  unsure (1)..(315): unsure at all Xaa locations
MTMGCVDHDHGNVESHDVPEAKPSEIYTYEAGWHIYGMNCSERGDKKYRLAIASFLXQLVNRVEVVHLDESTGDIAPVLSFHHPFPPPKSMFFPYPQSLRPDLLVTSADLLRIWCIKDVHAAVPVAADSKNGSVSCNGVCSPAGHHPSVKLCCEINVNRNSDFCVTLTSFDWHEAYPRRIGTSSIDTTCTIWDVEREVVDTQLIAHDKEVYDIAWGGAGVFASVSADGSVRVFDLXRDKEHSTIIYESILGGGPILAATDGGLCXRHIWLSWGXXKQDPXYXXTSSMVXKVAXLXRXPTLLXLXQRHQAPGMPMG

SEQ ID NO: 41868 - protein, 276 aa, Magnetospirillum magnetotacticum MS-1
SIRVNPDVDALTHAKISTGKSENKFGIPIARAREVYAGAARLPGLEIVGVDAHIGSQITDLTPFDNAARLLCALARDLLADGHRLHHVDFGGGLGIPYRDDNAPPPDPAALAAILRPHFRPLGLKPVFEIGRMIAGNAGILVTRVVYVKPTEGKTFVIVDGAMNDLIRPTLYEAFHALRPLSEPGPDTPRLTADVVGPVCESGDYLALGREMPEVSPGDLIAVMSAGAYGAVQAGTYNSRRLVPEVLVRGDQASVVRPRPSYDDLIRLDRLPGWLA

SEQ ID NO: 41869 - protein, 92 aa, Oryza sativa
MSEEGGGNCRPRRMKALKGLSFYTTEEEQKKVFSPNVVSQEGARLVRDNQTGRPKGFGFVKYSSQADAEKAVKAMDGRIIRGRLIFVEIAKE

SEQ ID NO: 41870 - protein, 379 aa, Deinococcus radiodurans R1
MSLSRHALQDAAQRFGTPLYLYDAEELDAALWRVQRAFGDARIFYAMKANPNLNLLRRYAAAGVGFECVSLGELLRAEAAGAGGERMILNGPAKSDAEYAAAARLGATIVVDREEEVVLLPPGSRVLVRVNPAMTVSTHEHLATGTARSKFGLTPEQVPGTLAELRDAGHEVLGLHMHIGSAIEQAEDFTAAFARVTELRAHIGGLSVLNVGGGWSLNADLEGIAYEAHEAARVFGAELWVEPGRYLVASAGWLLTRVVGTKRTGRNFCLVDAGMTEFLRPMLYGASHPLYPMWDALATEVWDVAGPACESGDLIARGVPLPTPQRGHLLLIGEAGAYGASMSSTYLSRPRPAEVLWTGHDWQLLRRRETPQDIWAAEV

SEQ ID NO: 41871 - protein, 315 aa, Prochlorococcus marinus str. NATL1A
MQCRLLNFYCQRIMNKSALLSPAPFGRLLTAMVTPFDDEGKVDYGLAADLANYLVDQGSDGIVVCGTTGESPTLSWQEQQKLLEIVRNSLGSRAKVLAGTGSNSTSEAIEATKEAANSGADGALVVVPYYNKPPQEGLEVHFRAIANAAPKLPLMLYNIPGRTGCSISPSIVSKLMDCSNVVSFKAASGTTEEVTQLRNYCGSDLAIYSGDDALVLPMLSVGAVGVVSVASHLVAPNLKKIIESFLEGKYSEALYLHETLQPLFKSLFATTNPIPVKAALQLIGWSVGPPRSPLVSLNSEMKEELVKILSSLRLI

SEQ ID NO: 41872 - protein, 116 aa, Haemophilus ducreyi 35000HP
MSNIIKQIEQEQLKQNVPSFRPGDTLEVKVWVVEGSKRRLQAFEGVVIAIRNRGLHSAFTLRKVSNGVGVERVLQTHSPIIDSIFVKRKGAVRKAKLYYLRERSGKSARIKERLGN

SEQ ID NO: 41873 - protein, 736 aa, Arabidopsis thaliana
MAGNNSESSLYQVLVEWCQRMETSQARLREDVDDLLLQEESRTGKESATGLETDTEKEAEVEVEAEAADSWDNPTATWERAVSGFYFADSAYRTLMDSMGHAIHVTSAASGEITFWSRSAENLYHWYAEEVVGYRTIDVLVTEEYRNSLTGIRNRVCRGETWTGQFPFQKKTGELFMALVTKSPVYENGELVGVVTVSSDATLFNRMHPLSNEHQQQARSNNRHESNLRKHQWHLPRPQIAAASQVPVVPQYSSAVASNLKASKLLPQRNGDDSFNGNHNSRSRDENVPVVASTTFEKYGSLADKFLGKLQRKITGSQGTEDNEPILRNGINKSACGSGGSSKASNAVTCTAFRDNGNGKPKRAEVRISDVYGNGAEGLIHNGDRFQYIGNLGQSKPPRGLESGLVSGMRGTKMSDLNGEIEDAWNTRLSVDPLPILGVNSGRQQSPVNQRNNRLVTDSSCEIRWEDLQLGEEVGRGSFAAVHRGVWNGSDVAIKVYFDGDYNAMTLTECKKEINIMKKLRHPNVLLFMGAVCTEEKSAIIMEYMPRGSLFKILHNTNQPLDKKRRLRMALDVARGMNYLHRRNPPIVHRDLKSSNLLVDKNWNVKVGDFGLSKWKNATFLSTKSGKGTPQWMAPEVLRSEPSNEKCDVFSFGVILWELMTTLVPWDRLNSIQVVGVVGFMDRRLDLPEGLNPRIASIIQDCWQTDPAKRPSFEELISQMMSLFRKPGSGAQEEDD

SEQ ID NO: 41874 - protein, 541 aa, Magnaporthe grisea 70-15
MAHSTVSLALAAVGIFTLYLISKVILKTWQNATEARRLGCKPPASFPSWCPFGLDIVRKLIISRRQMRTPEWLREQLAKTSTPANPNNLTCSFQIVHTSGILTADEVNVHAMLSKQFDDFEVGQTRREIARPLVGESIFTTDGHAWKMLRGLVRPSFARHQVGDLELDEKHFKNMMACLETGSDGWTGNIDLQTLMFRYSLDSSTEFLCGASVGSQLKELQLQNGKVTDDEDEIDFASALDRAMEGLATRGQFFKCGPYIWPRGFEKACRDCHAFIDKYVARRQNKTLAAAEKQPPAESPPAAKEKYIFLDALAESFPDPVELRHQILGVLFAGRDTTASLISWVFYNLARDPARCHKLRRAVLEHFGGPREEEEEDPGRAVTFESLKECRYLQHVINETARLCPVVPVNSRRARRNTTLPRGGGPDGQSKVFVKEGTLVYFAPYIMGRRKELWGEDAERFVPERWEGKRHGWEFIPFSGGPRICPGQQSALTKTAYVIVRLLQRFDRIESWDPEVDVKHDATATMCSGTGVKVRLHADGF

SEQ ID NO: 41875 - protein, 745 aa, Zea mays
MALCRGDVNSTTCFSCLTEAFGDLPSACSDDKAATIYYDPCMVHYSDVHTLPGDDDTGPSIDTYPIGDNQYVTADPGQFIRLLAALVNATADYAAYNSTRRFATGQADTGFDPEFPELYALAQCTPDQTPAQCHKCLAGLISQSLGGFQNRDGARMLAVSCTYRYETKPFYNGPAMVRLASPSSGAPAPAPAVNSRVRAADGDPMYSTEAEDTEMVDSMMMDVSALRAATGDFDESNKLGEGGFGAVYKGVLPDGEEIAVKRLSSSSSQGVQELKNELALVAKLKHRNLVRLIGVCLGQQERLLVYEFLPNRSLDLILFDTENEERGRRRLDWAQRYKIINGVARGLQYLHEDSQLKVVHRDLKASNVLLDENMNPKISDFGLARIFGRGQTQAVTRRVVGTYGYMAPEYMMRGNYSVRSDAFSFGVMVLEVVTGRKNSDDGCNLLATVWTHWEAGTVAQLVEPSTMGGSFPEGDVLRCVHIGLLCVQADPAARPVMSSVVMMLGSDTVTLQAPSKPGFFVRNNSANAAASTVSLDDTELAARLGAEVQGRRAGPAVPSCTKTPPTQLKVVHRDLKTSNILLDAKMRPKISDFGLARIFKRDQTQAVTRPAASLAPSQYSVELQNQLPVWSVFINTFLLDLFHVSWVHPYMAPEDVMRGNYIINPFHKFDGTNSFLILLLTISLRKIKCDGLTHSISQTKRESTEQEDDYLVPQNKHAVNYYHALVDSGGGLFRCQLSPGSGGGL

SEQ ID NO: 41876 - protein, 307 aa, Alteromonadales bacterium TW-7
MLGLYFTLYVRVLNVVIINIKGKGMKLSLSVSIEHTETGLEFINIESDLCDAKIFLQGGQITQFTPKGKQPLIWVSGNETFSEGMSIRGGIPICWPWFGTHANGGWPAHGFARTSLWQADEVNETEECITVSLKLPMKLVNAEYWPHQSALKVEFVLSDSLEVRLTTTNLGDTAFSYTQALHTYFPTSDITNTHVDGLQGAQYIEFAEGPFTQQAVVGFERETDMVYTQAAPIQYINTPEGVIKVGRANSSSCVLWNPWIEKSKRLSNFADDEYKTMLCLEAANVLDDAVTLAPQQSHTLVTSIEWA

SEQ ID NO: 41877 - protein, 430 aa, Blastopirellula marina DSM 3645
MRNVISLVLGGGRGTRLYPLTKYRSKPAVPLAGKYRLIDIPLSNCINSDLNRIYVLTQFLSVSLHRHIRQTYRFDNFRGGFVELLAAQQTGNESTDWYQGTADAVRKNLKYIQQYGTDYVLILAGDQLYRMDYRKMLETHIKSGADVTIAGIPVTREDAGSLGIMRLDDSGRVVGFVEKPQTEEDLNLVRMAPDKLEALGVKSQGRDCLASMGIYLFNRDTLVDVLEKTDYEDFGREIFPAAIRSRHVQLHAFDDYWEDIGTIRAFYEANLSLANPNPPFSFSDEDEPIYSRARFLPPTLMSEVTIKRSQIADGCRIGAGCVIDNSVVGLRSLIGENVTIKDSVLMGSDYFETEGELADHRSCKRPPLGIGSGSVIQGAIIDKNCNIGKNVRIVNDHGIEDKEYDVGVTVVEGIPCVEKGAQIPDGWTLT

SEQ ID NO: 41878 - protein, 377 aa, Candida albicans SC5314
MSADGEFTRTQIFGTVFEITNRYTELNPVGMGAFGLVCSAVDRLTGQNVAVKKVMKPFSTSVLAKRTYRELKLLKHLKHENLITLDDIFISPLEDIYFVNELQGTDLHRLLNSRPLEKQFIQYFTYQIMRGLKYIHSAGVIHRDLKPSNILINENCDLKICDFGLARLQDPQMTGYVSTRYYRAPEIMLTWQKYDTEVDLWSVGCILAEMIEGKPLFPGKDHVHQFSIITELLGSPPADVIDTICSENTLRFVQSLPHRDPIPFSERFASCTHVEPEAIDLLAKLLVFDPKKRISAVEGLTHPYMEAYHDPTDEPVCESKFDWSFNDADLPVDTWRVMMYSEILDFHQTVGVANETEGSEQPDSQVEQNNLDSANGA

SEQ ID NO: 41879 - protein, 202 aa, Cicer arietinum
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASENVNKLLVGNKCDLAANKVVSSETAKAFADEIGIPFMETSAKNATNVEQAFMAMAAEIKNRMASQPANNARPPTVQIRGQPMNQKSGCCST

SEQ ID NO: 41880 - protein, 193 aa, Chromobacterium violaceum ATCC 12472
MISKYNRPMENLSNLDYSSYLKGWIRTVPNWPQQGVMFRDITPLLQNPKTFRMLIDIYVHRYMMEKVDLVAGLDARGFIIGSVLAYELNVGFVPIRKKGKLPFTTVEEEYELEYGNAAVEMHTDACKPGDRVILIDDLVATGGTMMAGYKLLKRMGADVLEAAAIIELPELGGGQLVRDGGLDLFTVCSYEGH

SEQ ID NO: 41881 - protein, 698 aa, Erythrobacter sp. NAP1
MGLLAIVYGIVTSRQVLGASAGNAKMQEIAGAIQEGAQAYLNRQYTTIGIVGIVAAALVGFFLGIVPAVGFVVGAVLSGVAGYIGMNISVRSNVRTAAAAETGLQEGLTIAFRAGAITGMLVAGLALLAIAVFFAVLVGPMGLDANSRVVIDGLVGLAFGASLISIFARLGGGIFTKAADVGADLVGKVEASIPEDDPRNPATIADNVGDNVGDCAGMAADLFETYVVTVGATMVLTALLFASQLGENLLTLMTLPLLIGGACIVTSIIGTYFVRLGNGTNVMGAMYKGFIVTAVLAIPLIYLVTQYALSTFGSDMTTVLGTGPGGVDFNGMDLFYCSLIGLALTGIIIWITEYYTGTNFRPVRSIAKASETGHGTNVIQGLAISLESTALPTIVIIAAIIGAYQLAGLIGLAYGATAMLALAGMVVALDAYGPVTDNAGGIAEMAGLDESVREKTDLLDAVGNTTKAVTKGYAIGSAGLAALVLFAAYTADLREFFPEANVDFGLENPYVIVGLLLGALLPYLFGAMGMTAVGRAAGDVVKDVREQFAADPGIMEGTSRPNYARTVDLVTKAAIKEMIIPSLLPVLAPIVVYFVILGLAGQDNAFAALGALLLGVIVGGLFVALSMTAGGGAWDNAKKYIEDGNHGGKGSEAHKAAVTGDTVGDPYKDTAGPAVNPMIKITNIVALLLLAALAGGAH

SEQ ID NO: 41882 - protein, 248 aa, Oryza sativa
MEDERNTESHQGGEAAEQVEVKDRGLFDNLLGRKKDDQPEEKKHEEELVTGMEKVSVEEPKKEEHHAEGEKKESLLSKLHRSSSSSSSSSDEEEEVIDDNGEVVKRKKKKGLKEKIKEKLPGHKDHAGEHAPPPAATGFPAPAPPASVVTAAPTPAPAPPEDATAVPPPAAAPAAPATTPAPAHPPPATEETRPPPPPPASTRAALNWGVCETRPWLEFGSVWRVLVWCFFCTAALLSSCQDWSRPGQ

SEQ ID NO: 41883 - protein, 644 aa, Mesorhizobium loti MAFF303099
MSEAVDAKQAPLDVITIGRASVDLYGQQIGSRLEDITSFAKSVGGCPANISVGTARLGLRSALLTRVGDEQMGRFIREQLRREGVNTDGLKTDKERLTALVLLSVESEGVSPMIFYRSDCADMALAPEDIDEAFIASARSIVVTGTHFSRPNSDAAQRKAIRIMKAKGGKVVFDIDYRPNLWGLAGHAEGFERYVKSDRVSAQLKTVLPDCDLIVGTEEEIMIASGADDCLSALKTIRALSAATIVLKRGAMGCIVYDGPISDDLEDGIVGKGFPIEIYNVLGAGDAFMSGFLRGWLGGEDHATAATWANACGAFAVSRLLCAPEYPTFEELQFFLKNGSKYRALRKDEAINHIHWATTRRRDIPSLMALACDHRVQLEDVAAKAGADPARIRDFKVLAVKAAAKVAAGRDGYGMLIDEKHGREAMFEFARHPFAWLGRPVELPGSRPLRFEFSQDIGSQLVEWPVDHCIKCLCFYHPDDPAALKEEQQQKLRALFEAARKVGRELLVEIIAGKHGKLDNTTIPRALEELYALGIKPDWWKLEPQASAGAWTRIEAVILKHDPWCRGIVLLGLEAPQDELEAAFAATAKAPIVKGFAVGRTIFVHAAEEWLAGRMSDDEAVADMASRFEQLTEAWLAARGRKAA

SEQ ID NO: 41884 - protein, 79 aa, Glycine max
  misc_feature (72)..(72): Xaa can be any naturally occurring amino acid
  unsure (1)..(79): unsure at all Xaa locations
MATAMIAWAAVTTADRADPRMHAPFTGLKSMAGFTTRKTNHDISSIATNAVRVLCMHEWTPVLMKKYETLYXLPDLDDP

SEQ ID NO: 41885 - protein, 233 aa, Candida albicans SC5314
MSCEDEHHNHNHGHNHNHNHVAPIPTTAGQSLNNKIDTSKVTALNMANSADDLAKVFKDSTKKYQIKPIIKSDSDEQMIINIPFLNGSVKLYSIILRTNGDLYCPKTIKLFKNDTSIDFDNVDSKKPIQVLTHPQVGVANNDSDDLPEFLESNNDDDFVEHYVSRHKFTGVNQLTIFIEDIYDEGEEECHLHSIELRGEFTELNKDPVITLYESAANPADHKNLTIVENQNLA

SEQ ID NO: 41886 - protein, 473 aa, Bacillus cereus ATCC 10987
MQQQTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNADVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESEEPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYKTPLYPIVPILALITNSIVVISLAFIPEQRMALYCGIPFIIFCYIYYYINKKRQKPMKVETTNETNHQTR

SEQ ID NO: 41887 - protein, 440 aa, Candida albicans SC5314
MPSIDNDAGASTVSSSISLVKTIIGAGLLSMPLAYSTDGIIFGTFIILLAAFTSGFGLFLQCYVSRYVPVKHATFFNLCSITYPHLSVVFDFAIAVQCFGCAVSYLVLIRDLMPTIVTYVPYIDEKHYPSFWLLVSTVLTIPLSFLKNLDSLKYSSILGLVAIFYMTILVIGHYFAGDIERQGQITLFPTSVTGVFSTFSIIVFAFTGHQNMFSIINEARDKSLTSLTKLVNFAIGISSLLFIAVGLSGYLTFGQDVDGNVILSYPNGLTTTIGRFCIVFMVTFSFPLMIHPARISINNIYHWVTTNYFDKDEANESTALLGNESQESQIAEDEEQGKTHLSHVVPFPHKHFVIVTTSLLIIGYLLAISIKSFALILAIVGASGSTSISFILPGLFGYKLIGSESDDPSTLEVAFKNLSLGLTFWGVAVMILCLYSSLTL

SEQ ID NO: 41888 - protein, 1156 aa, Yarrowia lipolytica CLIB122
MRDYSDVSEAETEVAPSPYKLGSRLKRLKRRIDDDDDYSSDEGPSNHSSQVLRKEPKRKNSSDMSRSATPMPRVGSGSRKKRDANGRMKLQRMCDKGKYEEAYQLVRDGADVNDRDYAGNTALHEAALKGHVDIVKLLLDHKAIVDIRSGPTDLDTPLIDAAANDHVEVVQLLLERGADPRIINALGKSAMDSVDEEMPHSTKIRSLIQEALHSFRNRPRPPESREDDPEAFPDPELHKIYNHGTGGGEGGGAGSDTGSSRRRGVRAQAMRNDLLWLDLTSKNGREQIYQKAADGDIEFIGSSLEGGWKPDTQSLCLAARHGHTDVVGLLLAFGCECDEPGEDGETALLRTVGRGHVSTLKLLLDSGANPLRKNSQGKTALQVVKELSGYEEEVTLLEEWTSKGSGKDRGDSKLVKSEKADKSEKADKSDRDKARLEKMEKRRIERERERERERERDRERVKVEKVEKSEKSEKREKRERTNSTSERHNSTASTHSERHNSTSEIRDRERERERERERERKHVKKEPVVDTHANMSSSSPHHVASPPRVASPSQMSPVSTPMSRTSSQADENKGSVKHERTPSISSISDKLLVKKRKLAGGKEEMERRKSKEEVKVKKRSISSASGASNKPQSVFDKLFGSKQKEKEEQQRVAREKEEAARLERQERIRRKKQQQQEQLEEEKRKLEEEKRKLEEKKRLEEERLRKEQEKRDKAEKAERERVERERREKKERERKEREDKEKKEREEKERAERVEREKRERAERAEKAEKEARERKEREEKERVERVEKEKARAEKAEKEANEAAKAEKEAKDKEIKEAAEKAQAKEVKESKESKEPKESKETSKESSRESLSASSSAAASTTPSAATSPDSRKSPLIKRPKELDRQKSKESLDRREIEREKERKRLERQRAILKGIEEDERRRNEMRRREQELKAEQELLAAKEREKREAEELEREKERERQRRIQLDIDSRKALPYGLREAIYEPRQVDQIFAFLPLFVRQSCFLDIQLSLLLGVKNFCGSYPRVARRIVSTTEKERLWSTLTPLLCRAPGPGDDLEMVGLERQDERRKFLGMNCFWVSCSDVLEVISTNFPLLFDAVMSVAPLKVDIDWEEDAEAAAATAAYVEAESEQIDKAIAKFPLRVRMKLQALRPQWP

SEQ ID NO: 41889 - protein, 148 aa, Cicer arietinum
MSNFKSKYHDELIANAAYIGTPGKGILAADESTGTIGKRLASINVENVETNRRALRELLFTAPNVLQYLSGVILFEETLYQSTAAGKPFVDVLNEAGVLPGIKVDKGTVELAGTDGETTTQGLDGLGARCAKYYEAGARFAKWRAVLK

SEQ ID NO: 41890 - protein, 409 aa, Yarrowia lipolytica CLIB122
MIPQFLLLLWLTLVKGEVLYLDNETRLACANVNAGEDSVGPAKDTYIQFSFDELETPGVMALAIFEWRDYDRIGGVCDDAAIDNNKCEEHEYATFKVKPEETDNLYSRVFSFPLNLQSIQKFRYTVFKSGQYCAMVHPVIPNDDFAAKMSIKSAYGFLGGGEVGLLLLSRISIIYHFVTFSIWFYAYKKNSKHAVPVQKYLTKAMGLLVLKSVLVFVNLSMTNKYETAPELVATVASIVKPVADSLFLSLLIVMSLGYGTIVQSKSLKFYFLSWVVKGGWFCVAYFLLKPLNLPIDMSDFSPEALKITFYIPIMLGLVVTTRYLKKTNQSALARRSAMLTMALLALGIVYAGVYLTFKAHVQQNWTLFEYQWFLPACGELAAEMIYHLCFCVFWFPRPLQAAKEIDKEM

SEQ ID NO: 41891 - protein, 471 aa, Myxococcus xanthus DK 1622
MHHMPRTTGMNVAVVGGGISGLAVAHHLRSRGTDAVLLESSARLGGAVGTHALAGYLVEQGPNSFLDREPATRALAAALNLEGRIRAADPAAKRRYVYTRGRLRSVPASPPAFLASDILPLGARLRVAGELFSRRAPEGVDESLAAFGRRHLGHRATQVLLDAVQTGIYAGDVEQLSVAATFPMLVKMEREHRSLILGAIRAQKAQRQAALPAGTAPKLSGALSTFDGGLQVLIDALAASLGDAAHVGARVEGLAREDGGWRLIIEEHGRRAELSVAQVVLAAPAHATAKLLRPLDDALAALVAGIAYAPIAVVHLGFDAGTLPAPDGFGFLVPAEEQRRMLGAIHASTTFPFRAEGGRVLYSCMVGGARQPGLVEQDEDALAALAREELKALAGVTARPSFTRVFRWPLGIPQYNLGHLERVAAIDAALQRLPGLHLIGNAYKGVGLNDCIRNAAQLADALVAGNTSHAP

SEQ ID NO: 41892 - protein, 479 aa, Cryptococcus neoformans var. neoformans
MASRNPVVTRRAATRSRNDENAAPQQSVRTKPSISHLGPASKTAAVNVSVAAGKKPVAVKVGAKRTALGGVVVNGKEETEAGKKPLKASGKTVTEARQPLASRQNNAQPTRPIAAIPHRSKATPANVYAPVEAPAKLTVEEDMQMEIDARRSQPVSNAADFATVDEELLDDESEEDDMEEEDEEDWLRMSEEEMVKAQEQLDVVQATFKDDVDMFDTTMVAEYADEIFEHMERLEESVMPNPRYMDFQTEIEWTMRTTLIDWLLQVHLRYHMLPETLWIAVNIVDRFLSTRVVSLVKLQLVGVTAMFIAAKYEEILAPSVEEFVYMTENGYTKDEILKGERIILQTLDFTISSYCSPYSWVRRISKADDYDVQTRTLSKFLMEVTLLDHRFLRCKPSMIAAIGMYLARKMLGGDWNDAFIYYSNFTESQLITGASLLCERLIEPDFESVYVYKKYANKKFLRASTFARDWALTNAANSS

SEQ ID NO: 41893 - protein, 622 aa, Yarrowia lipolytica CLIB122
MEQENIDIPDELYPLALLMDELKHDEFSLRISAMKKLQLIAAALRQERCRDELIPFLEDVTQEDEDEVLTVLAEELANLVPYIGGPEYSHLLIPSLETLSCMEEPVVRDKAVESINRICEGLPSRDHVAQTILPLVKRLSSAEWFSSKVSATGLYAAAIRHCPTEAVPELLKQYGELTRDDTPMVRRAAATHLPAVIEALPAEADSPEADDEIYSMFKAQVGDDQDSVRLLSVNVLIAKAEKLKRQGNSQHTSSLIEFALALLHDPSWRVRYMCADRFEKLAESLTSVVPEEGVEKTEVDEMERAFVPEFIKFMQDGEAEVRTAVAKQVPGFCRLVTPANLDKIVANVEELSQDSSQHVRAALGSEISALAPLLGKEKTIETLLPTFLQMLKDDFPDVRLNIISKLHLVNKVIGIDLLSQSLLPAVSDLAQDKQWRVRLAIIEYIPLLATQLGVSFFDKELGPLCMTWLWDSVYSIREAATQNLKKLTKVFGVDWAKDEILPHIIVVAADSNYLYRLTALCAVTTLIPVVDESMIKTSILPFIAELINDPIPNIRFNVAKTYTELVRALHEEKISSPEVIEEICTSTVIPHLERLSTDGDVDVRYFSTKALEDIAEIKKAHA

SEQ ID NO: 41894 - protein, 534 aa, Cryptococcus neoformans var. neoformans
MPSGIPTRRVRLVDENAPPPPGAVVTRTRSRALASTTSTATNVKPTTTSIPMMKRQRSTISSENKIVDKSDVRRNALGEVRNGKGGEKEKESGKGKVVAIERKPLATTQAKAQRVTRSASAQPVMGVKDGDKKRKAVITSKIPSRSRSTGAEPAQVEVKPTIKTEEEPVRKRRKTSSPVVEVGEDGPTVDGKELLLSSGSKNATAFRSPKIKAKDDGWTDLDAEDEGDPTMVSEYVVEAFKYMMDIQGQTMPDPEYMDNQAELQWKMRQILMDWIIEVHSKFRLLPETLFIATNLVDRFLSKRVISLVKFQLVGLTALFIASKYEEVCCPGVEHFLHMSDGGYTVEELLKAERYMLSTLQFDMSYPNPLNFIRRISKADGYDIQSRTVAKYLVEISCVDHRLLGYTPSMLAAASMWLARLCLERGEWNANLVHYSTYSEDEIRPCAQVMLDRILDPDFDESTSFYKKYASKKHMKASVYVREWATQLWPASADGSAVERGTELELLKMFLEDEEEENNKGSKRRMKAVDEEEEY

SEQ ID NO: 41895 - protein, 259 aa, Prochlorococcus marinus str. NATL1A
MLAIHALTIFTLQAQFWSWLAFSGFIFLYWVTACLGVTTGYHRLLSHRSFQVPKWLERFFATCGALSCQHGPIDWVGLHRHHHTFSDTEADHHDSNKGFWWSHMGWMFEDVPAMKAVPRLSGDLIKDPYYRFLNKNFLLLQLPLGATLYLIGQSAGVGGWAMVLWGIPLRLVFVYHITWLVNSATHCWGTIAYESGDNSKNNKWVAALTFGEGWHNNHHAFPNSAKHGLQRKQIDLTWQHIRFLKAIGLAKKIRLPAAS

SEQ ID NO: 41896 - protein, 115 aa, Brassica napus
  misc_feature (67)..(67): Xaa can be any naturally occurring amino acid
  unsure (1)..(115): unsure at all Xaa locations
MSSGRYMAYSPSPSTTPHSPRIAGLRAPSAAVAEQEKYLAELLAERQKLGPFVPVIPHSVRLLNQEXPAYSWLGGSQGSSSGLIVKKTMKVDIPVDKYPTFNFVGRILGPRGNSL

SEQ ID NO: 41897 - protein, 412 aa, Mesorhizobium loti MAFF303099
MTEMARGMVIIGAGECGGRAALTLRDLGYDGPVTLVGDEPHLPYERPPLSKEAMASDAPEIKAIASDAVLAERSIRHIHSVQAAAIDRAAHSVRLSDGSVLPYDKLLLATGATPRKLSMPGLGARCVYLRTFADALAIRGHLRAGSRIAVIGGGFIGLELAAASRRLGAAVTVIEAQPRILMRGVPAEIAEIVHDAHIAEGVDIVCGQGIASIADDGRQVRVTLAGGREVSADLAIIGIGAVPVTGLAADAGLMIDNGIAVDAELCSSDPDIFAAGDCCSFPLAVYGGRRVRLEAWRNAQEQGALAAKNMLDAGEAHAAVPWFWSDQYGLSLQIAGLSDEGKNTVRRDLDDGAFILFHLAEDGTLVAASGIGPGNAVARDIRLAEMLIGKRAKPAPEALGSQAVKLKSLLAA

SEQ ID NO: 41898 - protein, 352 aa, Deinococcus radiodurans R1
MPKVITLPGDGIGPEVTAAAVQVLREVAPDVTVEEHAIGGGAYDAHGEPFPTSTRDALKEADAVLLGTVGGAHDSAWNQLPRHLRPESGLLALRKALGCYANLRPVRVQPGLEHLSPLKAELARGVDILIVRELLGGIYFDQDRKIEGDTAYNTMRYTTSEVERVAKVAFWAAEQRKGRVTSVDKANVLEVSELWRRDVQALRDRDYRSIHLNHEYVDSVAMLIVADPSRYDVILTENLFGDILSDLAAVIPGSLGLMPSASLGDGAGLFEPIHGSAPDIAGQGVANPAAAIMSVGMLLRHGLERSEAANQVDRAVALALREQPTRDLGGSADTQTFTRAVLKALGSSPSVG

SEQ ID NO: 41899 - protein, 520 aa, Medicago truncatula
MAMGIGEILSQLGSIAASLMFVYAMYEQFCPSDLRKFVENYKHKFTDLMSPYIQITFNESSGERLKQSETYTIIQTYLGANSSKRAKRLEAEVVEDSQSPLVLSMDDNEEIEDEFNGVKVWWSANSKAPRRKASSGRSFDVVRCFTLTFHKRHRDLITSSYIQHVLEQGKAIIFKNRRLKLYTNNGGCWWMSGWSHTNFAHPARFETLAMEPEKKEEIINDLVKFKKGKEYYAKVGKAWKRGYLLYGPPGTGKSTMISAIANFMNYDVYDLELTTVKDNNELKTLLIETSSKSVIVIEDIDCSLELTGQRKKKKEKDHTDKNENKEKTDKKSEEEDEDDDNDDEEEEEKRKSNVTLSGLLNSIDGIWSSCGGERIIIFTTNFVDKLDPALIRRGRMDKHIEMSYCRYQAFKVLAKNYLDVESHGDLFPIIEKLLGETNMSPADVAENLMPKSTTEDAESCLKNLIQYLEIAKEKEEEEAKKNGEKAQLVAGKDKQELAQNYRMNRWRRQVKNMRNFFGSC

SEQ ID NO: 41900 - protein, 314 aa, Triticum aestivum
MRSDGVVALYGNNKAVVEPSAKPAAATFSVKVGLAQMLRGGVIMDVVTAEQARLAEEAGACAVMALERVPADIRAQGGVARMSDPALIRDIKRAVTIPVMAKARIGHFVEAQILEAIGVDYVDESEVLTLADDAHHINKHNFRVPFVCGCRDLGEALRRIREGAAMIHTKGEAGTGNVVEAVRHVRSVMGAVRALRNMDEDEVFSYAKQIAAPYDLVMQTKQLGRLPVVQFAAGGVATPADAALMMQLGCDGVFVGSGIFKSGDPARRARAIVQAVTHYSDPEILANVSAGLGEAMVGINLSDPNVERFAARSQ

SEQ ID NO: 41901 - protein, 169 aa, Oryza sativa (japonica cultivar-group)
MAATADNGEKMILLISSDGERFELSEAAASQSKTLSHMIEDDCTDNGVPLPNVTAVVLVKVVEYFKKHAAVTPKPATEAVVADKAKREEELKSFDAEFVDVDRTMLFELILAANFLNAQDLLDLTCQHAADLIKDMSVEEVREVFNITNDFTPEEEAEVRKENAWAFDN

SEQ ID NO: 41902 - protein, 352 aa, Triticum aestivum
  misc_feature (256)..(256): Xaa can be any naturally occurring amino acid
  misc_feature (280)..(280): Xaa can be any naturally occurring amino acid
  unsure (1)..(352): unsure at all Xaa locations
MNSKLCISSSHQPWHGFHIHESATERVAPPRVHLIKKMSHPKVSIDEFISTLPQRKGWSQPLIQYKNFWFRGPPLEQILLAQHAFEPRADDIILATQPKCGTTWLKALAFTIVNRSRYSFDDHPLLTSHPQRVVPFIEIPGVGGGGADHHAHIETLSSPRLLATHMPMSLLPLDMSCRVVYVCRDPKDALVSRLHFENRITKGSNLSMESAFSMFCEGFSSYGPFWDHCLEYWKESLARPNNVLFLKYEEIKSDPXKFVRRLTKFLGVPLSREEERSGCXQEVVRLCSFEMLTSLQVNQVGGIDRGNKCYVGNSMFFRKGKVGDWRNHMSQEMGEKLDRIVREKLQGSGLAF

SEQ ID NO: 41903 - protein, 393 aa, Anthoceros formosae
MTMLAAKADPMTLSMGPHHPSMHGVLRLIVTLDGENVTDCEPILGYLHRGMEKIAENRTIVQYLPYVTRWDYLATMFTEAITVNAPEKLTNIQVPKRASYIRIIMLELSRIASHLLWLGPFMADIGAQTPFFYILREREMIYDLFEAATGMRMMHNFFRIGGVAVDLPYGWVDKCLDFCDYFSLKVDEYERLITYNSIFLKRVEGVGTISREEAINWGLSGLMLRASGVQWDLRKVDHYECYDELDWQVQSQTEGDSLARYLVRIGEMRESVKIIQQALKVIPGGPYENLEARRLNQGKDSEWNDFEYQFISKKPSPTFKLPKQEHYIRVEAPKGELGIYLIGDDSVFPWRWKIRPPGFINLQILPQLVKGMKLADIMTILGSIDIIMGEVDR

SEQ ID NO: 41904 - protein, 220 aa, Eucalyptus gunnii
MNPFSSHSHPNSCRFNFAEPPSDSRSATALGNFSHKEVLLASHHPKKRAGRKKFRETRHPVYRGVRLRDSGKWVCEVREPIKKSRIWLGTFPTVEMAARAHDVAALALRGRSACLNFADSAWRLPVPASADTKEIQKAAARAAEAFQSVESEDVMSGDEKKLRSEEGVFYDEEDIFGMPGLLADMAEGMLLSPPKWGGDIYGGEDEGNLGAHTSLWSYSI

SEQ ID NO: 41905 - protein, 427 aa, Xylella fastidiosa 9a5c
MSSPYKSSSHMAKETLLYAQSGGVTAVINATAAAVITEARSHRVKVLAARNGILGALREDLIDTSKESITAIRALTHTPGGAFGSCRFKLKSLEADHDKYERLLEVFKAHNVRWFLYNGGNDSADTALKVSQLAKTFDYPLHCIGVPKTIDNDLAITDASPGFGSAAKYTAVSICEAALDVAAMAETSTKVFIYEAMGRHAGWLAAAAGLAGQGQEEAPHIILLPERTYDETAFLAKVQQVVDGVGWCVVVASEGIRSNDGRFVADAGGTTDAFGHTQLGGVAAYLASRVKQTLGLKVHWTLPDYLQRSARHIASKTDWEQAQAVGKAAVRYALEGMNAVMPVIVRTSDTPYRWKIEPAALTKIANHEKTLPASFLRRDGFGISERARTYFEPLIRGETPMPYERNGLPRHVHLKNQSVPKQLPAWE

SEQ ID NO: 41906 - protein, 224 aa, Eucalyptus gunnii
MNSSSYISHPNSFSFDFAEPPFSLLLSHDRSAAPGNFSGEEVRLASDHPKKPAGRKKFRETRHPVYRGVRLRDSGKWVCEVREPRKKSRIWLGTFPTADMAARAHDVAALALRGQSACLNFADSAWRLPVPASPNTKDIQKAAAKAAEAFQLVESEDVMSGNEKKLHSEEGVLYDEEDIFGMPGLLANMAEGMLLSPPECSGDIYAGLDDGNLDAYTSLWSYSM

SEQ ID NO: 41907 - protein, 880 aa, Clostridium difficile 630
MGDLTMETKYVYSFGEGSKDMKSLLGGKGANLAEMTKIGLPVPPGFTITTEACNDYYVNNESIRAEIIKEIEEHLATLEKDLNKTLGCNKNPLLVSVRSGAVFSMPGMMDTILNLGLNDNSVVGLAEATQNERFAYDSYRRFIQMFSDVAMEVPKYKFENVLDRVKEAKGYTVDTELTTDDLKEIVKEFKAIYKKEIKNDFPQDPKEQLMLAIEAVFRSWNNPRAIVYRKLNDIAHNLGTAVNIQSMVFGNMGETSGTGVAFTRNPATGENKLFGEFLMNAQGEDVVAGIRTPQNISTLADVMPAVFDEFVKITHILEGHYKDMQDIEFTIENERLYILQTRNGKRTAAAAINVAVDLVEAGIIDEKEAIMRIEPNQLDQLLHPKFEDKALKEAKVIAKGLPASPGAASGKVYFNADDVVKANEKGEKVVLVRLETSPEDIEGMVKAEGILTARGGMTSHAAVVARGMGKCCVAGCGEIKVDEFNKEIRALDDVVIKEGEYISIDGSTGNVYLGDVKKTEVSLTGNFEKLMNWVDKHKCMMVRTNADNPRDARAAIEFGAEGIGLCRTEHMFFDEARLPAVREMILSNTVEQREKALEKILPMQREDFVELFKVMDGKPVNIRLLDPPLHEFLPHDDETIEELSKSMGIKVSDIKKRIVDLDEFNPMLGHRGCRLAITYPEICVMQSKAIIQGAIEAIKAGVKVSPEIMVPLVGEVNELKIIRKMIVETVDAIIKEEGIEVPYTVGTMIEIPRACLTADEIAQEADFFSFGTNDLTQMVFGYSRDDAGKFLGQYVDEEILEKDPFQVLDQNGVGKLVKMGAKLGREVKPELKLGICGEHGGEPSSVEFCYSVGLNYVSCSPFRVPIARLAAAQASIKNPR

SEQ ID NO: 41908 - protein, 284 aa, Zea mays
MAAAASTMSLLPISQPRKQQQQGAGAVVVFQRRPWDARRRRYVVPTARLFGPAIFEASKLKVLFLGVDEGEGSSKHLHAHHPAPAPALLPRTYTLTHSDVTASLTLAVSHTINRAQLQGWYNRLQRDEVVAEWKKVRGRMSLHVHCHISGGHLLLDLIAGLRYYIFRKELPVVLEAFVHGDGDLFSRHPELEEATVWVYFHSNLARFNRVECWGPLRDAAAPAPAEDDSTAPAAASIAMEGQMPVGEWPHRCPQQCDCCFPPHSLIPWPNEQDMAAAAGQVRQQ

SEQ ID NO: 41909 - protein, 229 aa, Yarrowia lipolytica CLIB122
MLSLVRPAVTRSILRGAPGSMRLLSSTARLHAPATDSAINIYAGGSAAAAPPAGFRIHRPATWEESEEGALSKATKYFLLAEMFRGLYVVLEQFFRAPYTIYYPFEKGPVSPRFRGEHALRRYPSGEERCIACKLCEAICPALAITIDAEERIDGSRRTTKYDIDMTKCIYCGYCQESCPVDAIVETPNVEYATETREELLYNKEKLLANGDKWELELQYALDADAPYR

SEQ ID NO: 41910 - protein, 199 aa, Mesorhizobium loti MAFF303099
MAPRSAEASRKTKETDISVSVHVDGSGKSDIATGVGFFDHMLDQLSRHSLIDMTVRAKGDLHIDDHHTVEDTGIALGQALTKALGERRGIMRYASIDLAMDETLTRAAIDVSGRPFLVWNVSFSSPKIGTFDTELVREFFQALAQNAGITLHVTNHYGANNHHIAETCFKAVARALRAALEPDPRQPDAVPSTKGSLKG

SEQ ID NO: 41911 - protein, 491 aa, Medicago truncatula
MAIPGSGAKNLIAIFASVRNRASSKIKTTLCPLNVQITFYESSDERLKQSETYTIIQTYLGANSSQRAKRLKAEVVEDSQSPLVLSMDDKEEIEDEFNGVKVWWSSNSKAPTRKASSGRPNFDVVRYLTLTFHKRHRDLITSSYIQHVLDQGKAVIFKNRRLKLYTNNSGCWWMSGWSHTNFAHPARFETLAMEPEKKEEIINDLVKFKKGKEYYAKVGKAWKRGYLLYGPPGTGKSTMISAIANFMNYDVYDLELTTVKDNNELKTLLIETSSKSVIVIEDIDCSLELTGQRKKKKEKDRNDKNENKEKTDKKSEEEDEDDDDDDEEEEEKRKSNVTLSGLLNSIDGIWSSCGGERIIIFTTNFVDKLDPALIRRGRMDKHIEMSYCRYQAFKVLAKNYLDVESHGDLFPIIEKLLGETNMSPADVAENLMPKSTTEDVEACLKNLIQYLEIAKEKEEEEAKKKGEKAQLVAGKDKQELAQDCRMNRWRR

SEQ ID NO: 41912 - protein, 850 aa, Bacillus cereus G9241
MIKRLINKSVLLLTIIVMFASVFSIQSVKAVSNSKTTEVIIHYKEQLGNTKDWNLWLWGENANGTSYEFTGEDEFGKYAKINIDGDYNRVGFIIRTNEWEKDGGDRWIENIKDGRAEVWILSGDEKVYNAKPSSDLSIQKATIDSFNEITVTTNVPFHIKEQKIEIEGIKIKNISPYDINSGNVTNKVKIITEQKIDLKQTYKVKIENLADTNTEIGKVIRSEEFDHSFYYGGNDLGNIYTPQHTKFRVWAPTASEAKLVTYKKWNDKIGTEINMQQGEKGTWKAELKGNQEGLYYTYKVKIGDKWTEAVDPYARAASVNGDKGAVVDLEETNPKKWNTNKKPKLKNPEDAIIYELHVRDLSIQPESGIKQKGKYLGVTEKGTRGPEGVKTGLDHMKDLGVTHVQLLPIFDYASVNEENVNEPQYNWGYDPKNFNVPEGSYSTNPYEPTVRITELKQMIQTLHDNNLRVVMDVVYNHMYNATESNFHKLVPGYYYRYNEDGTFANGTGVGNDTASERKMMRKFMIDSITYWAKEYNLDGFRFDLMGIHDYETMNEIRKAVNQIDPSIILHGEGWDLNTPLAAELKANQKNAEKMKGIAHFNDNIRDGLKGSVFEEKENGFVNGKANMEDRIKKGITAGINYDKNTSTYQDPEQVLTYVEAHDNHTLWDKLELTNPSDSEEVRKQMHKLSSSILLTSQGIPFLHAGQEFMRTKYGDHNSYKSPDSINQMDWLRRATFNNEVDYMKGLIELRKKYSAFRMTSAEQIKTHISFIDAPKNTVAYTIEGNKNEYFTVAHNANREAVEITLPSKGPWKVLVDGKQAGSKPLSVVHDNKIKVPALSSFVLKTEKPIK

SEQ ID NO: 41913 - protein, 317 aa, Burkholderia xenovorans LB400
MEPELKALIEQLSQAGRRPFWQCTVDDARNAPTLVKRLFPDAPSVERTQDIRISSTRGHAFPARLYVPRDRPCGLIVYLHGGGWVVGSVDDYHPLTATITARSGFAVLSVDYRLAPEHAFPIPLEDARAALEWASSGSAAVAIGADVNCLIVMGDSAGANLATVAARLHNEKNIDRRVDGQVLVYPVTGHDFKTASYDEFAEGNLLTRNDMQWFWDHYCPERAARANPLASPLEAEDLSMSPPALVMTAGRDPLRDEGEAYGARLRKAGVDVAVVRCDGLVHGFLAMIHQVPGAARAFDRIVDYITRLGEAVPEARR

SEQ ID NO: 41914 - protein, 479 aa, Medicago truncatula
MYEQFCPSDLHKFVEKHMNKFTDLMSPYVEITFYESSGERLKQSETYTIIQTYLGANSSQRAKRLKAEVVEDSQSPLVLSMDDKEEIEDEFNGVKVWWSSNSKAPTRKASSGRPNFDVVRYLTLTFHKRHRDLITSSYIQHVLEQGKAIIFKNRRLKLYTNNSGCWWMSGWSHTNFAHPARFETLAMEPEKKEEIINDLVKFKKGKEYYAKVGKAWKRGYLLYGPPGTGKSTMISAIANFMNYDVYDLELTTVKDNNELKRLLIETSSKSVIVIEDIDCSLELTGQRKKKKEKDRNDKNEKKDKTDKKSEEEEEEDDDDDDDDEEEEKRKSKVTLSGLLNSIDGIWSSCGGERIIIFTTNFVDKLDPALIRRGRMDKHIEMSYCSYQAFKVLAKNYLDVESHGDLFPIIEKLLGETNMSPADVAENLMPKSTTEDVEACLKNLIQYLEIAKEKEEEEAKKKGEKAQLVAGKDKQELALD

SEQ ID NO: 41915 - protein, 518 aa, Medicago truncatula
MGIREIWSNLGSIMASIMFVYAMYEKFFPPALRRYLRKYTHKFTNFMYPYIKITFYEKSGDNLKHNKTYTTIQTYLSANSSQRARRLKAEVIKDSQNPLVLSMDDNQEITDEFNGVKVWWSANHITSRTQSFSIYPSSDEKRFLTLTFHKRHRELITTSYIQHVLEQGKAITMKNRQLKIYTNNPSNDWFRYRSTKWSHTTFEHPASFETLALEPKKKEEILNDLVKFKKGKEYYAKVGKAWKRGYLLFGPPGTGKSTMISAIANFMNYDVYDLELTIVKDNNELKRLLIETSSKSIIVIEDIDCSLDLTGQRKKKKEKDDVENDEKKDPIKKAEKEEKNESKVTLSGLLNFIDGIWSACGSERIIIFTTNFVDKLDPALIRRGRMDKHIEMSYCSYQAFKVLARNYLDVEFHDDLFPIIEKLLEETNMTPADVAENLMPKSITEDFESCLKNLIQSLEIAKKKDEEEAKKKIEDEEVKLKAEKEKLELAQEEEKVKADEKLEENVKENGVKENGVIH

SEQ ID NO: 41916 - protein, 461 aa, Oryza sativa
  misc_feature (345)..(345): Xaa can be any naturally occurring amino acid
  unsure (1)..(461): unsure at all Xaa locations
MGRKIKVKKKKASSKVWQPGVDTLEEGEELQFDPQAYNYLRGFNIGWPCLSFDVVRDQLGLVRSEFPHTLYGVAGTQAERATWNYIGIFKICNINGKKREPIPASAIDGDSDMDSESSSDEEDEAVNEDTMPILHLKKVAHAGCVNRIRSMNQEPHICATWGDTGHVQVLIFDSRGTESKLYQRLEWTCEVWDFSSFLNSLAESGAVAHNEDDRIHNHVPVKIFGSHKDEGYAIDWSPLVTGRLVSGDCNKCIHLWEPTSNSWNVDTNPFWSPTEADIFASCSADRTISIWDIRTGKKPCISVRAHNADVNVISWNRLASCMIASGCDDGSFSIRDLRLIKDDSXVAHFEYHKHPITSVEWSPHEPSTLAVSSADHQLTIWDLSLEKDAEEEAEFRARMREQADAPEDLPPQLLFVHQGQKDLKELHWHPQIPSMIISTAADGYNMLMPSNIDTTIREADA

SEQ ID NO: 41917 - protein, 505 aa, Medicago truncatula
MASIMFVYAMFDKFFPPNLRVYFLKYTNKFTNYMYPYIHIKFHELSGERLKQSETYKIIQTYLSDNSSQRARRLKAEVVKDSQNPLVLSMDDNEEIIDEFNGVKVWWTANYTTSKSQSFSYYPTSDEKRFLTLTFHKKHREVITTSYIQHVLDEGKSIMSKNRQLKLYTNNPSSNWWGYRSKKWNHTTFEHPARFGTLAMEPEKKQEILNDLLKFKKGKEYYAKVGKAWKRGYLLYGPPGTGKSTMISAIANYMNYDVYDLELTTVKDNNELKRLLIETSSKSIIVIEDIDCSLDLTGQRKKKKKKDDDENDEMKDPIKKAEEEEKNESKVTLSGLLNFIDGIWSACGSERIIIFTTNFVDKLDPALIRRGRMDKHIEMSYCSYQAFKVLARNYLDVETHDDLFPIIEKLLGETNMTPADVAENLMPKSITEDFESCLKNLIQSLEIAKKKDEEEAKKKIEDEEAKLKAQKEKQELIQEEEKVKVDEKLEEKVKENGVKENGVIH

SEQ ID NO: 41918 - protein, 275 aa, Medicago truncatula
MDPNKKEEIINDLVKFKTGKEYYTKVGKAWKRGYLLFGPPGTGKSTMISAIANFMNYDVYDLELTTIKNNNELKRLLIETSSKSIIVIEDIDCSLDLTGQRKKKEEKPKYEKESMVTLSGLLNFIDGIWSACGGERIIIFTTNFVDKLDPALIRRGRMDKHIEMSYCSYQAFKVLAKNYWDVESHDDLFPIIEKLLEKTNMTPADVAENLMPKSIDEDFETCLKSLIQSLENAKKKDEEEAKKKIEDEEAKLKAEKEKQELTQEEEKVKENGVIY

SEQ ID NO: 41919 - protein, 918 aa, Arabidopsis thaliana
  misc_feature (22)..(22): Xaa can be any naturally occurring amino acid
  unsure (1)..(918): unsure at all Xaa locations
MLSSIGCNMFVPSTFCSVSSYXEFVSIDCGCSSNYTDPRTGLGWVSDSEIIKQGKPVTLANTNWNSMQYRRRRDFPTDNKKYCYRLSTKERRRYIVRTTFLYGGLGSEEAYPKFQLYLDATKWATVTIQEVSRVYVEELIVRATSSYVDVCVCCAITGSPFMSTLELRPLNLSMYATDYEDNFFLKVAARVNFGAPNMDALRYPDDPYDRIWESDINKRPNYLVGVAPGTTRINTSKTINTLTREYPPMKVMQTAVVGTQGLISYRLNLEDFPANARAYAYFAEIEELGANETRKFKLVQPYFPDYSNAVVNIAENANGSYTLYEPSYMNVTLDFVLTFSFGKTKDSTQGPLLNAIEISKYLPISVKTDRSDVSVLDAIRSMSPDSDWASEGGDPCIPVLWSWVNCSSTSPPRVTKIALSRKNLRVNLFFDRWLDDNELTGTLPDMSKLVNLKIMHLENNQLSGSLPPYLAHLPNLQELSIENNSFKGKIPSALLKGKVLFKYNNNPELQNEAQRKHFWQILGISIAAVAILLLLVGGSLVLLCALRKTKRADKGDSTETKKKGLVAYSAVRGGHLLDEGVAYFISLPVLEEATDNFSKKVGRGSFGSVYYGRMKDGKEVAVKITADPSSHLNRQFVTEVALLSRIHHRNLVPLIGYCEEADRRILVYEYMHNGSLGDHLHGSSDYKPLDWLTRLQIAQDAAKGLEYLHTGCNPSIIHRDVKSSNILLDINMRAKVSDFGLSRQTEEDLTHVSSVAKGTVGYLDPEYYASQQLTEKSDVYSFGVVLFELLSGKKPVSAEDFGPELNIVHWARSLIRKGDVCGIIDPCIASNVKIESVWRVAEVANQCVEQRGHNRPRMQEVIVAIQDAIRIERGNENGLKSSSSSSSKAQSSRKTLLTSFLELESPDISRNSLAPAAR

SEQ ID NO: 41920 - protein, 525 aa, Oryza sativa (indica cultivar-group)
MAEVKPEDMVHHPPMDQLQGFEYCIDSNPSWGEAIALGFQHYILSLGTAVMIPTMLVPLMGGNDHDKARVVQTLLFVTGIKTLLQTLFGTRLPTIIGGSYAFVVPILSIIRDPSLAQIADGHTRFVQTMRAIQGSLIVSSSIQIILGYSQLWAICSRFFSPLGMVPVVALVGLGLFERGFPVIGRCVEIGLPMLILFVALSQYLKHVNVRHVPVLERFSLLICVALVWVYAHILTASGAYKHTALLTQFSCRTDRANLISSALWISIPFPLQWGAPTFSANHAFGMMAAVVVSLIETTGAFMAAARLASATPPPAYVLSRGIGWQGIGTLLDGLFGTGTGSTVSVENVGLLGSTRVGSRRVIQISAGFMIFFSMLGKFGALFASIPFPIFAAIYCVMFGIVAAVGLSFLQFTNMNSMRNLFIVGVSLFLGLSIPEYFSRYTTSAQQGPAHTKAGWFNDYINSVFSSPPTVALIMAVLLDNTLDVREAARDRGMPWWARFRTFRGDSRNEEFYTLPFNLNRFFPPS

SEQ ID NO: 41921 - protein, 400 aa, Nostoc punctiforme PCC 73102
MSKKSLASLSSADISGKRALVRVDFNVPVDDQGKITDDTRIRAALPTIQDLTQKGAKVILASHFGRPKGVDDKLRLTPVAKRLSELLGQEVIKTDDSIGDEVAAKVAALQNGQVLLLENVRFYPEEEKNDAEFAKKLAANADFYVNDAFGTAHRAHASTEGVTKFLSPSVAGYLVEKELQYLQNAIENPQRPLAAIIGGSKVSSKIGVIETLLEKCDKLIIGGGMIFTFYKARGLSVGKSLVEEDKLELAKSLEAKAKERGVALLLPTDVVLADNFAPDANSQTVSIENIPDGWMGLDIGPDSVKFFQEALADTKTVIWNGPMGVFEFDKFAAGTEAIAHTLAEIGKTGTTTIIGGGDSVAAVEKVGLADQMSHISTGGGASLELLEGKVLPGIAALDDA

SEQ ID NO: 41922 - protein, 533 aa, Oryza sativa (indica cultivar-group)
MAGGFGGGGGEAIAGRAEQYEGKITGYFILACIVGSFGGSLFGYDLGVSSGVTAMDDFLIKFFPEVYARKSAHLHETDYCKYDNQVLTLFTSSLYFAGLVSTFAASHLTRRRGRRATIMVGAVSFFLGGAVNAAAANVAMLIAGRLLLGVGIGFGNQAVPLYLSEIAPYNIRGAVNQLFQLTTCLGILVADVINYFTDKIHPWGWRLSLGLAMGPATAIFVGALFLPETPNSLVEMGRLEEARRVLEKVRGTRKVDAEFEDLKEASEAARAVRGTFRSLLAARNRPQLIIGALGIPAFQQLSGMNSILFYSPVIFQSLGFGNSAALYSSIITGSMLVVGALVSMVVVDRLGRRFLFIEAGIQMISSMVVVAVILALKFGHGEELSKGVGTVLVVAICLFVVAYGWSWGPLGWLVPSELFPLEMRSAGQSVVVCVNLFWTAAVAQCFLAAMCHLRWGVFILFAALIVVMSIFVILLLPETKQVPIEEIWMLFDKHWYWKRIVRKDPKYQGHHHHQMAAMPTAAAAAAKSGSSEV

SEQ ID NO: 41923 - protein, 1069 aa, Chromobacterium violaceum ATCC 12472
MPKRTDIKSILIIGAGPIVIGQACEFDYSGAQACKALREEGYKVILVNSNPATIMTDPDMADVTYIEPISWPVVEKIIAKERPDAILPTMGGQTALNCALDLARNGVLEKYKVELIGATEDAIDKAEDRGRFKEAMAKIGLSCPLSFVCHTMEESLEAQAKVGFPTLIRPSFTMGGSGGGIAYNKEEFLAICERGFEASPTHELLIEQSVLGWKEYEMEVVRDKNDNCIIICSIENFDPMGVHTGDSITVAPAQTLTDKEYQIMRNASLAVLREIGVDTGGSNVQFATNPATGEMIVIEMNPRVSRSSALASKATGFPIAKIAAKLAVGFTLDELKNDITGGATPASFEPSIDYVVTKIPRFAFEKFPQADDRLTTQMKSVGEVMAMGRTLQESMQKALRGLETGLAGFDPVTTDEAAIRHELGAPGPERILYVADAFRIGMSRDDIHAVSKIDPWFLAQIEDIVGEETALSGRKIEDMDYAELRRLKRKGFSDRRLGELLGTDQAAVRAKRWALGLHPVYKRVDTCAAEFATNTAYMYSSYEEECESNPSDRKKVMVLGGGPNRIGQGIEFDYCCVHAALSLRESGFETIMVNCNPETVSTDYDTSDRLYFEPLTLEDVLEICRVEKPFGVIVQYGGQTPLKLARALEANGVPIIGTTPDMIDAAEDRERFQKLLNELGLKQPPNRTARAPAEAMKLADEIGYPLVVRPSYVLGGRAMEIVHEPADLERYMREAVKVSNDSPVLLDRFLNDAIEVDVDCVSDGEQVVIGGIMQHVEQAGVHSGDSACSLPPYSLFPALQDEIRRQTEAMARALNVVGLMNVQFAIQGDTIYVLEVNPRASRTVPFVSKVTSAPLAKIAARAMAGISLAEQGFTKEVIPPFYAVKEAVFPFIKFPGVDTILGPEMKSTGEVMGVGKTFAEAYVKAQLGAGDRLPKTGKVFLSVRDGDKNGAVDVARELQRLGFGVCCTRGTAKHLTEAGLIVQVVNKVNEGRPHIVDMIKNGEIDLVINTVDEKRTAIQDSHSIRRSALQARVPQYTTLSAAKAVCVGMKHAESFDVYSVQQLHAQIAG

SEQ ID NO: 41924 - protein, 361 aa, Sinorhizobium meliloti
MKALVENLKATARETDATDIRAAFAADPNRFSRFSTAFDDLLFDYSKCAVNDRIIDGLEALAKAAKVEEKRDAMFRGDIINITEERAVLHTALRNRSNRPVLVDGKDVMPDVNAVLEAMGKFADDIRSGALKGATGKKITDVVNIGIGGSDLGPVMATLALAPFHDGPRLHFVSNVDGAHIADTLTLLDPETSLFIVASKTFTTIETMTNAATARAFIAGKLGEAAVGHHFAAVSTALDKVGAFGIDAARVFGFWDWVGGRYSIWSAIGLPLMIAIGKENFGRFLDGGHAIDEHFRSAPLRQNIPMLLGLIGFYNRNVLGYPSRAILPYDQRLTRFPAYLQQLDMESNGKGVTLDSQPVEF

SEQ ID NO: 41925 - protein, 140 aa, Brassica napus
  misc_feature (11)..(12): Xaa can be any naturally occurring amino acid
  misc_feature (28)..(28): Xaa can be any naturally occurring amino acid
  misc_feature (32)..(32): Xaa can be any naturally occurring amino acid
  misc_feature (35)..(35): Xaa can be any naturally occurring amino acid
  misc_feature (39)..(39): Xaa can be any naturally occurring amino acid
  misc_feature (46)..(47): Xaa can be any naturally occurring amino acid
  misc_feature (52)..(52): Xaa can be any naturally occurring amino acid
  misc_feature (54)..(54): Xaa can be any naturally occurring amino acid
  misc_feature (58)..(60): Xaa can be any naturally occurring amino acid
  misc_feature (64)..(64): Xaa can be any naturally occurring amino acid
  misc_feature (72)..(72): Xaa can be any naturally occurring amino acid
  misc_feature (75)..(75): Xaa can be any naturally occurring amino acid
  misc_feature (78)..(78): Xaa can be any naturally occurring amino acid
  misc_feature (81)..(82): Xaa can be any naturally occurring amino acid
  misc_feature (85)..(85): Xaa can be any naturally occurring amino acid
  misc_feature (87)..(87): Xaa can be any naturally occurring amino acid
  misc_feature (90)..(91): Xaa can be any naturally occurring amino acid
  misc_feature (93)..(93): Xaa can be any naturally occurring amino acid
  misc_feature (97)..(98): Xaa can be any naturally occurring amino acid
  misc_feature (102)..(102): Xaa can be any naturally occurring amino acid
  misc_feature (105)..(105): Xaa can be any naturally occurring amino acid
  misc_feature (107)..(109): Xaa can be any naturally occurring amino acid
  misc_feature (111)..(111): Xaa can be any naturally occurring amino acid
  misc_feature (113)..(113): Xaa can be any naturally occurring amino acid
  unsure (1)..(140): unsure at all Xaa locations
MASSMLSSAAXXTSPAQGTMVAPFTGLXSSAXFPXTRKXNNDITFXXSNGRXVXCMKXXXPVGXKKIENLSXLSXLTXMNXXKGXDXPFXXKXVSCXXIQMXHGXFXXXGXGXTPPILIGVLKGNFLGRADGGQKGKTKF

SEQ ID NO: 41926 - protein, 288 aa, Prochlorococcus marinus str. NATL1A
MNYKLKTRSGWLDEYHQGVRYGLEGKLILEESSPFQKITIYESKRYGKALLLDDCWMTAEKSEKCYHECLIHPALCCSTRIDNILIIGGGDGGSARECLKYKEVKSIDLVEIDLRVIELSQKYLPTIGGNAWSDSRLNLQIKNGIDWVKHTKENSYDVIIIDGADPIGPSKELFSNSFLKDCKRILKPGGVLATQSESPESFQEIHINIVKILREIFDYADPMYGSVSIYPSGLWSWAFASMENPKYIYPKKSRVKEISENCQVWSERWQQGAFNTIPAFIERELAKI

SEQ ID NO: 41927 - protein, 496 aa, Burkholderia xenovorans LB400
MGHMNETPALPAWLDGSPKLLLIDGQPTPARSGRTFETINPTTGKALAQIAEADEKDIDLAVAAARRALDGPWGRFKPFDRQAVLLKLADLVETHFDELALLDTLDMGGPIRSTGAKRTRAIGLLRFYAGLATSIHGSTIDNSQAGEVISYTVKEPVGVVAAINPWNGPLGLAIWKIAPALAAGCTVVLKPAEQAPLSPLRFGELCLEAGIPQGVVNVVTGFAGAGAALAAHPGVDKVAFTGSTEVGQHIIRASAGNIKRVSLELGGKSPNIVFADANLDAAVPGAAMAVFANSGQICSAGTRLFVQRSIHEEFVERLSSFAKTLRVGNPLDPDTQLGPLVSEAQLKRVTSYLDKGREEGARAVAGGTRLQNDELKNGYFVEPTVFDGVKDDMAIAREEIFGPVISVLPFDTAEEAVQRGNDTEYGLGSGVWTRDIGNAHRVARGLRAGSVWVNCYQVMDPAVPFGGYKMSGYGRESGVEHMEEFLQTKAIWIKTD

SEQ ID NO: 41928 - protein, 388 aa, Mesorhizobium loti MAFF303099
MAGTFIIAQGGGPTAVINQTVVGATLEIRKRHPGAKVLGSIHGVRGIRDGNYVDLSAIPEDRLRLIAGTPSAALGSTRDKPDAAYCDVILKGLKKAGADAFIYIGGNDTSGTQQILTDAAGGSIAFVHAPKTIDNDLEENDHTPGFISAAEFVAGAFLSVDLDFRALPGIYVGIVMGRHAGFLTAAAAAWQLDPDSGPHLVYVPERPFSAAGFIDDVRATLDRHKRCIVAVSEGVSTADGKALVESLVPPEKLERDAHGNVKLSGSDLPAALERALAEGLPGKRARVDALGYMPRGYVGAISAVDAQEAFDAGAFAVSVAEQGGGSVALQYDGTKTVLKKVPLKNVAGKTRHMPDDFMKPDVNQLSEAGMAYLKRLVPEKYKVGKPFV

SEQ ID NO: 41929 - protein, 302 aa, Alteromonadales bacterium TW-7
MYTNERVITSEQSNASVGDVVLSPIKVLWVGGMLLTAVLGGWYTFSISALLVFIATTSIILCLGHSLGMHRRLIHKSYKCPLWLEYFFVHLGVVVGLAGPIGMIKTHDMRDWAQRQPECHDYFGHKQPMWKDFCWQLFYDIRLNNSPTFNIETKVIESRVYSWMDKTWMLQQLPLAFLLLLLGGISWVIWGICVRVSISIIGHWLIGYLAHNIGQRHWHVNQACIQGYNVPFAALLTMGESYHNNHHAFPGSANFALEKGQLDVGWLVLKKLEKLGLVWDLIQPENLPVRSELKRIDSQYEN

SEQ ID NO: 41930 - protein, 255 aa, Brucella suis 1330
MSYESPFHLNDAVAIVTGAAAGIGRAIAGTFAKAGASVVVTDLKSEGAEAVAAAIRQAGGKAIGLECNVTDEQHREAVIKAALDQFGKITVLVNNAGGGGPKPFDMPMSDFEWAFKLNLFSLFRLSQLAAPHMQKAGGGAILNISSMAGENTNVRMASYGSSKAAVNHLTRNIAFDVGPMGIRVNAIAPGAIKTDALATVLTPEIERAMLKHTPLGRLGEAQDIANAALFLCSPAAAWISGQVLTVSGGGVQELD

SEQ ID NO: 41931 - protein, 374 aa, Prunus webbii
MTFTLRKKEILIDILLRLPAKSLVRFLCTRKSWNDLIGSSSFVSTHLNRNVTNHAHVYLLCLHHPNVRRQFNPDDPYVKQECQWSIFSNETFEECSKLSHPLGSTEHYVIYGSSNGLVCMSDEILNFDSPIHIWNPSVRKLRTPPISTNINLKFSHISLQFGFHPGVNDYKAVRMMRTNKTAVAVEVYSLRTDSWKMIEAIPPWLKCTWLHYKGTFLNGVAYHIIEKGPIFSIMSFDSGTEEFEEVIAPDAICSSWGLCIGVYKEQICLLSGFYGCEDEGMDKIDLWVLQAKRWKQLCSVVFPLGDCERIIGISKGTELLMEKKDFNKGVGELYLCNYESKQFLETGIRLAVVKYDEIEFLFVITYIESLVLLN

SEQ ID NO: 41932 - protein, 710 aa, Coprinopsis cinerea okayama7#130
MAWRCSGATNKELIANLKSGGIFHSDRVMKAMAAVDRGNYVRDKSDAYKDSPQPIGHGATISAPHMHAYASEHLLPYLRPGARVLDIGSGSGYLAAVLHHLVSPGGKVVGIEHIPELAEWSIGNLKRDGLGEALDKGEIVIVAGDGREGWKDGGPYDAIHVGAAAPTVPPALLEQLASPGRMFIPVGSWDQYIEHIDKDDKGHVTKQKVMGVRVPEKLLHNGSPDFKLDPEGNENIWPLNLNRRGMGFYEKQLSILGALCLLGLGLDQRLSKSKQDSGGERSDGGQASPSVVASLARKYLVVYGIVMGADWLQGPYVYSLYHEQYEIPERTVAVLFVTGFLSAGLAAPFVGAWADQHGRKRLCLAFCVTYTLACLLITLPALPILFLGRIVGGISTSILFSAFESWLVSSASSMKISSGDLSSIMGRASLVNGLVATTAGVISQWLVERTSAKFVAPFLTSAGLLVVAWVLIRGLWGENYGGSGTVAGRGSVDLFQLRKLGEAWHVVRTDPLLLTLGLTQTCFEGSMYLFVFVWVPSLQETTPSSTLPLGLIFSSFMVSMMLGSLLYTAIVSFSSRSKTDPTSTPGSDSSLGVHAKLSSLVCAFGALALAMSVSSRAEHIRFWAFCLFEACVGMYYPVQGMLRGSFISNDHRATVSSLFRIPLNIFVVVSLLSGVSSARRAVMTANLRGVRAREWEWEGGGVERDLETIF

SEQ ID NO: 41933 - protein, 156 aa, Zea mays
LAIAHRFDTDLIKKVSTNCPVMQNHRYGISPRRYRENDALSSFFKILTTSPDENGKVYVSTVQANNYPITCTQWRPEKAIFEWRKPMIPHSEDAVQLAKNGVHVYLAHPSLSRNSQARKSPNRPPADKVLDNLIYNYSPTFTGKKSKSFEEVYIFS

SEQ ID NO: 41934 - protein, 261 aa, Triticum aestivum
MSTAEATREENVYMAKLAEQAERYEEMVEFMEKVAKTADVGELTVEERNLLSVAYKNVIGARRASWRIISSIEQKEESRGNEAYVASIKEYRTRIETELNKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 41935 - protein, 368 aa, Prunus webbii
INNPTFVENHLSNSMQSKLSTCVLFSRFDQSDANSDEKELAFSFLYLRNDYDDDEHNVNFVVEDIKFPLSSGRFIGLEDVESPSILGHCNGIVCLSPCSDNLVLCNPAIKEIKLLPKSGLPDWWGCAVGFGYDPKSKDYKVSRIASYQADIYGDGLIYPPRVEIYTLSTDSWREIRNNSLETDTTCFFPDYFQMYFQGICYWVGYEQPKQSVEYEDEEQKPMVLFFDTGDEIFHNLLFPDSFYMYEEGSSYAYEMSYLMYCDLRIILWNGSIALFGFNRFSVFPDSYGVWVLDDFDGAKGSWTKHLTFEPLMGSKKVLEFWRSDEILMVTEDGDIVSYNLATEKLKNLPMNSPSDFETIVYVNSLVPI

SEQ ID NO: 41936 - protein, 569 aa, Xylella fastidiosa 9a5c
MSQTRPWLQHYPSGISTEIDTDAFRTIADVFDTSVIKYRHCPAYTNFGKTLTYGEVDLLTKQFASYLLNVLKLKKGDRIALMMLNCLQYPVATFGALCAGLTVVNVNPLYTARELKHQLVDAGSTVLVVMDNFCTTVQQIIADTPIKQVITTELGDLLDFPKRSLINFAVKHIKKLVPEYQLPRSIRFREALALGSKHSMPPIHIASDDLAFLQYTGGTTGTPKGAMLTHRNMVANMQQVSQWLQTSNSLKEGCETVLTALPLYHIFALTANSLVFMKIGGCNHLISNPRNMRTFVKELQRVRFTVITGVNTLFNKLLNTPGFDKLDFSSLKIALGGGMVIQRSVAEQWKQVTHVPLIEAYGLTEASPEACINPLNLQEHNGSIGMPIPSTDVCIKDDTNTALPIGEMGELCIKGPQVMKGYWQRPEETSEVLDADGWLHTGDIVKMDKQGFLYIIDRKKEIILVSGFNVYPKEIEEVIAMIPGVAEVAAVGVPDEQSGEVVKVVIVKKDPMLTAEEVKAHAATNLTRYKLPRIIEFRATLPKTDVGKILRRELRDAAPASTTFTAQPK

SEQ ID NO: 41937 - protein, 291 aa, Glycine max
  misc_feature (187)..(187): Xaa can be any naturally occurring amino acid
  misc_feature (224)..(224): Xaa can be any naturally occurring amino acid
  unsure (1)..(291): unsure at all Xaa locations
MLPYHTLEGAQVALGRGLTLAETIWFKYSANKPDFVLHCHNTLFLCLFYSIAPIPFVLMELSGYEKLNKHKIQPSVKRSFKEMFKCYKDVMETFVIAVSPLQIISYPTIKWIGIRTGLSLPSGWELFWQLFIYFVIEDFSNYWIHRMLHCKWAFEKIHKVHHEYVAPIGLSAPYAHWAEIIILGIPXFLGPALVPGHITTYWLWFILRQLEAIETHSGYDFPWXPTKYIPFYGGPASHDFHHYVGGKSQSNFASVFTYCDYIYGTHKGYQYRKQMRKKNSTDTFIAQNYKM

SEQ ID NO: 41938 - protein, 459 aa, Pseudomonas putida GB-1
MNPTLQTTLLIIGGGPGGYVAAIRAGQLGIPTVLVEGQALGGTCLNIGCIPSKALIHVAEQFHQASRFTEPSPLGISVASPRLDIGQSVAWKDGIVDRLTSGVAALLKKHGVKVVHGWAKVLDGKQVEVDGQRIQCEHLLLATGSSSVELPMLPLGGPVISSTEALAPKALPQHLVVVGGGYIGLELGIAYRKLGAQVSVVEARERILPTYDSELTAPVAESLKKLGIALHLGHSVEGYENGCLLANDGKGGQLRLEADQVLVAVGRRPRTQGFNLECLALKMNGAAIAIDERCQTSMHNVWAIGDVAGEPMLAHRAMAQGEMVAEIIAGKARRFEPAAIAAVCFTDPEVVVVGKTPEQASQQGLDCIVAQFPFAANGRAMSLEAKSGFVRVVARRDNHLILGWQAVGVAVSELSTAFAQSLEMGACLEDVAGTIHAHPTLGEAVQEAALRALGHALHI

SEQ ID NO: 41939 - protein, 352 aa, Pseudomonas putida GB-1
MNDHNNSINPETAMATTTMTMIQALRSAMDVMLERDDNVVVYGQDVGYFGGVFRCTEGLQTKYGKSRVFDAPISESGIVGTAVGMGAYGLRPVVEIQFADYFYPASDQIVSEMARLRYRSAGEFIAPLTLRMPCGGGIYGGQTHSQSPEAMFTQVCGLRTVMPSNPYDAKGLLIASIECDDPVIFLEPKRLYNGPFDGHHDRPVTPWSKHPHSAVPDGYYTVPLDKAAITRPGNDVTVLTYGTTVYVAQVAAEESGVDAEVIDLRSLWPLDLDTIVESVKKTGRCVVVHEATRTCGFGAELVSLVQEHCFHHLEAPIERVTGWDTPYPHAQEWAYFPGPSRVGAALKKVMEV

SEQ ID NO: 41940 - protein, 418 aa, Burkholderia xenovorans LB400
MSDLSSHILVLGAGHAGDSVAAFLRQYGWQGSITLAGNEGTAPYHRPPLSKALLLGQIPDDDLSLRPASFYDKQNIRLLTDIHAIQIERAQRRVKVRNGEPLAYDHLILATGARVRALDVPGKELEGVMSLRGRADSLAFRDAIRPRKHVVIVGGGYIGLEAAASASKLGANVTVIEREARLLARVASPFLAQYVHDYYRARDVAIELSASVAGFEGNGGRVTEVRLADDRTLLCDVALVGIGVLAEQSLAVAAGLACNDGVLVDEHARTSDERIHAIGDCTRRPLRLGGSDLMVRLESVHNATEQARQAASDLCGRAAPVVECPWTWSDQFDLRLQLAGFPKAAADTVVRGDPMKDAFAIFHLDAAARLQAVEAINAPTEFAFARRVAASGVPLPRNRLSDPAVPLKALMDDALTRA

SEQ ID NO: 41941 - protein, 445 aa, Mortierella alpina
MATPLPPSFVVPATQTETRRDPLQHEELPPLFPEKITIFNIWRYLDYKHVLGLGLTPLIALYGLLTTEIQTKTLIWSIIYYYATGLGITAGYHRLWAHRAYNAGPAMSFVLALLGAGAVEGSIKWWSRGHRAHHRWTDTEKDPYSAHRGLFFSHIGWMLIKRPGWKIGHADVDDLNKSKLVQWQHKNYLPLVLIMGVVFPTVVAGLGWGDWRGGYFYAAILRLVFVHHATFCVNSLAHWLGDGPFDDRHSPRDHFITAFVTLGEGYHNFHHQFPQDYRNAIRFYQYDPTKWVIALCAFFGLATHLKTFPENEVRKGQLQMIEKRVLEKKTKLQWGTPIADLPILSFEDFQHACKNDNKKWILLEGVVYDVADFMTEHPGGEKYLKMGVGKDMTAAFNGGMYDHSNAARNLLSLMRVAVVEYGGEVEAQKKNPSMPIYGTDHVKAE

SEQ ID NO: 41942 - protein, 224 aa, Oryza sativa (japonica cultivar-group)
MDVSAALSSDYSSGTPSPVAADADDGSSAYMTVSSAPPKRRAGRTKFKETRHPVFKGVRRRNPGRWVCEVREPHGKQRIWLGTFETAEMAARAHDVAALALRGRAACLNFADSPRRLRVPPIGASHDDIRRAAAEAAEAFRPPPDESNAATEVAAAASGATNSNAEQFASHPYYEVMDDGLDLGMQGYLDMAQGMLIDPPPMAGDPAVGSGEDDNDGEVQLWSY

SEQ ID NO: 41943 - protein, 445 aa, Mortierella alpina
MATPLPPTFTVPASSTETRRDPLPHDVLPPLFNGEKVNILNIWKYLDWKHVIGLLVTPLVALYGMCTTELHTKTLVWSIVYYFATGLGITAGYHRLWAHRAYNAGPAMSFALALFGAGAVEGSIKWWSRGHRAHHRWTDTEKDPYSAHRGVFYSHLGWLLIKRPGWKIGHADVDDLNKNPLVQWQHKHYLILVILMGLVFPTAVAGLGWGDWRGGYFYAAILRLIFVHHATFCVNSLAHWLGDGPFDDRHTPRDHFITAFLTLGEGYHNFHHQFPQDYRSAIRFYQYDPTKWLIATCAFFGFASHLKTFPENEIKKGKLQMIEKEVLEKKTKLQWGTPIADLPILSFEDFQHACKNDRKQWILLEGVVYDVADFMTEHPGGEKYIKMGVGKDMTSAFNGGMYDHSNAARNLLSLMRVAVVEFGGEVEAQKSRPSVTVYGDHSKEE

SEQ ID NO: 41944 - protein, 223 aa, Sorghum bicolor
IENKISRQVTFAKRRNGLLKKAYELSLMCDAEVALIIFSGRGRLFEFSSSSCMYKTLERYRSSNYSSQEVKVPLDSEINYQDYLKLRTRVEFLQTTQRNILGEVLGPLSMKELEQLENQIETSLKQIRSRENQMLLDQLFDLKSKEQELQDLNKDLRKKLQETSPENALHVSSWEEGGHSGASGNVLDPYQGLLQHPESDPSLQIGYHQQAYMDQLNNEDMAG

SEQ ID NO: 41945 - protein, 553 aa, Prochlorococcus marinus str. NATL1A
MVQYYLEGKKLNQVEKNKAAKDGLEIGKDIDKFAEMGWEQMDKTDLELRLKWYGMFWRPKTPGKFMLRLRIPNGIINAEQLKVIASIVARYGENGSCDITTRQNIQLRGVLISDLPEILNRLKKVNISTTQSGFDNPRNVTGNPIAGVDPEEIIDTRIYTSKMQDHLTNDGKGNSEFSNLPRKWNTAIAGSKDNFLLHNDLIFHPVKINGVLGFSVWIGGVLSSVMNEYAVPLNAWVEEEKIYELTSIILSLWRDNGERNIRPKGRFRFYLDKIGIETFRDLIEKQYGTLKEDPGSIFSDKPRSFFGIHSQKQEGKYFAGIHVPVGRLLAEDLQDLANICENFGDKEIRLTEDQNIIITGIDTNLIEEFKEQSILQKFPLEPETIAAGTVSCTGNTYCGFALTNTKDQALKISHELDKELDLKDELKIHWTGCPNSCGQAYMGGIGLTGKKAKDKEGKTVEAYDISIGGSQGPNYKLGELIKKSVPQDELKDVLKDLLISDFDAKEKIFLSKKSGSLSRFMNWFSPLGKDKPLINRANGSHDIFSKFMNRISN

SEQ ID NO: 41946 - protein, 412 aa, Coccidioides immitis RS
MSGSAALEYGFPSTHSTNAVSVVVYAMHNLNSAASAFSPTSKAALQFLLFIYGTSIVLGRLYCGMHGFLDVVAGCLLGALLGFIQCSYGAAIDAYVLSGGIQGPLLVALVVLVLVRIHPEPADSCPCFDDSVAFAGVMIGVELGGWHFGKTRFGLPDPIPGSIVFDLEKIGWVKAVLRIILGVATVFVWREVMKPSLLRVLPPLFRLIEKSGFSLPRRFFTQASEYKRVPDHLKDDHVIPNVAEIPSMLTSIRHPRRRAISIGPQSEADAYETLAYREHRRRLSTSSPDLIRSAGPSPSAAGDDHSNIPTPTSNPIRQQSQRSANRSPLRLDEYKNMMGTGSPTCEKNGINAFPGVAAHSLDYPYKSQNEEEMFSMITKPRVRYDVEVVTKLIVYSAVEVNPILFHFLGLDR

SEQ ID NO: 41947 - protein, 634 aa, Oryza sativa (indica cultivar-group)
MDFKVASFLLLLLIVTCGAAQGQGNDFVVLDLKTTEVGEDASPMYKEQIALTKIPVTLLRSKHSSLCSACENITSEAVNFLSEKQIQDKIMTILHDTCSQTFSFEQKCLETMDSYATLVFAKIAEIKPDEFCKQYGLCRDMALLSAVKSESTCVFCHHIIDEIMSKLKDPDAEFEIIQLLLKECNKIEGHQQQCKRMVLQYVPLVLVNGEKFLEKNDVCAMIQACDAGKRKAFNLFSARKLILSAYFAVLPLRDEGAISLGLSTLPGLFAGSLLLTLVAAPVASLAFSLPSIPKPRALVFIHRFFSLSLLVFFVLWFASTPGHSPSISQVSLLNLIAISSTWARVIDIMDSESGSRLFGFIGAGATLGQLFGSLFAATMAWLGPFLLLCSSLLMELAALSSKGICTDDTHGSMELSSTIAEKSQNTEADDEMSSLVTSQGLPSQVSESQKTKPEIFVMFEGFWLIARSPYLMYISLFLWLSAVVSSFFYFQGRILTIAGVTVAICASPLIATLNMVALALWPTWVAVAVTETIRKVTTYVLTRPGRELLFTVVSQDEKYKAKVCIDVVVQRLGDATAAGIYSLLFSSLEKKASMVTLYALLLCFVWLLTAFHLGRLQTNLVKVQVASFASSIPR

SEQ ID NO: 41948 - protein, 427 aa, Ipomoea batatas
LGGGAGTRLYPLTKKRAKPAVPLGANYRLIDIPVSNCLNSNVSKIYVITQFNSAYLNRHLSRAYASNMGGYKNEGFVEVLAAQQSPENLWSQGTADAVRQYLWLFEEHNVLVLEFLVLAGDHLYRMDYERFIQAHRETDADITVAALPMDEKRATAFGLMKIDEEGRIIEFAEKPKREQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPISTTPRYLPPSKMLDADVTDSVIGEGCVIKNCKIHHSVVGLRSCISEGAIIEDSLLMGADYYETDADRRLLAAKGSVPIGIGRNSHIKRAIIHNIARIGNDVKIINNDNVQEAARETEGYFIKSGIVTIIKDALIPSGTII

SEQ ID NO: 41949 - protein, 225 aa, Coccidioides immitis RS
MSVSTGRMSQATNITQPPSYSKKFVVVGDGGCGKTCLLISYSQGYFPEKYVPTVFENYITQTTHTPSGKTVELALWDTAGQEEYDRLRPLSYPETDLLFVCFAIDCPVSLENVMDKWYPEVLHFCPTTPLILVGLKSDLRTKRTCIELLKSQGLTPVTPEQGQAVAQRMGALYVECSSKEMRGVDEVFELAVNTAVGIQESSWNSHGGGHQGGGKKIKKRSCKIL

SEQ ID NO: 41950 - protein, 222 aa, Zea mays
MDWAYYGSGYSTPASGGGGGDEDAYMTVSSAPPKRRAGRTKFKETRHPVYKGVRSRNPGRWVCEVREPHGRQRIWLGTFETAEMAARAHDVAALALRGRAACLNFADSPRRLRVPAQGAGHDEIRRAAVEAAELFRPQPGERNVGGSEAAAEAAAAAPCAMGSGDLGGGEFPYYPVDDGLEFEMRGYLDMAQGMLIDPPQPAAGQSAWIEDEYECEVSLWSY

SEQ ID NO: 41951 - protein, 446 aa, Zea mays
MAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 41952 - protein, 203 aa, Shigella flexneri 2a str. 301
MLTEQQRRELDWEKTDGLMPVIVQHAVSGEVLMLGYMNPEALDKTIESGKVTFFSRTKQRLWIKGETSGNFLNVVSIAPDCDNDTLLVLANPIGPTCHKGTSSCFGNTAHQWLFLYQLEQLLAERKYADPETSYTAKLYASGTKRIAQKVGEEGVETALAATVHDRFELTNEASDLMYHLLVLLQDQDLDLTTVIENLHKRHQ

SEQ ID NO: 41953 - protein, 200 aa, Triticum aestivum
LLLLSAYLDKKVQENEELLDSSKTKEARTIFHGQRVPELSIKLYAERIFKYAKCSPSCFVLGLIYIERYLQQPNIYMTSFSVHRLLIASVVVAAKFIDDAFFNNAYYGRVGGITTREMNMLELDLLFSLDFRLKVDIETFGSYCLQLEKEALVLVLERPIQVQAANVTKHLICNSSADETCKHELVRERYSSQAVHGCSW

SEQ ID NO: 41954 - protein, 181 aa, Brassica napus
MAYSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 41955 - protein, 326 aa, Oryza sativa (japonica cultivar-group)
MAALHHQAAAAPVTTTTDGGELRAMDLYEKLEKVGEGTYGKVYKAREKATGRIVALKKTRLPEDDEGVPPTALREVSLLRMLSQDSHVVRLLDLKQGQNKEGQTILYLVFEYMDTDLKKFIRAHRQNLQKIPVPTVKILMYQLCKGVAFCHGRGVLHRDLKPHNLLMDRKTMALKIADLGLSRSFTVPLKKYTHEILTLWYRAPEVLLGAAHYSTPVDIWSVGCIFAELATNQPLFAGDSEVQQLLHIFKLLGTPNEQVWPGVSKLPNWHEYPQWNPSKVSDLVHGLDADALDLLEKMLQYEPSKRISAKKAMEHPYFNDVNKELY

SEQ ID NO: 41956 - protein, 523 aa, Yarrowia lipolytica CLIB122
MIILYVLAVAVSFLIFKRVTYTMRSRELAKKWHCEEPHNLNEFPLNLPLFFLIINASRRHELLDTLLGLFRSFAPTKTVKQVLLGSFTIIPTNDPENIKAVLATQFKDFCLGQRHGQLAPVLGDGIFTLDGQGWQHSRAMLRPQFARDQVSDVEMIERHVQMMLLRIPNNKKFDIQELFFNLTLDTATEFLFGQTVGSQTVEMPNEDKSTVSDMPKDMRKSFQEDFNVAQHHGGIRTRFQMFYWLWRPTELFSSSKRVHAFVDHYVEKALANSDEEKSDDKYIFLRELAREVKDPRVLRDQALNILLAGRDTTAGVLSWIVYELARHPEVWKKLRAEIHQDFGDGSDLSQITFEGLKRCEYLRFVINETLRLYPSVPLNVRYASRDTTLPRGGGPDESKPILVRKGDTIVYNVFSMHRTEEFWGKDCDEFRPERWAEKGSRGWEYLPFNGGPRICLGQQYALTETSYVITRICQLFTNIENADTAVEPPQKLHALTLCHLNGVFVKMTRDEAAFAETEKLINA

SEQ ID NO: 41957 - protein, 626 aa, Bacillus cereus G9241
MARYKRMQGYNVHYLTGTDEHGQKIQKKAEELNVTPQAYVDNIVAGIKELWEKMDISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEENPHFIQPESRKNEMINNFIKPGLEDLAVSRTSFDWGVRVPGNPKHVIYVWVDALSNYITALGYGTENEEMYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFNGEIPAFKANVTEFDETLVAFAKDTLKKVEEAMENMEFSVALSSIWQLVSRTNKYIDETQPWVLAKDENDREKLASVMAHLAEVLRQTGIMLMPFLTVAPSKMFAQLGLTEEAHTSWESLSTIGCIPAGTKVEKGNPIFPRLEMEVEVEYIKEQMKASAPKVEEKKEEEPKAEEITIDDFFKVELRVAEVLSAEPVKKADKLLKIQLDLGTEKRQVVSGIAKFYSPEDLKGKKVICVTNLKPVKLRGELSQGMILAGEENGVLSLASIDQNLPNGTKIK

SEQ ID NO: 41958 - protein, 452 aa, Prochlorococcus marinus str. NATL1A
MIKSKSKNPIQKKSTQSIKKLLQRKWLNVILALILTGLGAALTGILFKTGIHTLEDYRSNLLASMPRWIVLPILGALGGLISGSLIQNFAPAAKGAGVSHIIAFLRHKPVPMGLRVGIVKLFAGIIAIGSGFPLGPEGPAVQMGGSVAWKMAKWLKAPISFRRVIVAAGGGAGIAAIFSAPIGGFVYAIEELLNSARPVVLLLVVVTTFWADSCADILQAIGLDQKAGGFVNNLGFQLERAYTPVIEFFPIDFLYLIFLGIVLGLLAEMYCRYVLKMQVLGNKWFKNKTIERMSLSGLLLGTMYSIIPENFHNIEGLQKIIVNESSNFTLAISIFFILFFASGLAAASGAPGGLFYPMLTLGGAIGLASGIGVETITGHVPTTYIFAGMGRFVAGCSRTPLTAMFLAFALTKNLLILKPLLITCIASFLTARIFNEHSIYERQITIEEGELI

SEQ ID NO: 41959 - protein, 431 aa, Mycobacterium tuberculosis H37Rv
MGAPRLIHVIRQIGALVVAAVTAAATINAYRPLARNGFASLWSWFIGLVVTEFPLPTLASQLGGLVLTAQRLTRPVRAVSWLVAAFSALGLLNLSRAGRQADAQLTAALDSGLGPDRRTASAGLWRRPAGGGTAKTPGPLRMLRIYRDYAHDGDISYGEYGRANHLDIWRRPDLDLTGTAPVLFQIPGGAWTTGNKRGQAHPLMSHLAELGWICVAINYRHSPRNTWPDHIIDVKRALAWVKAHISEYGGDPDFIAITGGSAGGHLSSLAALTPNDPRFQPGFEEADTRVQAAVPFYGVYDFTRLQDAMHPMMLPLLERMVVKQPRTANMQSYLDASPVTHISADAPPFFVLHGRNDSLVPVQQARGFVDQLRQVSKQPVVYAELPFTQHAFDLLGSARAAHTAIAVEQFLAEVYATQHAGSEPGPAVAIP

SEQ ID NO: 41960 - protein, 322 aa, Glycine max
AGVLLRYVPLTAKRMTGIVSRGGSIHAKWCLAYHKENFAYEHWDEILDICNQYDVALSIGDGLRPGSIYDANDTAQFAELLTQGELTRRAWEKDVQVMNEGPGHVPMHKIPENMQKQLEWCSEAPFYTLGPLTTDIAPGYDHITSAIGAANIGALGTALLCYVTPKEHLGLPNRDDVKAGVIAYKIAAHAADLAKGHPYAQAWDDELSKARFEFRWMDQFALSLDPMTATSFHDETLPADGAKVAHFCSMCGPKFCSMKITEDVRKYAAEHGYGTDEALQRGMDAMSAEFQAAKKTISGEQHGEAGGEIYLPEAYVRTKRTT

SEQ ID NO: 41961 - protein, 183 aa, Candida glabrata CBS 138
MTNHKLKVIVLAGTAGTGKSTVAARLLKEYSTKYPGIKFVEGDELHPKANIDKMASGNPLNDDDRWGWLKEVALKSAQSAEEGGCGVSVVACSSLKKSYRDLIRSTRPDVEYHFVFLYGSKVEILNRLNSRKGHFMKSNMMESQFKDLQLPEESEANCVVVLLDHKGFDEIEDDVLKYTNTVL

SEQ ID NO: 41962 - protein, 205 aa, Triticum aestivum
QDEEEEDQQDMAPVKMALGPQVPLKDLLHLHKEEEEGEDESLRRWKEQLLGPDAVHTTNLLHALGAETVEPEVTILNLTILAPGRPDLLLPIPFVPDDKGHAFALKDGCAYSFRFSFAVSNNIVSGLKYSHTVWKTGVKVENQKVMLGTFSPQQEPYTYKAEEDSTPSGIFARGSYSARLKFVDDDGKVYLDMRYSFEIRKDWPN

SEQ ID NO: 41963 - protein, 497 aa, Arabidopsis thaliana
MEMILITLCLTTLLALLLKSILKRTATKNFNLPPSPWRLPVIGNLHQLSLHTHRSLRSLSLRYGPLMLLHFGRTPVLIVSSADVAHDVMKTHDLVCANRPKTKVVDKILSGGRDVAFAPYGEYWRQMKSICIQNLLNNKMVRSYEKIREEEIKRMIEKLEKASCSSSPSPVNLSQILMTLTNDIICRVALGRKYSGKKDGIDVENIVRTFAALLGEFPVGEYIPSLSWIDRIRGLDHKMEVVDKRFDEFLERVVKEHEEADKETRSDLVDKLLTIQSDKTGQFELEKSALKLIIWDMFLAGTATTLSFLEWAMTELMRNPKVMKKLQEEIRSSSPQDLFVTEKEAEKMNYLQAVIKEALRLRPPAPLLVPRVLSEDVKLKGYNIPAGTQVIVNAWAIQRDTTTWGTDAEEFKPERHLDTNLDFQGQDFKFIPFGSGKRICPGIGFTSALIGVTLANIVKRFNWRMDVEPQRVQHDLTEATGLVVFRKFPLIAIPSSA

SEQ ID NO: 41964 - protein, 281 aa, Bifidobacterium longum DJO10A
MVTPMKSDGSVDFAAAQKLAKYLVADGADGLVVNGTTGESPVTHMDEKVELVRAVKEVVDVPVISGAGSNDTAHTVRMVEQTQEAGADAVLVVMPYYSRPSQDGIVGHYKAVDESAEKPIIVYDVPGRTGLKVKVGTYDRLAELEHVKAVKDATGDLAAAVEKQQRTGLAWYSGDDGLFLPFLSIGAVGIISVIAHVASNPMQQLVQAFDRGDITTARRLANQLAPLVHALNGDGYQAVMAKAALKVKGVIPSTTMRLPNIGPDATQLDKAEEGMRAAGLL

SEQ ID NO: 41965 - protein, 419 aa, Triticum aestivum
  misc_feature (77)..(77): Xaa can be any naturally occurring amino acid
  misc_feature (89)..(89): Xaa can be any naturally occurring amino acid
  misc_feature (105)..(105): Xaa can be any naturally occurring amino acid
  misc_feature (133)..(133): Xaa can be any naturally occurring amino acid
  misc_feature (140)..(140): Xaa can be any naturally occurring amino acid
  misc_feature (180)..(180): Xaa can be any naturally occurring amino acid
  misc_feature (220)..(220): Xaa can be any naturally occurring amino acid
  misc_feature (267)..(267): Xaa can be any naturally occurring amino acid
  misc_feature (348)..(348): Xaa can be any naturally occurring amino acid
  unsure (1)..(419): unsure at all Xaa locations
MASPMLSTAMAPLQGGMLEFSGLRSSSSLPLRRNATSDDFMSAVSFRTYAVSTSGGSRKAPTEAKLKVAINGFGRIXGRNFLRCWHGRXDSSPLEVIAINDTGGXKQASHPPQSTTPTLGIFDADVKPVGDNXISVDGQXIKVVSDRNPSNLPWGEMGIDLVIEGTGVFVDRAGAGKHLXAGAKKVLITAPRQGRHPPPTSAASTPDLYTHADTIISNAXSCTTNCLAPFVKVLDQKFGIIKGTMTTTHSYTGDQRLLDASHRDLRXRARAAALNIVPTSTGAAKAVALVLPNLKGKLNGIALRVPTPNVSVVDLVVQVSKKTLAEEVNQAFRDAAANELKGILDVCXDEPLVSVDFRCSDVSSTIDASLSMVMGDDMVKVIAWYDNEWGYSPEGRRPRRHRRRPMEVNAGRRHYCPVK

SEQ ID NO: 41966 - protein, 837 aa, Solanum lycopersicum
MEMSTRRSNYTLLSQVADDNYLPPPPKYSVTGGGGGGGGVAPYYESHSGEKGKGKTGDNRGFDWDLSDHRSNMMQASNRIGAAAFPGSIGLQRQSSGSSFGESSISGEYYMPSLSNAEASFGYLNDGGGGAEVRMKPLEANLFGGSSSKSWAQQTEESYQLQLALALRLSSEATCADDPNFLDHVPDESASRASASAASAETLSHRFWVNGCLSYFDKVPDGFYLIHGMDPYVWIVCSDLQENARVPSIESMRAVDPSVVPSVEVILIDRRTDPSLKELQNRIHSLSPTCGTTKEVVDQLAQLVCSHMGGATSAGEDELVPLWKECSYELKDCLGSTVLPIGSLSVGLCRHRALLFKVLADAIGLPCRIAKGCKYCNRADASSCLVRFGPDREYLVDLIGSPGCLCEPDSSLNGPSSISISSPLRFPRFREVEPTTDFRSLAKQYFSDCQSLNLVFEESSAGAAVDGDAGQTDRNNIERNSAVTGPSNRDEVSRLPVPAIRDMAPVKYVRPVLHGDTQLSDPRDIGNDMRFLERGSQLVPSKISRDIALEIEDFDIPWEDLVLKERIGAGSFGTVHRADWNGSDVAVKILMEQDFHAERFKEFLREVAIMKRLRHPNIVLFMGAVTQRPNLSIVTEYLSRGSLYRLLHKPGAREVLDERRRLSMAYDVAKGMNYLHKRNPPIVHRDLKSPNLLVDKKYTVKVCDFGLSRLKANTFLSSKSAAGTPEWMAPEVLRDEPSNEKSDVYSFGVILWELATLQQPWSNLNPAQVVAAVGFKGKRLDIPRDLTPQVASIIEACWAKEPWKRPSFAAIMDMLRPLIKPPVTPPQPGRTDTQLIA

SEQ ID NO: 41967 - protein, 912 aa, Oryza sativa (indica cultivar-group)
MPPRKDPNGGAFPSEPAPPQPAKAKGKKKDENKDDDLSEEDQALKEQLELYVVRAQDPDPGVQKLALESMRQEIRSATSSMTSVPKPLKFLRPHYGTLKAYFETMPESELKKYMADILSVLALTMSAEGERESLKYRMIGSEGDIGSWGHEYVRLYLEITLEFSVFLFPLFVIENKIGFSNNVNVSLARNLAGEIAQEFQKRQDDGMTTDSLKELVEQIVSFHMKHNAEPEAVDLLMEVEKLDLLVKHVDSTNYKRTCLYLTSSSKYLPAPDDMSALKIAFEIYMKFGDFANALRIALLLDDKVGLSTDIDDDIAADENEKEALQDIISNIKLSEGYLTLARDIEVMEPKSPEDIYKVHLIDGRGATSSSLDSARQNLAATFVNAFVNAGFGQDKLMTAPSDSSGSGSSGNWLFKNKEHGKASAAASLGMILLWDSDSGLAQLDKYLHSNDIHVVAGALLGIGIVSCGVKSDCDPAFALISEYFSRDESIIRIGAILGLGIAYAGSQKEEVKILALGLAIPLVRENLTAFLSDSQVPLEVLVFAAISLGLVFVGSCNEEIAQTIICVLMERSEPELAEPIIRLLPVALGLLYLGKQESVEATAEVSKTFDEKIRNYCDVTLMSLAYAGTGNVLKVQKLLGICSEHLEKGETHQGPAVLGISLISMAEELGAEMAVRSLERLLQYGEQNIRRAVPLALGLLCISNPKVNVMDTMSRLSHDADAEVSMAAIISLGLIGAGTNNARIAGMLRNLSSYYYKEAGHLFCVRIAQGLVHLGKGLLTLSPYHSDRFLLSPIALAGLVTVLHACLDMKSIILGKYHYMLYILALAMQPRMLLTVDEDLKPLSVPVCVGQAVDVVGQAGRPKTITGFQTHSTPVLLAAGERAELATEKYLPLTPVLEGFVILRNNPEYHED

SEQ ID NO: 41968 - protein, 116 aa, Clostridium difficile 630
MDCIFCKIANGEIPSTKVYEDDRVLAFNDLNPVAPYHILVVPKKHYDSLIDIPDKEMDIVSHIHVVINKIAKEKGFDQTGFRVINNCGSDGGQEVKHLHYHILAGKKLPNYEAGQN

SEQ ID NO: 41969 - protein, 164 aa, Triticum aestivum
  misc_feature (84)..(84): Xaa can be any naturally occurring amino acid
  misc_feature (108)..(108): Xaa can be any naturally occurring amino acid
  misc_feature (117)..(117): Xaa can be any naturally occurring amino acid
  misc_feature (134)..(134): Xaa can be any naturally occurring amino acid
  misc_feature (136)..(136): Xaa can be any naturally occurring amino acid
  misc_feature (143)..(143): Xaa can be any naturally occurring amino acid
  misc_feature (148)..(150): Xaa can be any naturally occurring amino acid
  misc_feature (152)..(153): Xaa can be any naturally occurring amino acid
  misc_feature (159)..(159): Xaa can be any naturally occurring amino acid
  unsure (1)..(164): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSXKWVPCLEFKQGWVIFREQNASPGXYYDGRYWTXWKLPMFRMNRRNQVINXVXEAKKEYXDAMSXXXGXXKCVRVXCVSSP

SEQ ID NO: 41970 - protein, 311 aa, Prochlorococcus marinus str. NATL1A
MVPEQSLSKFESTSSKMSTITGKTNLVGLLGQPVNHSLSPIMHNAAYEEMGLDWCYVAMPCHSQDLEKVTKALRFLDFKGLNITIPHKQEVLKACNKLTEIANDIQAVNTLIPEKNNQWIGANTDVQGFLTPLKDHNLKNKSVVVIGCGGSARAVVMGLSSLNIKKVTIISRNEKTLNIFVQSTSNLLSKRDISIESINNTKLNVLPYIQEADLIINTTPIGMNGSQAKQESVPLGHEVWDCLSNKTILYDLIYTPRPTNWLKIGQQKNCFTIDGLDMLVEQGAFSIKLWTGFHDVPVQTMKSSAEKHLMV

SEQ ID NO: 41971 - protein, 759 aa, Streptococcus pneumoniae R6
MYNYPMRIHYHRKNGEYDTCSFVKSQDQRIDLLTYKEDYFGALFSFEHPSSHVIESLNFVVHTGQTSKEYSIRFNHYPLLTEVWILEGDDRIYYSENPAIASPFYKNQNPFAFDKAINSASFDHHWGYQGELGCRVEDNQAHFSLWSPTATEVQVVVYESAANDAPVWKTFEMKRGNSYSYNHKDNTIGVWSLDVEEDLVGKTYQYQVQFPHHQTLTRDPYTIATSPDGKRSAILSHVEKQVENFEVKHGSEATWRLENPCKAVICEMHIRDLTKSPTSGVDEHLRGTFLGAAQAGTVNQYGQSTAFDYIKKLGYNYVQLQPIADRHKEYDEDGNVTYNWGYDPQNYNAPETSFSTNPDDPAQVIRDLKVMVQAYHDAGIGVIMDVVYNHTFSVVDAPFQTTVPDYYYRMNPDGTFQNGTGVGNETASEHEMFRKYMIDSLLYWVQEYNIDGFRFDLMGIHDVKTMQMIRQSLDEIDSNIILYGEGWDMGTGLAPYDKAKKDNAYQMPNIGFFNDNQRDAVKGGEVYGAIKSGFVSGAATEPILAKAILGSRELGSYTHPNQVLNYVEAHDNYNLHDLLATLHPDQSSEQIMRKVETATAMNLLMQGMAFMEIGQEFGRTKLVATGENGELTHDDRERAMNSYNAPDSVNQVNWNLINERQDSIEFIRQVIRLKTKTGAFSYSSYDEIYHHVFVHSAIEHSGCLIYEVHGKEHLLVVVNAKSEPYQFENAGNLAMLVTNSRSKEDNVLNDISLAVLSVL

SEQ ID NO: 41972 - protein, 124 aa, Bacillus cereus G9241
MKVVQTNNAPQAIGPYSQGIIVNNMFYSSGQIPLTSSGELVAGDVTVQTEQVFQNLQAVLEEAGASFDTVVKTTVFLKDMDDFNAVNEVYGSYFSTHKPARSCVQVAKLPKDVSVEIEVIALVK

SEQ ID NO: 41973 - protein, 881 aa, Carica papaya
MFATEENPAPDNPGSVFLEHRRTNPVVVAALSEDLIKSIGSSNSSSGRENENKAVKFKVRAVMTVRNKSKQDLKDTIVKHLDAFSEKIGRNVVLELISSTEIDPRTKEAKKSNQAVIKDWYKKSNVKAERVHYTTELLVDSTFGEAGAITVINHQNEFFLEYTIEGFASGPLHFPCNSWVQPVKHHSSPRIFFSNKPYLPSDTPVGLKALREKELKDLRGDGKGVRNLSDRVYDFDVYNDLGNPDKGSDFARPVLGRQIPYPRRCLTGRPPTDTDMHVESRVEKPLPVYVPRDEQFEESKTDTFSAGRLKAGLHNLIPSVKATISADNHDLYREGLLLKIGLQDELIKKLPLPTVVNTIQESSQRLLKYNTPKIVSKDKFAWLRDDEFARQTMAGINPVSIERLRVFPPVSNLDPQIYGSQPSALQEHHIAPHLHCMTVQQALEEKKLYIMDYHDVYLPFLDRINALDGRKAYATRTIFFLTPQGCLKPIAIELSLPHTGPTSRQKRVVTPPVDATSNWVWQLAKAHVCANDPGVHQLVNHWLRTHASMEPFILAAHRQMSAMHPIFKLLDPHMRYTLEINALARQNLINADGVIESCFTPGRYCMKMSAAAYRNHWRFDMKGLPADLIRRGMAEPDPTQPHGLKLLIEDYPYAADGLLIWSAIENWVGTYVNHYYPNSTLICNDRELQAWYSESINVGHADLREANWWPKLDNADDLISILTTIIWLASAQHAALNFGQYPYGGYVPNRPPLMRRLIPEKIPEYANFLADPQKYFLSALPSLLQATKFMAVVDTLSTHSPDEEYLGERQQPSIWSGDAEIIEAFYGFSAEIIRIEKEIEKRNQDPSLKNRCGAGVLPYELLAPSSEPGVTCRGVPNSVSI

SEQ ID NO: 41974 - protein, 463 aa, Methanocaldococcus jannaschii DSM 2661
MFIDGKWINREDMDVINPYSLEVIKKIPALSREEAKEAIDTAEKYKEVMKNLPITKRYNILMNIAKQIKEKKEELAKILAIDAGKPIKQARVEVERSIGTFKLAAFYVKEHRDEVIPSDDRLIFTRREPVGIVGAITPFNFPLNLSAHKIAPAIATGNVIVHHPSSKAPLVCIELAKIIENALKKYNVPLGVYNLLTGAGEVVGDEIVVNEKVNMISFTGSSKVGELITKKAGFKKIALELGGVNPNIVLKDADLNKAVNALIKGSFIYAGQVCISVGMILVDESIADKFIEMFVNKAKVLNVGNPLDEKTDVGPLISVEHAEWVEKVVEKAIDEGGKLLLGGKRDKALFYPTILEVDRDNILCKTETFAPVIPIIRTNEEEMIDIANSTEYGLHSAIFTNDINKSLKFAENLEFGGVVINDSSLFRQDNMPFGGVKKSGLGREGVKYAMEEMSNIKTIIISK

SEQ ID NO: 41975 - protein, 488 aa, Mycobacterium avium 104
MTKNSDHRCYDELFIGGQWRKPANPQQLDVISPHSEQPIGHAQAAGPEDVDAAVAAARRAFDHGPWPRMSHAERMAKVEQLATIYAAHMDEMADLITDEMGSPRSFSRMGQGAAAATLIHLTLAAARDFPWTERRQGVLGEVHLHRAPVGVVGAIVPWNVPQFLIMPKLIPALIAGCTVIVKPAPETPLDALWLAEMIEQLELPPGVVSVLPGGTDVGEALVRHPGVDKVAFTGSSAVGRRIAALCGERLKRVSLELGGKSAAIILDDADIDKTVAGLKSAGLMNNGQACVAQTRILVSDRKHDEVVDALAAMMAELNVGDPADESTDIGPLVAQRQQRRVQEYIKSGRSEGARMVLGGEDSPAGRGWYVRPTLFADATNDMRIAREEIFGPVLTVLRYRDEDDAIRIANETDYGLAGSVWTADVAHGLEVAAAVRTGTYGINMYTLDIGAPFGGFKQSGIGREFGPEGLHEYVELQTLVCKGQLPPL

SEQ ID NO: 41976 - protein, 459 aa, Listeria monocytogenes str. 4b F2365
MKHIVIIGGGLSGLAAAYELQKTHPNYTWELVEKDKKLGGKFETVKRDGFLIEKGPDSFLARKPAGVGLVKDLGLEDKLIANATGRSYIYHQKALHPIPEGSVMGIPTDKEALLASTLVSEIGKARALQEPTMERNNQEQDQALGEFFEARFGKELVKTIIEPLLSGIYAGDIYKMSLRATFPQFEQAVKKYGNLMDGLKESSMQTTGTKATIGAFRTLEGGLDALPKAIAAALPKGNLHTAKQATNITKKNSSYEISFVDGDKMEADGVIIAATHDALIHLLAEKTTEPFAGQPLTTLATVSLAYNEQDVPILPDGTGYLVARTAPYKTTACTWVQKKWPHMVPENKMLLRGFVGKAGETWLEQASDEAIVSAVLRDYAEMMDLHAAPLFYEVSRMKSAMPQYLVNHQDRLKQLKKNIKADYPGVYFAGMSYEGVGIPDCIAGAQTAAKELVDYLEEV

SEQ ID NO: 41977 - protein, 606 aa, Oceanicola granulosus HTCC2516
MDLRNIAIIAHVDHGKTTLVDELLKQSGAFRENQSVAERAMDSNDLERERGITILAKATSVEHNGTRINIVDTPGHADFGGEVERILSMVDGVVLLVDAAEGPMPQTKFVTSKALALGLRPIVVLNKVDKPDAEPDRALDEVFDLFAALDAADDQLDFPHLYASGRAGWADETLEGPRRDLSALFDLIVRHVPAPRQAAAADKPFRMLATTLGADPFIGRLLTGRVESGTLRTGATVNALSRTGEKVESFRVSKILAFRGLSQQPIDEAVAGDIVSLAGMSKATVADTICDPALDVPLPAQPIDPPTITVTFGINDSPLAGRDGKKVQSRVIRERLMKEAETNVAIKIADTPGGEAFEVSGRGELQMGVLIENMRREGFELSISRPRVIIREEDGQRLEPVEEVTIDVDDEYSGAVIEKLTGPRKGELVEMKPAGAGKTRIVAHVPSRGLIGYHGEFLTDTRGSGVLNRIFHSWAPHKGAIQGRRQGVLISMENGVSVAYALWNLEERGKMFIGAQEQVYEGMIIGEHSRENDLEVNPLKGKKLTNVRASGTDEAVRLTTPVTMSLETAIAYIDDDELVEVTPNSIRLRKRFLDPHERKRQSRAAG

SEQ ID NO: 41978 - protein, 323 aa, Aspergillus nidulans FGSC A4
MENYQKIEKIGEGTYGVVYKARELTHPNRIVALKKIRLEAEDEGVPSTAIREISLLKEMNDPNIVRLLNIVHADGHKLYLVFEFLDLDLKKYMEALPVSEGGRGRALPDGSTLSRNLGLGDAMVKKFMAQLIEGIRFCHSHRVLHRDLKPQNLLIDRDGNLKLADFGLARAFGVPLRTYTHEVVTLWYRSPEILLGGRQYSTGVDMWSCGAIFAEMCTRKPLFPGDSEIDEIFKIFRILGTPDETIWPGVTSFPDFKPTFPKWKREDIQNVVPGLEEDGLDLLEALLEYDPARRISAKQACMHPYFQHGSSYYSGRARRNGFH

SEQ ID NO: 41979 - protein, 793 aa, Solanum lycopersicum
MEVPVRRSNYAILQQQPPYDEFNSDEKSKSRGDKGLYWDLIDRRKGTTPFQASIVLPTQSSEGSFAESSISGVSFGYMNAYSDVGGSLSKSWAQQTEESYQLQLTLALRISTEATCADDPNLLDYVPDESVSHASASSASVEAMSHRFWVNGSLSYFDKVPDGFYFIQGMDPYIWTVCSDLQESGRIPSIESLMAVDPSVVPSVEVILIDRQSDPRLKELQNRIHSMYRSCNTTKEVVDQLAKLVCNHMGGAASVGEGDFIPIWKECCNDLKDCLGCFVFPIGSLSVGLCRHRTLLFKVLADIIDLPCRIARGCKYCKESDAFSCLVRFGLDREYLVDLIRDPGCLYEPNSLLNGPSSISIPSPLRLPRFGQVEPAMDFTSFAKQYFSDCLSLNLAFDDSSAGTAVDGDAGQTDRSSMDKSSAVPSSSNRDEVSRLPLPSINAWNKGCDKGSQLPAKYHPPNMSISMSQEKDLIHLKNVPPIRYVDAHLIAISEARTDTINDQRYFEGVGRLAPAKPSRGLVLDVEDLDIPWNDLVLKERIGAGSFGTVHRADWNGSDVAVKILMEQDFHAERYKEFLQEVAIMKRLRHPNIVLFMGAVTEPPNLSIVTEYLSRGSLYRLLHKPGAREVLDEKRRLCMAYDVAKGMNYLHKRKPPVVHRDLKSPNLLVDTKYTVKVCDFGLSRLKANTFLSSKSAAGTPEWMAPEVLRDEPSNEKSDIYSFGVILWELATLQQPWSNLNPPQVVAAVGFKGMRLEIPRDLNHPVTTIIEACWVNEPWKRPSFSTIMDMLKPLI

SEQ ID NO: 41980 - protein, 474 aa, Dechloromonas aromatica RCB
MSKQFDVLVIGGGPGGYIAAIRASQLGFLAACAESNPYADPKGEPRLGGTCLNVGCIPSKALLHTSHLFEEANHSFEAQGIKVGKATIDVPVMKARKDGVVNQLTSGIKMLLKKNKVSFLAGHGSFVGKEGDYWKVKVGAEEVLTKQVIVATGSKARHLPNLPVDQKIVMDNEGALNQESVPKKLAIIGAGVIGLEMGSVWRRVGSEVTVLEAMPDFLAAADVDVAKEALKLFSKQGLNIQMGVKIGDIKATKKSVSIAYTDKDGKEQKLDADRLIVSIGRVPNTDGLNGEAVGLKLDARGFVEVDGHCKTNLPGIWAIGDVVRGPMLAHKAHEEGVMVAELMAGQAGHCNFDTIPWVIYTSPEIAWVGKTEQQLKAEGVEYKAGKVPFLANGRALGMGDPSGFVKMLACKKTDRILGVHIIGANASEIIAEAVVAMEFGGASEDLARICHAHPTLSETVHEAALACDKRTLNF

SEQ ID NO: 41981 - protein, 143 aa, Coccidioides immitis RS
MYLEDRTVRLQLWDTAGQERFRSLIPSYIRDSSVAVVVYDISNAKSFQNTRKWVDDVRGERGNDVIIVLVGNKTDLNDKREVTTAQGEEEAKKNGLMFIETSAKVGYNVKQLFRRIAQALPGMEVIDVNINPTQPVSNEGCAC

SEQ ID NO: 41982 - protein, 407 aa, Dechloromonas aromatica RCB
MSIIEVQVPQLSESVAEGTLASWKKKIGEAVARDEILIDIETDKVVLEVPSPAAGVLVEIIKADGETVVSGELIARIDTEAKAGVAAPAAEAPKAAAAAAPAPAAAAPAGTASPSARKILDEKGVAAADVAGSGRGGRVTKEDAVAAAPKSGPVAAPAAAKVSLPTPPVTVALGDRTEQRVPMTRLRARIAERLLQSQQTNAILTTFNEVNMGPMMALRKQYGEKFEKTHGVRLGFMGFFVKAACAALQKFPVLNASVDGNDIVYHGYIDIGIAVGSPRGLVVPIIRNADQMSIAEIEKKIAEFGAKAKDGKLTIEELTGGTFSISNGGIFGSMMSTPIINPPQSAILGIHATKDRAMVENGQVVVRPMNYLAMSYDHRIIDGREAVLGLVTMKEALEDPSRLLLGV

SEQ ID NO: 41983 - protein, 104 aa, Arabidopsis thaliana
LGEGLKWGLVWPWGNLLVPLKAVDLPPKFKSWLVPGKIHHIFCTENFCFKKIHDYLKTICPDWLIVRGEFDKNARYPEIKTLTIGQFKLGLCHGHQVIPWGDLD

SEQ ID NO: 41984 - protein, 432 aa, Dechloromonas aromatica RCB
MTTERKATLSIDGQAPVDFSIMSPTHGNDCIDIRTLGGKTGLFTYDSGFLSTASCKSKITFIDGDVGQLLYRGYPIEQLAENCNFLEVTYLLKNGELPNAKQKADFESTIKNHTMVHEQLSKFFSGFRRDAHPMAVMTGVVGALSAFYHDAMDFSDAEHRNVSFNRLVAKMPTIVAMAYKYNTGAPFMYPDNSLDYTANFMRMMFGNPCEKYVPNPVLVRALDTIFTLHADHEQNASTSTVRLAGSSGANPFACIAAGIACLWGPAHGGANEACLQMLEEIGDVSRVPEYIARAKDKNDSFKLMGFGHRVYKNFDPRAKLMRQVCNEVLAELGLENDRLFKLAMELERIALEDPYFVEKKLYPNVDFYSGIVQKAIGIPTEMFTCIFALARTVGWMTQWEEMISDPEYKIGRPRQLYMGAAKRDVVPLAQRG

SEQ ID NO: 41985 - protein, 1018 aa, Chromobacterium violaceum ATCC 12472
MQVTRRQLFKLTAAQLGASSLVAMGFAPQQALAEVRQFKLLGARETRNTCTYCSVGCGLILYGLGDGAKNAHGEIYHIEGDPDHPVSRGSLCPKGAGLLDFIHSPKRLKYPEVREPGSGEWKRIGWDEAISRIARLMKDDRDAHIVEKNAAGVPINRWLSTAMLTASAGSNETGIISQKFIRSLGIVATDAQARVCHGPTVSALASTFGRGAMTNSWVDIKNADFILVMGGNAAEAHPVGFKWAIEAKKTRGTRLIVVDPRYNRTASVSDLYLPIRVGSDIAFLGGVINWLIQHDKIHWDYVKAYTNAALIVRDDYRFDEGLFSGYDAAKGKYDKSSWNYELGDDGYAKTDPSLQHPRCVWQLLKQHYSRYTPEMVNTICGTPVDGFLQVCKELGETARPDKAGTILYALGWTQHTTGSQNIRTMAMIQLLLGNIGMPGGGVNALRGHSNIQGLSDLGLLSTQLPGYLTLPSEADHPDLATYLAKTTPKALQANQFNYWSNTPKFFVSLMKWMWGDNAGKDNDWGYDWLPKWDKMYDVLHMAELMYQGKMNGFIVQGFNPLASFPDAAKVTEAFSKLKYMVIIDPIATETSTFWQNHGDAHDVDPAKIQTTVFRLPSTCFAEEDGSIVNSARWLQWHWKGAQPPGEARGDNEIIGELFVAIRDLYRKEGGKLADPILKVNWNYRNPKAPTPSELAMEMNGKALADLPDPADPSKTLVKKGEQLPGFAALQDDGRTACACWIFSGCWTQAGNQMARRDNTDTGLGNTPGWSWSWPANRRILYNRASCDPAGKPWDPARKLISWNGEKWVGGDVPDFKADAAPDSGMQPFIMNPEGVGRLFCADKLVDGPFPEHYEPMESPIGTNPLHPKVVSSPAVRLFDSDRKRLGTHKDFPYVGTTYRLTEHFQFWTKSVLLSAIAQPEQFVEIGEALAREKGIAQGDMVKVSSNRGFVKAKAVVTKRLMALKVNGQTVHQIGIPLHWGWEGVARPGYLTNALPPAVGDCNTQTPEYKAFLVKLEKL

SEQ ID NO: 41986 - protein, 555 aa, Staphylococcus aureus subsp. aureus NCTC 8325
MTHLSDLDIANQSTLQPIKDIAASVGISEDALEPYGHYKAKIDINKITPRENKGKVVLVTAMSPTPAGEGKSTVTVGLADAFHELNKNVMVALREPALGPTFGIKGGATGGGYAQVLPMEDINLHFNGDFHAITTANNALSAFIDNHIHQGNELGIDQRRIEWKRVLDMNDRALRHVNVGLGGPTNGVPREDGFNITVASEIMAILCLSRSIKDLKDKISRITIGYTRDRKPVTVADLKVEGALAMILKDAIKPNLVQSIEGTPALVHGGPFANIAHGCNSILATETARDLADIVVTEAGFGSDLGAEKFMDIKAREAGFDPAAVVVVATIRALKMHGGVAKDNLKEENVEAVKAGIVNLERHVNNIKKFGVEPVVAINAFIHDTDAEVEYVKSWAKENNVRIALTEVWEKGGKGGVDLANEVLEVIDQPNSFKPLYELELPLEQKIEKIVTEIYGGSKVTFSSKAQKQLKQFKENGWDNYPVCMAKTQYSFSDDQTLLGAPSGFEITIRELEAKTGAGFIVALTGAIMTMPGLPKKPAALNMDVTDDGHAIGLF

SEQ ID NO: 41987 - protein, 249 aa, Treponema pallidum subsp. pallidum str. Nichols
MRGYFIAGNWKMHKTCAEAVALAQELVRELRGGPHTYMIAPSFTALDAVGKVLRGSNVLLGAQDVSSEEWGAHTGEVSVLQLEDLGVQVVIVGHSERRHGRGENDKLINQKVRRVLESGLRVILCVGERLQEYEAGCTNEVVGTQVRAGMADVCGSLMHNVTVAYEPVWAIGTGKTATPAQANAVHAHIRSVVREMYGAAIAEALCIQYGGSMKAENARALLAEEHIDGGLIGGASLEAASFVPIARSV

SEQ ID NO: 41988 - protein, 444 aa, Spinacia oleracea
NSQTCLDPEASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPDWFQGTADAVRQYLWLFEEHNVMEFLILAGDHLYRMDYERFIQAHRETDADITVAALPMDEKRATAFGLMKIDEEGRIIEFAEKPKGEQLQAMKVDTTILGLDDERAKEMPYIASMGIYVISKDVMLNLLRDKFPGANDFGSEVIPGATSIGLTVQAYLYDGYWEDIGTIEAFYNANLGITKKPVPDFSFYDRSSPIYTQPRYLPPSKMLDADITDSVIGEGCVIKNCKIHHSVIGLRSCISEGAIIEDTLLMGADYYETDADRKLLAAKGSVVLGIGQNSHIKRAIIDKNARIGDNVKIINSDNVQEAARETDGYFIKSGIVTVIKDALIPSGTVI

SEQ ID NO: 41989 - protein, 419 aa, Treponema pallidum subsp. pallidum str. Nichols
MMLRTCKDVTMRGERVVVRVDFNVPMRDGMVQDDTRVTAAVPTLRYIIEQGPRHVVLISHLGDPTRDADKAEGNAKKDGCPFDRHAFINGKHRLKPVADCLAKKLGVPVHFAPSCVGQREFIEGLPDGSVVLLENVRFHPEETSGDAKVQEQFARELAQYGDIFVNDAFGTAHREHASTVVLPRLMRRRVAGLLIEREVRYLEPMVCNPKVPMVAVVGGAKVSSKIAVLESLLRTSTALIIGGGMAYTFLKAQGVGVGTSLVEDDFIDTARMLLQKAQSGGVSVVLPVDHVCASTFCADAQPVAVDDVHIPMHLMGMDVGPRTLEQYRAHLKGVSSVLWNGPVGVFEFDAFAHGTRVLAQLIAEATDAGATSVVGGGDSIAAVSKFGLASRMSHVSTGGGASLKLFEGKVLPGISCLET

SEQ ID NO: 41990 - protein, 474 aa, Streptococcus pneumoniae R6
MTRYQNLVNGKWKSSEQEITIYSPINQEELGTVPAMTQTEADEAMQAARAALPAWRALSAIERAAYLHKTAAILERDKEKIGTILAKEVAKGIKAAIGEVVRTADLIRYAAEEGLRITGQAMEGGGFEAASKNKLAVVRREPVGIVLAIAPFNYPVNLSASKIAPALIAGNVVMLKPPTQGSISGLLLAKAFEEAGIPAGVFNTITGRGSEIGDYIIEHKEVNFINFTGSTPIGERIGRLAGMRPIMLELGGKDAALVLEDADLEHAAKQIVAGAFSYSGQRCTAIKRVIVLESVADKLATLLQEEVSKLTVGDPFDNADITPVIDNASADFIWGLIEDAQEKEAQALTPIKREGNLLWPVLFDQVTKDMKVAWEEPFGPVLPIIRVASVEEAIAFANESEFGLQSSVFTNDFKKAFEIAEKLEVGTVHINNKTQRGPDNFPFLGVKGSGAGVQGIKYSIEAMTNVKSIVFDVK

SEQ ID NO: 41991 - protein, 384 aa, Clostridium difficile 630
MSTKRDYYEVLGISKGAEAQEIKKAYRKLAMKYHPDRNPGDKEAEEKFKEINEAYEVLSDDTKRKTYDQFGHDGLNGQGGFGGQGGFGGQGFGGFEDMFGDIFGDMFGGSFGGGRARRRGPQRGADIRQSVTISFEEAAFGKKMSIKVNRSEECEECNGTGAKPGTSKKTCSTCNGTGQVRTVQRTPFGNIASSRPCSACNGTGEVIESPCSKCHGTGNTRKVKTIEVDIPAGIDDGQMIKLSGQGEVGEKGAPRGDLYIVVNVKSHPLFTRDGNDIYFEMPITFVQATLGDEIEVPTLDGKVKYSVPEGTQTGTVFRLKEKGIPRIRGNSRGDQYVKVVVEIPKKLNDKQKELLREFAKECGSNVHEKKKTFGQKIEDMFKKK

SEQ ID NO: 41992 - protein, 380 aa, Streptococcus pneumoniae R6
MKNEMLALILAGGQGTRLGKLTQSIAKPAVQFGGRYRIIDFALSNCANSGIHNVGVVTQYQPLALNNHIGNGSSWGLDGINSGVSILQPYSASEGNRWFEGTSHAIYQNIDYIDNVNPEYVLILSGDHIYKMDYDDMLQSHKDNNASLTVAVLDVPLKEASRFGIMNTDANNRIVEFEEKPAQPKSTKASMGIYIFDWQRLRNMLVAAEKSKVGMSDFGKNVIPNYLESGESVYAYEFSGYWKDVGTIESLWEANMEYISPENALDSRNRQWKIYSRNLISPPNFLGANAHVEDSLVVDGCFVDGTVKHSILSRGAQVREGAEVLDSVIMSGAIIGQGAKIKRAIIGEGAIISDGVEIDGTDEVQVVGYNEVVGVATDED

SEQ ID NO: 41993 - protein, 494 aa, Burkholderia xenovorans LB400
MNANPKHVADPTRLRNQNLIGGQWKAALSGQSIAVENPANEEIIAQVPRGQQEDIDEAVKVARATFESAAWRKIRPIDRGRILENIARKVEEHAEELSWLESLDTGKAISFARVIDLPSTVDVFRYMGGWCSKLGGTTPPISFDGKEYHAYTRREPVGVVGAITPWNYPLALGSWKIASALAAGCTMVLKPTELTPLSTLRLAELCLEAGLPEGALNVVNGYGHEAGEALARHPDIDKITFTGSTVVGKKIVEYALGNMKRVTLELGGKSPSIVFDDADLDQVGLGAALAVFFNSGQICFAASRLFVQASVYDRVVEAVAAVASQFKVGNGQDTDTMLGPLVSRKQQERVLGYVQSGIEQGASLIYGGQKIGDKGYFLQPTVFADADQSMKIAQEEIFGPVVSIIRFKDEVEAIRLANDTTYGLAANIWTRDIKKAHRVAHRLQAGSVWINCHGVIDPAAPFGGFKQSGWGREVSEEGLAAYTEIKTVCALLDD

SEQ ID NO: 41994 - protein, 131 aa, Myxococcus xanthus DK 1622
MRRMARKAIHSDQAPKAIGPYSQAVQVDAGKMTFLSGQIPLDPATMEMVQGDVVAQAERVMENLKAVLAASGLDFSHVVRCTIFLTDLGDFARVNEVYGRYFTGAPPARATVQVSALPRGSKVEIDAIAVS

SEQ ID NO: 41995 - protein, 217 aa, Oryza sativa (japonica cultivar-group)
MVILLQAFKLLNVKEIGYKLTHQIKCLELQATEYSLHHIKVTSVEVAANTSSHGSESSIPCPTTTRQQEKQPLNIEELSDSSEEGVRRAPRTNWKEEENLRFVSAWLNNSVDSVDGNDKKSEYYWKDVADEFNSNMPRNAHTRTVKQMKTHWDNVKRDIAKFCGAYAQVRNTCTSEYFEDMIMEKAHTWYKNQAQQKSFTLEYMWREQKDQPKGPPI

SEQ ID NO: 41996 - protein, 379 aa, Streptococcus pneumoniae R6
MKIDKYSAILGNTVGFHNMSTLTDHRPVASLPFGGKYRLIDFPLSSLANAGVRSVFGIFQQDNISSVFDHIRSGREWGLSTLLSHYYLGIYNTRVESSTVGKEYYQQLLTYLKRSGSNQTVALNCDVLINIDLNQVFHLHSTTKEPITVVYKKLAKKDISEVNAILDVDETDHVLSHKLFDSKSTAETFNMSTDIFVVDTPWLIEHLEEEAKKEHPEKLRYVLRDLAVKEGAFAYEYTGYLANIHSVKSYYQANIDMLESQKFYSLFSPNQKIYTKVKNEEPTYYANTSKVSTSQFASGSIIEGQVANSVLSRNIHVHKDSLVKDSLLFPRVVIGEGAQVEYAILDKGVEVEPGVVIRGTAEHPVVVKKGAKVTEDIHS

SEQ ID NO: 41997 - protein, 341 aa, Oryza sativa
  misc_feature (314)..(315): Xaa can be any naturally occurring amino acid
  unsure (1)..(341): unsure at all Xaa locations
MPTVSVGRDRFFVALGRTYTQEEFEVLCFEFGIELDDVTTEKAIIRKEKHLEDDDGEVDGDDDEVIYKIEVAANRYDLLCLEGLARALRIFTGTEATPMYKISCIPRDSMLQMHVKPQTSQIRPYVVCAVLGGVTFDEARYNSFIDLQDKLHQNICRKRTLVAIGTHDLDTLKGPFSYEALPPQEINFVPLKQEESFRADKLMEFYKSDMKLKKFLHIIENSPVYPVIYDSNRTVLSLPPIINGAHSAITLKTRNVFIECTATDLTKAKIVLNTMVTMFSEYCENKFEVEPVEVVSHDGSKTIYPDLSCYKMEXXSLSEVVGPIGISLDETKVISLLNKMQ

SEQ ID NO: 41998 - protein, 206 aa, Zea mays
MASLLARQAAQALRARQTAQLGPAASAMQGHLRTYMNAGIPKRFKEDEEKEQLAKDLAKDWNAVFERSINTLFLTEMINYPFEKGPLSPRFRGEHALRRYESGEERCIACKLCEAICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 41999 - protein, 623 aa, Oryza sativa (japonica cultivar-group)
MTVRDVATWNSLLAGLAQGTEPNLALALFHRLANSFQELPSREEPNEVTIVAALSACAQIGLLKDGMYVHEFAKRFGLDRNVRVCNSLIDMYSKCGSLSRALDVFHSIKPEDQTLVSYNAAIQAHSMHGHGGDALRLFDEMPTRIEPDGVTYLAVLCGCNHSGLVDDGLRVFNSMRVAPNMKHYGTIVDLLGRAGRLTEAYDTVISMPFPADIVLWQTLLGAAKMHGVVELAELAANKLAELGSNVDGDYVLLSNVYASKARWMDVGRVRDTMRSNDVRKVPGFSYTEIDGVMHKFINGDKEHPRWQEIYRALEDIVSRISELGYEPETSNVLHDIGEEEKQYALCYHSEKLAIAFGLIATPPGETLRVIKNLRICGDCHVVAKLISKAYGRVIVIRDRARFHRFEDGQCSCRDYCGVWAIWFCVKLLGFQKHFIERCHVASSQGFVTFATVEGHDADFVFYTRQEIQDVDGEKDAGRAGETGMISYKIAAHAADLAKCHPYAQAWDDTLSKARFEFRWLDQFALYLDPVTTMSFHDETLPSEGAKVAHFCSMCGPKSCSMKITEDIRKYADEHGYRIVEEAVIPGMNAMSAEFLAARKTISGEQHGEAGGEIYVPESYTARK

SEQ ID NO: 42000 - protein, 402 aa, Burkholderia xenovorans LB400
MDEGIKRIVIAGAGQAGATVAFGLRRGGFGGEIALVGDEVHLPYERPQLSKEMLRPESAGHRSIRTRAEFNEQRIELVLGRRVVAVDVERHQIQLDDGRGLAFDRLVLAGGVSPRQLPGGPHDAAAVRYLRTVEDASGLCADLETGGHVAIVGGGVIGLEVAAAARARGCEVTVIEAADRLMSRSVDDTVSRFLDRAHRGKGVDIRYRVLVTELRDGRYLELSDGSTVAADTVLVGIGVTPNIAGFDALGITDAAGVRVDAYGQTALQGIFATGDIASQKNENGFGRIETWANAQDHALNVARNLLGERVAYESPVWFWSDQGTTNLQVVGNATRGRRIVRGDERGEAFSVFWLGEGDRVTGCASVNMPKDMALARRWVKQGNRVDPHQLAEPGTPLRNCAL

SEQ ID NO: 42001 - protein, 168 aa, Methanocaldococcus jannaschii DSM 2661
MRTILNKLNINGEIMLIKDIMKKPIVVYEDNDLIDVIRLFRKNKISGAPVLNKDGKLVGIISESDIVKTIVTHNEDLNLILPSPLDLIELPLKTALKIEEFMEDLKNALKTKVRDVMTRKVIVAKPDMTINDAAKLMVKNNIKRLPVVDDEGNLIGIVTRGDLIEALI

SEQ ID NO: 42002 - protein, 110 aa, Glycine max
GRGKGGMGLVKGGANMHGKVLRDNIQGITKPAIRTLARRGGVERINGLIYEETKRVLKIFFENVINDGITYTEHAKKKTVTAMDVAYALKRQGKTLYCYEAKKIIFKIMT

SEQ ID NO: 42003 - protein, 1527 aa, Coccidioides immitis RS
MGVNTAAEAAARVAYLSSDLVLSVQPSLQGDSEFSQQLKQLSAKNVQGIVSHEVPEVRAVRQNEDPLLSAFHPLQNGKYVSVTTSSSILLSSIPHLYRLAQYPIVLHVSLEPAAFPDFSVISSIRQCGFSFLHSETPQEAQDIALTAHALAIKSGKGVIHFFDSSNASGDVPIAEEDPELVTEILDLNSARALHQSNGTSQTIYANSGRIATVEEQGLAAAQSQAVATSELPALSKDLSSTEASSIASSQGDSISGSAVPSSAATTVEAPTRRPVDASDIFQIAAHIWDSLAARTGRTYHAIEYVGPENAKNALFIFGSTRIFVDILSDPSSKGDFPGIGIITARLYRPWVGSQISRTIPTSVERIAVLEQVRKTTKWGPSFLDLLSSLARQGGGNSPLLVGYRLGYVEPSTVRQALRGIFQNLTASSPIQNLDVGTQKEPSEVASKLQLEQPANENAYVKILNQLFDGRLHVANQLGSQHAGISATVSTSPEYGFGSLIARMERRERFVGEVQEAVKSNEFATDIPRNWLSKWALNAAEPKKINQIAPDVIARLLVDGSSLSRELLASKQFFFAESQWLIGSDAWAYDLGNSGVHHVLASGANVNMLIIDSQPYSERVAADPTRRKKDIGLYAMNYGNAYVASVAVYSSYTQVLQAITEADQFKGPSVVVAYLPYNKEDDSPLTVLQETKKAVDLGYWPLYRWNPNNAEKGEPNFALDSERIKRELEEFLRRDNQLTQIMKRNPRFSAALSESYGSEVRALQKRAAKDAYDKLLEGLFGAPLTILFASDNGNAENLAKRLGNRGKARGLKTAVMAMDDYPIEDLPTEENIVFISSTAGQGELPQNGRNFWETVKNSADLDLSSVHYSVFGLGDSHYWPRKEDKIYYNKPGKDLDSRLSFLGAKKLADIGLGDDQDPDGYQTSYQEWEPRLWQALGVDKVEGLPEEPPPLTNEDIKIQSNYLRGTIAEGLRDTSTGAISASDQQLTKFHGTYMQDDRDVRDERKAQGLEPAYSFMIRCRLPGGVATPQQWLQMDAISSAYGNETMKLTTRQTFQFHGVVKGKLRPAMQAINKALMTTIAACGDVNRNVMCSSLPELSTYHREVHQVSKKISDHLLPATTAYHEIWLKDENDKKIQVAGDAIVDHEPLYGPTYLPRKFKITIAIPPHNDTDVYAHDIGLIAIKGADGHLEGFNILAGGGMGMSHNNKKTYPRTGSMLGYVPANQAHIVCEKIMLVQRDHGDRKNRKHARLKYTIDDMGVDVFKDKVEEILPNGLRFAPPRPFKFDSNVDTFGWQKDEKGLNHFTFFIENGRVEDTADFQMRTGLRELAELGKGEFRLTGNQHLILSNVEDADLPAIKQLMAKYKLDNTAFSGLRLSSSACVAFPTCGLAMAESERYLPVLITKLESTLEENGLGRDSIVMRMTGCPNGCARPWLAEVAFVGKAYGAYNMYLGGGYHGQRLNKLYRASIKEEEILDIMKGLLKRYALERNVDGALPERFGDWCVRAGVIKETTEGKNFHEGVAEDEGEE

SEQ ID NO: 42004 - protein, 378 aa, Nannochloris bacillaris
MAAEDGEISAIVCDNGSGMVKAGFAGDDAPRAVFPSIVGRPRHQGVMVGMGQKDAYVGDEAQSKRGILSLKYPIEHGIVTNWDDMEKIWHHTFYNELRVAPEEHPVLLTEAPLNPKVNREKMTQIMFETFNVPAMYVAIQAVLSLYASGRTTGIVMDSGDGVSHTVPIYEGYALPHAIQRLDLAGRDLTEFMMKILTERGYSFTTTAEREIVRDIKEKLCYVALDYEGELQTSLASSTLEKNYELPDGQVITIGSERFRCPEVLFQPSMLGVEGAGIHETTYNSIMKCDVDIRKDLYANIVLSGGTTMFAGIADRMTKDITALAPSSMKIKVVAPPERKYSVWIGGSILSSLSTFQQMWISKSEYDESGPSIVHRKCF

SEQ ID NO: 42005 - protein, 439 aa, Gloeobacter violaceus PCC 7421
MLSLPTKEASLPRVPRLVGPLPGPRAQALIARDEAVTSPSYTRGYPLVAARGEGCMLEDVDGNVFLDLTAGIAVTATGHAHPVVVRAIQEQAANLLHMSGTDFYYEPMAELAEALCERAPFPTAAGRPRARVFFSNSGAESNEGALKLARYYTGRQQVVAFLGAFHGRTYGAMSLTGSRAVQRQGFGPLVPGISHIPYGTHASLDYLEDKLFPAVLPPEEIAAIVVESIQGEGGYIVPEDGFHERIRQICTRHGILMVVDEVQAGMGRTGKLFAIEHWGVQPDIVTLAKGIASGLPLGAILSRPEIMTWPAGSHATTFGGNPVACAAANATLKLLEAGLIENAERMGRVLQAGLGQLADRFSFVSASRGKGLMVAVDLFDAAGNLDRERRDQIVDLAFYRGLLLLGCGKAAIRFCPPLVIDADQVRVALDILRQIFEEQ

SEQ ID NO: 42006 - protein, 195 aa, Candidatus Desulfococcus oleovorans Hxd3
MKRSASVQRQTAETQVSVTVLLDGIGTQTISTGIPFFNHMLSLFAAHGFFDLTVQASGDIDVDFHHTVEDVGIVLGNSVNKALGDRKGIRRYGYAVTPMDEALAHAVIDLSNRPFLVFNVPSIPAAETGFGVQLAKEFFRAFAVNCGMTLHIRVDYGENEHHVIESVFKAVARALDMATSMDDRITGPLSTKGCI

SEQ ID NO: 42007 - protein, 419 aa, Oryza sativa
MENMRSENFNQGVSMEGVKHAPEMANTNRRALRDIKNIIGAPHQHMAVSKRGLLDKPAAKNQSGHRPMTRKFAATLANQPSSAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKLELMSFFIIELSLVEYEMLKFQPSMLAAAAIYTAQCTINGFKSWNKCCELHTKYSEEQLMECSKMMVELHQKAGHGKLTGVHRKYSTFRYGCAAKSEPAVFLLKSVAL

SEQ ID NO: 42008 - protein, 573 aa, Treponema pallidum subsp. pallidum str. Nichols
MSISLLQQERHRYLPKVPDLLRGDFRRVCARRGLSTTAVADYDALRSLFARTYGQPLVNFVNASEKNEDSPMETAPEPRGLRVAIVLSGGQAPGGHNVIAGLFDGLKRWHADSVLIGFLGGPAGVLSGDHIEICADRVDAYRNTGGFDLIGSGRTKIESESQFAAAAQTVTRMALDALVVVGGDDSNTNAALLAEHFVNSGISTKVIGVPKTIDGDLKNEAIETSFGFDTATKTYSELIGNIARDACSARKYWHFIKLMGRSASHIALECALKTQPNVCLISEEVAAQSLTLAQIVQSLCDTIATRAQHGEHFGIVLVPEGLIEFIPEMKALITELNEVMARRAQEFEALDTPDAQRVWIEQALSASARAVFNALPAEISTQLLADRDPHGNVQVSRIDTERLLILQVTERLAQMKQEGTYTGVFSSIAHFFGYEGRCAFPSNFDADYCYTLGLTACLLAVHRFTGYVASVRNLTSSVAEWAVGGVPLTMLMNMERRHGSQKPVIKKALVDLEGMPFRVFSRRRASWALKTSYVYPGAVQYYGPPAVCDEPSVTIRLERPAPAANSSFGHRSS

SEQ ID NO: 42009 - protein, 65 aa, Arabidopsis thaliana
  misc_feature (13)..(13): Xaa can be any naturally occurring amino acid
  misc_feature (31)..(31): Xaa can be any naturally occurring amino acid
  misc_feature (34)..(35): Xaa can be any naturally occurring amino acid
  misc_feature (39)..(39): Xaa can be any naturally occurring amino acid
  misc_feature (47)..(48): Xaa can be any naturally occurring amino acid
  misc_feature (57)..(57): Xaa can be any naturally occurring amino acid
  unsure (1)..(65): unsure at all Xaa locations
MASSMLSSATMVXSPAQATMVAPLNGLKSSXAFXXTGKXNNGITSIXXNGGRVKCMXVWTTIGKK

SEQ ID NO: 42010 - protein, 367 aa, Triticum aestivum
  misc_feature (203)..(203): Xaa can be any naturally occurring amino acid
  misc_feature (313)..(313): Xaa can be any naturally occurring amino acid
  unsure (1)..(367): unsure at all Xaa locations
MARHHLLLFLPLLALAFSFVVAAPERQGDAAAFIDGASHRYLRDQQEDQATSMSLDEVSAAVSVLLGFAPPAMLPAPSSAKFNKLLLPNPFDRPRSVFLMQLDGSHDYVDCFISDAGSIYKTKIDGAKSAAIELTDKDELIVIRSDESSGLDVLDNELANLATWLAGSYQKADSKLNIPLEEGKQSLLCSPTKEADVEFASSXLISLLKTIKRGIQVHEDFSGGIVSHAELLVCHFTGIKALEDEYGPAEIVKQGAEVVQTALTKAFDQLQGAYNGKIVGLVISAKEASTSLASIIDAPSSLHISRRLAEASXTNATASIAAIYLVRLSLAWITGIILLVSTLIGICLLMNMPLTRDTLLYSNVKMD

SEQ ID NO: 42011 - protein, 434 aa, Streptococcus pneumoniae R6
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 42012 - protein, 375 aa, Blakeslea trispora
MEDEVAALVIDNGSGMCKAGFAGDDAPRAVFPSIVGRPRHQGVMVGMGQKDSYVGDEAQSKRGILTLRYPIEHGIVTNWDDMEKIWHHTFYNELRVAPEEHPVLLTEAPLNPKSNREKMTQIMFETFNAPAFYVAIQAVLSLYASGRTTGIVLDSGDGVTHTVPIYEGYALPHAILRLDMAGRDLTDYLMRILAERGHSFTTTAEREIVRDIKEKLCYVALDFEQEMQTAAQSSALEKSYELPDGQVITVGNERFRAPEALFQPALLGLESVGIHETTYNSIMKCDVDIRKDLYSNIVMSGGTTMYPGIADRMQKEITALAPSSMKIKIVAPPERKYSVWIGGSILASLSTFQQMWISKQEYDESGPSIVHRKCF

SEQ ID NO: 42013 - protein, 833 aa, Acidobacteria bacterium Ellin345
MSMWHASVRRLSKSVLFINRSFISLAIFLGVLAFSSTAAFGQSEAGGEAALKLPDLSSVSFMGVDGHKLLLIGLVFCALGLAFGLAIYMTLKNLPVHRSMLEISELIYETCKTYLTTQGKFILILWAFIAVVIAMYFGWLAPVPNKPIAVTLPVILAFSLVGIAGSYGVAWFGIRVNTFANSRTAFAGLRGKPYSIYEIPLRAGMSIGMMLISVELLIMLCILLFVPADYAGPCFIGFAIGESLGAAALRIAGGIFTKIADIGSDLMKIVFKIKEDDARNPGVIADCTGDNAGDSVGPSADGFETYGVTGVALITFILLGVHDPKVQVQLLVWIFVMRIMMLVSSAGAYFLNTVIAKGRFGNADEMNFETPLTSLVWITSIVSIILTYIVSKMMIPDLSGDTTLWWKLATIISCGTLAGAVIPEFVKVFTSVDSKHVQEVVTSSKEGGASLNILSGLVAGNFSAYWLGLTMVVLMGVGYYVSAWGAAEGHGLGALMLAPAVFAFGLVAFGFLGMGPVTIAVDSYGPVTDNAQSVYELSLIENVPNIEAELKKDFNINVNFERAKHLLEANDGAGNTFKATAKPVLIGTAVVGATTMIFSIIMALTNGLTTDVGKLSLLHAPFVLGLITGGAMIFWFAGASIQAVSTGAYRAVEFIKANIKLEGIEKASVADSKKVVAICTQYAQKGMFNIFLAVFFGTLAFAFFEPFFFIGYLISIAIFGLYEAIFMANAGGAWDNAKKVVEVELKAKGTPLHDATVVGDTVGDPFKDTSSVAMNPVIKFTTLFGLLAVELAVSLEKNGGPLGRILALAFFIVSAFFVWRSFYGMRIGSLKNE

SEQ ID NO: 42014 - protein, 337 aa, Salmonella typhimurium
FFLFDDIRFGASISGSHVAIDDIEGAWNSSTKYEGGNKGHRPGVKGGYFPVPPVDSAQDIRSEMCLVMEQMGLVVEAHHHEVATAGQNEVRTRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 42015 - protein, 127 aa, Methanocaldococcus jannaschii DSM 2661
MDVEDTVKKLNLKFRNIEGERLILAITCDENKNVLMVAFMNEEALKKTLETGYMHYYSTSRKKLWRKGEESGNVQKLIKFYRDCDGDALLFIVEQKGVACHEGYYSCFHYKIEDGELKITGEYYSKR

SEQ ID NO: 42016 - protein, 320 aa, Candida glabrata CBS 138
MAKGEDKIQKSAAQKVSKFGSFTAGGLAACIAVTVTNPIEVVKIRMQLQGELMAANQRIYTNPFQAMGVVFRNEGIRGLQKGLVAAYIYQIALNGSRLGFYEPIRAVMNKTFYPDQESHKVQSVGINVFAGAASGIIGAVMGSPLFLVKTRLQSYSNAIKIGEQTHYTGVWNGLKTIYMTEGVKGLFRGIDAAILRTGAGSSVQLPIYNTAKNFLLRNDIMEDGPSLHLTASTISGLGVAVVMNPWDVILTRIYNQKGDLYKGPIDCLVKTVKIEGITALYKGFEAQVFRIGPHTILCLTFLEQTMKLVHAFESKVLGHN

SEQ ID NO: 42017 - protein, 502 aa, Aspergillus nidulans FGSC A4
MSSSPVPLLKAPVPGNRGSSNSPRPPKLTLGIPPSATSRPVAGNGVPIMSDAPQPQRPSGRPAPPQLRLATPMGSTQDVPPQRNVRPMPPPLATTGLNDANGHSRSGSSTHLDGKGSGPASASSSNYSNLSFAMGGLRQPHGGTPDPSSAISSVYSDREGGVQMERDNSVNGLIPDLDKLSLEKGRALDVEDLDDQGWLAASEQKKIVELGSLGEGAGGAVTRCKLKEGKTVFALKIITTDPNPDVKKQIIRELNFNKDCASEHICRYYGAFMDKSTGTISIAMEFCEGGSLDSIYKEVKKLGGRTGEKVLGKVAEGVLNGLTYLHGRKIIHRDIKPSNILLCRNGQVKLCDFGVSGEFGTKGDANTFIGTSYYMAPERITGQSYTITSDVWSLGVTLLEVAQHRFPFPADGTEMQPRAGLIDLLTYIVRQPIPKLKDEPENGIKWSSNFKYFIECCNSLEKEPPRRATPWRMLEHPWVLDMKNKKVNMANFVKQSFDSTVL

SEQ ID NO: 42018 - protein, 476 aa, Mycobacterium tuberculosis H37Rv
MPTTSMSLRELMLRRRPVSGAPVASGASGNLKRSFGTFQLTMFGVGATIGTGIFFVLAQAVPEAGPGVIVSFIIAGIAAGLAAICYAELASAVPISGSAYSYAYTTLGEAVAMVVAACLLLEYGVATAAVAVGWSGYVNKLLSNLFGFQMPHVLSAAPWDTHPGWVNLPAVILIGLCALLLIRGASESARVNAIMVLIKLGVLGMFMIIAFSAYSADHLKDFVPFGVAGIGSAAGTIFFSYIGLDAVSTAGDEVKDPQKTMPRALIAALVVVTGVYVLVALAALGTQPWQDFAEQETAGLAIILDNVTHGEWASTILAAGAVVSIFTVTLVTMYGQTRILFAMGRDGLLPARFAKVNPRTMTPVHNTVIVAIFASTLAAFIPLDSLADMVSIGTLTAFSVVAVGVIVLRVREPDLPRGFKVPGYPVTPVLSVLACGYILASLHWYTWLAFSGWVAVAVIFYLMWGRHHSALNEEVP

SEQ ID NO: 42019 - protein, 2104 aa, Arabidopsis thaliana
MVDCSDVYISFDRSEDTVRYSFVSHLCAAFRRRGISSFIRENGSDSESNGFSKLETSRASVVVFSEKYSSSKSCMEELVKVSERRRKNCLAVVPVFYPVTKSFMKKQIWNLGDVRSDWPSALLETVDLPGHELYDTQSDSDFVEEIVADVREKLNMSDNIGIYSKLGKIETLIYKQPWGVRSIGIWGMPGIGKTTLAKAAFDQLSGDYEASCFIKDFNKAFHEKGLYGLLEAHFGKILREELGIKSSITRPILLRNVLRHKRVLVVLDDVCKPLDAESFLGGFDWFCPGSLIIITSRDKQVFSICRVDQIYEVPGLNEEEALQLFSRCAFGKEIIHESLQKLSKKVIDYANGNPLALIFFGCMSRKNPKPIEIAFPKVKKYLAHEIHDAVKSTYDSLSSNEKNIFLDIACLFRGENVDCVIHLLEGCGFFPRVEINVLVEKCLVSMAEGRVVMHNLIQSIGRKIINGGKRRSRLWKPLIIKYFLEDRQVLGSEDIEAIFLDPSALSFDVNPMAFENMYNLRYLKICSSNPGNHYALHLPKGVKSLPEELRLLHWEHFPLLSLPQDFNTRNLVILNMCYSKLQRLWEGTKELGMLKRIMLCHSQQLVGIQELQIALNMEVIDLQGCARLQRFLATGHFQHLRVINLSGCIKIKSFPEVPPNIEELYLKQTGIRSIPTVTFSPQDNSFIYDHKDHKFLNREVSSDSQSLSIMVYLDNLKVLDLSQCLELEDIQGIPKNLRKLYLGGTAIKELPSLMHLSELVVLDLENCKRLHKLPMGIGNLSSLAVLNLSGCSELEDIQGIPRNLEELYLAGTAIQEVTSLIKHLSELVVLDLQNCKRLQHLPMEISNLKSLVTLKLTDPSGMSIREVSTSIIQNGISEIGISNLNYLLLTFNENAEQRREYLPRPRLPSSSLHGLVPRFYALVSLSLFNASLMHIPEEICSLPSVVLLDLGRNESVSWGFEQFPSHYTFSDCFNKSPKVARKRVVKGLAKVASIGNEHQQELIKALAFSICGPAGADQATSYNLRAGSFATIEITPSLRKTLLGFAIFVVVSFSDDSHNNAGLGVRCVSRWKTKKRVVTGKAEKVFRCWAPREAPEVQRDHMFVFYEDAEMHRGGGEGNKPNIMADHVEFEFQAVNGRNKVLGGNCMVTECDVCVITAATGAASLSVTNASKDMSLSKNHSPKLSSVIGKLRFKRVGYLDLTSEIKVTPYLRHDRSKGGYADCHKHISCAPTLISAADYSPTEKILLNCGGGASNLTDTDNRIWISDVKSKFLSSSSEDSKTSPALTQDPSVPEVPYMTARVFRSPFTYTFPVASGRKFVRLYFYPNSYDGLNATNSLFSVSFGPYTLLKNFSASQTAEALTYAFIIKEFVVNVEGGTLNMTFTPESAPSNAYAFVNGIEVTSMPDMYSSTDGTLTMVGSSGSVTIDNSTALENVYRLNVGGNDISPSADTGLYRSWYDDQPYIFGAGLGIPETADPNMTIKYPTGTPTYVAPVDVYSTARSMGPTAQINLNYNLTWIFSIDSGFTYLVRLHFCEVSSNITKINQRVFTIYLNNQTAEPEADVIAWTSSNGVPFHKDYVVNPPEGNGQQDLWLALHPNPVNKPEYYDSLLNGVEIFKMNTSDGNLAGTNPIPGPQVTADPSKVLRPTTRKSKSNTAIIAGAASGAVVLALIIGFCVFGAYRRRKRGDYQPASDATSGWLPLSLYGNSHSAGSAKTNTTGSYASSLPSNLCRHFSFAEIKAATKNFDESRVLGVGGFGKVYRGEIDGGTTKVAIKRGNPMSEQGVHEFQTEIEMLSKLRHRHLVSLIGYCEENCEMILVYDYMAHGTMREHLYKTQNPSLPWKQRLEICIGAARGLHYLHTGAKHTIIHRDVKTTNILLDEKWVAKVSDFGLSKTGPTLDHTHVSTVVKGSFGYLDPEYFRRQQLTEKSDVYSFGVVLFEALCARPALNPTLAKEQVSLAEWAPYCYKKGMLDQIVDPYLKGKITPECFKKFAETAMKCVLDQGIERPSMGDVLWNLEFALQLQESAEENGKGVCGDMDMDEIKYDDGNCKGKNDKSSDVYEGNVTDSRSSGIDMSIGGRSLASEDSDGLTPSAVFSQIMNPKGR

SEQ ID NO: 42020 - protein, 255 aa, Triticum aestivum
MAVRVWVSAILLAFLLAASPFAQVARAQSEEDAAMQEVVDGADLGYVGDDTPVSSEEPLSPAPGVETVCAFPKNAGKIVPAGEETELVVGLQNEGESTLNVVAVHSTLHLPYDHKMYGQNLTVQSFYNASVPVSVQATFPYTFAVSKFLQPGAYDLVGYIVYEIDQHPYQNVFYNGTIEVVEVGGLLSVESVFLITLGIALLGLLGLWAYGQVQQLSKKTKKGPKVELGTGTTDANMDEWLEGTAFAKDKAKKNK

SEQ ID NO: 42021 - protein, 479 aa, Zea mays
MGARCSKLSVCWWPPHFKSPMLENGAAGDDGSGVPVFAEYSFDDLRVATDGFAPDRIVSEHGEKAPNVVYRGTLFSSGRTVAIKRFGRSAWPDSRQFLEEARAVGQLRSGRLANLIGCCCESGERLLVAEFMPHETLAKHLFHWETNPLSWAMRMRAALYVAQALDYCSSKGRALYHDLHAYRVVFDVDGNPRLSCFGLMKNSRDGKSYSTNLAFTPPEYLKTGRVSPESVVYSFGTVLLDLLSGKHIPPSHALDLIRGKNFLVLMDSCLEGHVSNSDGTDLMRLASRCLQYEARDRPNLKTVTPSHTLLGIQHDKNNSGQVSLSAIGKAFARADLNEVHEILLHDGYNEDDEANAELSLQSWNGDISESFVVKRRADNAFRSKEYTTAIECYSRFLDSGAVVAPTMLGRRCFAHVVAGNPQEGLEDAKRAEIIASDWPMGHYLQALALHKLGREAESQEALKNGTALEAARNSRARTV

SEQ ID NO: 42022 - protein, 112 aa, Bifidobacterium longum DJO10A
MSESDDCLFCKIIAGQIPSSKVYEDETTYAFNDINPKAKVHVLVVPKKHYANVAELAAGDPTELAHIVSIAQNIADKEFHGAYRLVFNTGLDAGQTVFHVHAHVMTGEKLDE

SEQ ID NO: 42023 - protein, 496 aa, Avicennia marina
MPTRQLFIDGEWREPVQRKRIPIINPANEQTIGDIPAATAEEMDIAVEAARKAFFRNSGKDWSSTTGAHRAKYLRAIAAKIKDRKVELVELEAIDSGKPLEEASLDMDNVIGCFEYFAGIAERLDSEQRTPVSLPMETFKCHLLKEPIGVVGLISPWNYPLLMAIWKVAPALASGCTAILKPSELASVTCLELAEVCMEVGLPPGVLNILTGLGPEAGAPLVTHPHVAKISFTGSDTTGVKIMTAAAQLVKPVTLELGGKSPIVVFEDVDLDTAAEWTLFGCFWTNGQICSATSRLLVHESIATTFLEKLVKWCEKIKISDPLEEGCRLGPIVSRRQYEKVMKYISTAKEEGATILCGGARPEHLEKGYFVQPTIITDVKTSMQIWIEEVFGPVLCVKTFATEDEAVELANDTHYGLAAAVISKDLDRCERMAKAFQVGAVWVNCSQPCFYQAPWGGKKRSGFGRELGERGLDIYLNVKQVTRYVSSEPWGWYKSP

SEQ ID NO: 42024 - protein, 424 aa, Oceanicola granulosus HTCC2516
MSTIIDIHAREILDSRGNPTIEVDVTLEDGTMGRAAVPSGASTGAYEAVEKRDGDKGRYKGKGVLEAVAAVNGEIAETILGADATDQVEIDLAMIELDGTDNKARLGANAILGVSLATAKAAAIYSGQPLFRYVGGTSARMLPVPMMNIINGGEHADNPIDIQEFMIMPVAATSIAEAVRFGSEVFHTLKKELSDAGLSTGLGDEGGFAPNLGSTREALDFILKSIEKAGFTPGDDIHLALDCAATEYFKNGVYDMVGEGKKLSPEENVAYLEALVKDYPIISIEDGCSEDDWDGWVALNAALGERCQLVGDDLFVTNPKRLKMGIEKRAANSMLVKVNQIGSLTETLQAVEMAHRAGMTNVMSHRSGETEDATIADLAVATNCGQIKTGSLARSDRLAKYNQLIRIEEMLGSAAEYAGRSILR

SEQ ID NO: 42025 - protein, 532 aa, Oryza sativa (japonica cultivar-group)
MAAIGNMNLFDLFFVLQLLLSGVCVLVICYRYQRLKSMKKCSLGVVQWPIVGVLPAIVANMHRLLDGVTFLLATSQLNFQCRFWLAGFRFFVTCDPDNVRHIFTSNFDNYPKGDVFADMFDVLGGGIFNTDGERWRRQRNKAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPERWITEDGKLRYVPSNKFVAFNSGPRTCLGKEMALVQMKVTAAAMAWNFAVEVVPGHVVEPRLSVILHMKNGLLEYIGFI

SEQ ID NO: 42026 - protein, 567 aa, Streptococcus pneumoniae R6
MALEVIMPKAGVDMTEGQIVQWNKKVGEFVKEGEILLEIMTDKVSMELEAEEDGYLIAILKGDGETVPVTEVIGYLGEERENIPTAGAASPEASPVPVASTSNDDGKSDDAFDIVVIGGGPAGYVAAIKAAQFGGKVALVEKSELGGTCLNRGCIPTKTYLHNAEIIENIGHAANRGIVIENPNFTVDMEKLLETKSKVVNTLVGGVAGLLRSYGVTVHKGIGTITKDKNVLVNGSELLETKKIILAGGSKVSKINVPGMESPLVMTSDDILEMNEVPESLVIIGGGVVGIELGQAFMTFGSKVTVIEMMDRIVPAMDVEVSKNLRLILERKGMTILTGTKLQEIIEENGQLRIKVEGKDDIIASKALLSIGRMPDLEGIGEVEFELDRGCIKVNEYMETSVPGIYAPGDINGTKMLAHAAFRMGEVSAENALKGNHAVAKLNLTPAAIYTLPEVAAVGLTEEQAREKYDVAIGKFNFAANGRAIASDAAQGFVKVIADKKYGEILGVHIIGPAAAELINEASSIIEMEITVEEMLKTIHGHPTYSEVMYEAFADVLGMAIHSPKKK

SEQ ID NO: 42027 - protein, 375 aa, Streptococcus pneumoniae R6
MASSKPSSISYFSVAFDALCIINRIGEVMADDKLRATPAARKLADDLGINLYDVSGSGANGRVHKEDVETYKDTNVVRISPLAKRIALEHNIAWQEIQGTGHRGKIMKKDVLALLPENIENDSIKSPAQIEKVEEVPDNVTPYGKIERIPMTPMRKVIAQRMVESYLTAPTFTLNYEVDMTEMLALRKKVLEPIMEATGKKTTVTDLLSLAVVKTLMKHPYINASLTEDGKTIITHNYVNLAMAVGMDNGLMTPVVYNAEKMSLSELVVAFKDVIGRTLDGKLAPSELQNSTFTISNLGMFGVQSFGPIINQPNSAILGVSSTIEKPVVVNGEIVIRPIMSLGLTIDHRVVDGMAGAKFMKDLKELIETPISMLI

SEQ ID NO: 42028 - protein, 661 aa, Treponema pallidum subsp. pallidum str. Nichols
  misc_feature (634)..(634): Xaa can be any naturally occurring amino acid
  unsure (1)..(661): unsure at all Xaa locations
MTEEAMRAMALSIRSLTIDAIERANSGHPGLPLGAAELAACLYGTILKHNPANPSWFNRDRFVLSAGHGSMLLYAALHLSGYDVSLEDIKNFRQVGSRCPGHPEYGCTPGVEATTGPLGQGISMAVGFALAEAMLAARFNTDEHAVVDHHTYALVGEGCLMEGVASEASSFAGTMRLGKLIVFYDENHISIDGSTDLTFSEDVAKRYEAYGWQVLRGSMYSYTDIMDLTACAKRDDRPSLIILRSIIGKGAPTVEGSARAHGAPLGEAGVREAKKALGLDPACSFFVAPELTAVLQKRKCECAHVEDSWNELFEAWSTQYPEKRADWDAAFVPGGVSTSQLARVVCPHFEKGSSLATRTASGKVLDALCSVLPNLVGGSADLRGPNAVAVSSLRPFSAEHRAGGYCYFGVREFAMAAIVNGMQLHGGLRAFGATFMVFSDYFRPALRLAALMRIPSVFVLTHDSIFVGEDGPTHQPVETLAALRAIPNVLVLRPADAEETFEAWKIALLHRSGPVCIVLSRQNVPVFEKSDSSWRSTVEESGAYVVREGGATPELTVLASGSEVDLALRAAQLSKRRVRVVSVLCKERFEAAGDEVQRRIQGGARVVVAEAGVYQGWGAWAKREKCLVLDRFGXSGPGTQVAQALEFTAEALVEIILDWLA

SEQ ID NO: 42029 - protein, 330 aa, Streptococcus pneumoniae R6
METKTMSFRDTIILAMSEEMRRDENVFLMGEDVGVFGGDFGTSVGMLEEFGPERVRDCPISEAAISGAAAGAAMTGLRPIVDMTFMDFSVIAMDNIVNQAAKTRYMFGGKGQVPMTVRCAAGNGVGSAAQHSQSLESWFTHIPGLKVVAPGTPADMKGLLKSSIRDNNPVIILEYKSEFNQKGEVPVDPDYTIPLGVGEIKRQGTDVTVVTYGKMLRRVVQAAEELAEEGISVEIVDPRTLVPLDKDIIINSVKKTGKVILVNDAHKTSGYIGEISAIISESEAFDYLDAPIRRCAGEDVPMPYAQNLENAMIPTVESIKDAIRKTYNKD

SEQ ID NO: 42030 - protein, 322 aa, Streptococcus pneumoniae R6
MSTLDKNLLLEMFRKMEEIRRMDLKIAQLVKKGKVPGMTHFSVGEEAANVGAMLALNPDDLITSNHRGHGQAIAKGIDLNGMMAEILGKYTGTCKGKGGSMHIADLDAGNLGANGIVGGGMGIAVGAALSQQMQNTGKIVVCFFGDGATNEGVFHEAVNMASIWNLPVIFYCINNGYGISADIKKMTNIEHIHQRSAAYGIPGMFIEDGNNVIDVYEGFQKAVDHVRSGNGPVLIESVTYRWLGHSSSDPGKYRTREEVELWKQKDPIENLRNYLIENNIASAEELEKIQAQVKEAVEASVKFAEESPFPPLESAFEDIYTD

SEQ ID NO: 42031 - protein, 374 aa, Pseudomonas putida
MAKRDYYEVLGVERGANEGDLKKAYRRLAMKYHPDRNPGDKESEEQFKEANEAYEVLSDASKRAAYDQYGHAGVDPSMGGGGAGFGGANFSDIFGDVFSDFFGGGRGGSRGGAQRGSDLRYTLELNLEEAVRGTTVSIRVPTLFNCNPCDGCGANKGSTPSTCPTCGGIGQVRMQQGFFSVQQTCPRCHGQGKIITDPCGACHGEGRVEEYKTLSVKVPAGVDTGDRIRLSGEGEAGTHGGPTGDLYVVINVREHEIFQRDGKHLYCEVPISYTDAALGGELEVPTLDGRVKLKIPEGTQTGKQFRLRGKGVAPVRGGGAGDLLCRVAVETPVNLSRRQRELLEELRDSLEGDSSHSPKANGWFDGVKRFFGDL

SEQ ID NO: 42032 - protein, 449 aa, Listeria monocytogenes str. 4b F2365
MEKHYDYIAIGGGSGGIASINRAAMHGAKCALIEPKFLGGTCVNVGCVPKKVMWYGAQIKEAMDLYADAYGYQVDASFNFQKLVENREAYIERIRGSYKNGLDNNKVEWIKGYAEFVDEKTLRVNGELVTADHILIATGGEPALPSIPGAEFGITSDGFFALKELPKKVAVVGAGYIAVELAGVLQQLGSETHLFVRKHAPLRNFDPLLTDTLTEIIEQSDMMLHKHAVPQKVEKNPDGSLTLSLEDGRTETVDTLIWAIGRKPVIQGLQIEKAGVKLLESGHIAVDKFQNTNVAGIYAVGDVTGHYELTPVAIAAGRRLSERLFNNKKDAHLNYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 42033 - protein, 115 aa, Arabidopsis thaliana
MVHSTYHVSFCTAQCLYISECGRGTLRLKTKMADTGKGSSVAGCNDSCGCPSPCPGGNSCRCRMREASAGDQGHMVCPCGEHCGCNPCNCPKTQTQTSAKGCTCGEGCTCASCAT

SEQ ID NO: 42034 - protein, 664 aa, Arabidopsis thaliana
FVFTNFLIFLISLDSVTAQEICFSGFFKPNSTYDLNRRQILSTLSSNVTSHNGFFNSKFGQAPNRVFINGMCIPGTKPETCSDCIKGASDKISESCPNKTDAYTWPDCCMVRYSNVSFSGSLVMEPSETLYHTGDIEDTGTNLTVFDRIWEELMLRTITAASLSSSNGSSFGQKYFAAEVASLTTFQTMYAMMQCTPDVSSKDCEFCLKTSVGDYESCCRGKQGGAVIRPSCFVRWDLYPYAGAFENVTFPPPPPQSLPQPPVSLIPPPVSDRANTTIKGIIVAIVVPIIVILVSLVVLLVVCRRKKSYKTTEVQATDEITTTHSLQFSFKTIEAATDKFSDSNMIGRGGFGEVYRGKLSSGPEVAVKRLSKTSGQGAEEFKNEAVLVSKLQHKNLVRLLGFCLEGEEKILVYEFVPNKSLDYFLFDPAKQGELDWTRRYNIIGGIARGILYLHQDSRLTIIHRDLKASNILLDADMNPKIADFGMARIFGVDQSQANTRRIAGTFGYMSPEYAMRGHFSMKSDVYSFGVLVLEIISGKKNSSFYNIDDSGSNLVTHAWRLWRNGSPLELVDPTIGESYQSSEATRCIHIALLCVQEDPADRPLLPAIIMMLTSSTTTLHVPRAPGFCLSGRDLEQDGVEYTESTSRSIPGSINDASITEFYPR

SEQ ID NO: 42035 - protein, 488 aa, Listeria monocytogenes str. 4b F2365
MSIKETALPKVQTKLFINGKWTDGDNKETKDIVNPANGEVIAKIAQAGPNETKKAIKAAKEAFPDWAKMELADRVKLLHKIADLMEEKADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSAETLKKISLELGGHAPFIVFDDANLDAAVNDLVAAKFRNNGQVCVSPNRIFVAKEIKEKFTKALVAKVEQLKVGNGLDDVNVGPLIREDAIDKIDKQLKNATDKGAKVLTGGGRLTGSDYDKGNFYKPTVLDNVTREMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 42036 - protein, 178 aa, Aspergillus fumigatus
FHQTPSAMSQVFFDVEYAPVGTAETKVGRIVFNLFDKDVPKTAKNFRELCKRPAGEGYRESTFHRIIPNFMIQGGDFTRGNGTGGRSIYGDKFADENFSRKHDKKGILSMANAGPNTNGSQFFITTAVTSWLDGKHVVFGEVADEKSYSVVKEIEALGSSSGSVRSNTRPKIVNCGEL

SEQ ID NO: 42037 - protein, 421 aa, Ehrlichia canis str. Jake
MSNITINKILARQILDSRGYPTIEAEVILSNNTKAKACVPSGASVGKFEAVELRDNDKNYYNGYGVTKAVNIINSEIAPQIIGMNTLNQEKIDNTLIKIDGTDNKSRIGANSTLAVSLAIAKAAASTLNIPLYQYIGGINAKVLPTPLINVINGGMHADNNLDFQEFMIIPNGANKFEDAMRMSAEVFFKLKQILKSKQYNTSVGDEGGFAPNIKTNNEVFEIIIDAIEKSGYKMYKDFSLGLDVAASTFYKDQKYKFADYEFNTQELVEYYKNITSQYPIISLEDPIAEEDTNGWKLITQELGNKIQIVGDDLFVTNCKLIQNGIQNNLANAVLIKPNQIGTLTETFNAIRLAQKNNYNTIISHRSGETEDTTISHIAVAANCGQIKTGSLSRSERLAKYNELLYIEKQLDISAIYYGAL

SEQ ID NO: 42038 - protein, 789 aa, Hordeum vulgare subsp. vulgare
MKMMAMAEAPCLCARPFLAARAWRPGPAPRLRRWRPNATAGKGVGEVCAAAVEAATKAEEEEDEEEEPVAEDRYALGGACRVLAGMPAPLGATALAGGVNFAVYSGGATAAALCLFTPEDLKADRVSEEVPLDPLMNRTGDVWHVFLEGELHGMLYGYRFDGTFAPHCGHYFDVSNVVVDPYAKAVISREEYGVPAHGNNCWPQMAGMIPLPYSTFDWEGDLPLRYPQKDLVIYEMHLRGFTKHDSSNVEHPGTFIGAVSKLDYLKELGVNCIELMPCHEFNELEYATSSSKMNFWGYSTINFFSPMTRYTSGGIKNCGRDGINEFKTFVRESHKRGIEVILDVVFNHTAEGNENGPILSFRGVDNTTYYMLAPKGEFYNYSGCGNTFNCNHPVVRQFIVDCLRYWVMEMHIDGFRFDLASIMTRGSSLWDPINVYGAPIEGDMITTGTPLVTPPLIDMISNDPILGGVKLIAEAWDAGGLYQVGQFPHWNVWSEWNGKYRDIVRQFIKGTDGFAGGFAECLCGSPQLYQAGGRKPWHSINFVCAHDGFTLADLVTYNNKYNLPNGEDNRDGENHNLSWNCGEEGEFARSSVKRLRKRQMRNFFVCLMVSQGVPMFYMGDEYGHTKGGNNNTYCHDSYVNYFRWDKKEEHSDLHRFCCLMTKFRKECEGLGLEDFPTAEQLQWHGHQPGKPDWSEKSRFVAFSMKDETKGEIYVAFNTSHLAAVVELPERIGHRWEPVVDTGKPAPYDFLTDDLPDRALTVQQFSHFLNSNLYPMLSYTSVILVSRPDV

SEQ ID NO: 42039 - protein, 463 aa, Thermobifida fusca YX
MSNDHLPEFPAGFWFGAATASYQIEGAVHADGRGPSIWDTYSHTPGLVLNGDTGDVACDHYHRYPEDVELLRRLGVDAYRFSIAWPRVMPTGSGDVNQRGLDFYDRLVDALLEAGITPVPTLYHWDLPQALEDAGGWRSRSTAEHFAAYTRAVVARLGDRIRHWITLNEPFCSAFLGYAVGRHAPGAREGTPALAAAHHLLLAHGLAVQELRAADAGEVGITLNPDRILPASDSAADRAAADRAETLHNRVWFDPLFAGRYPANEADVWGELADGSYRRDGDLEIIGQPLDFLGINYYRPLKVADGPLTEADPARRTAVDIRAHQQRFDGVRHTAMDWPVVPESFTDLLLDLTERYPNLPPIYITENGSAEHDVVSPDGRVHDTDRIAYLNDHLHALAAAIRAGVDVRGYFVWSLLDNFEWAFGYERRFGIVRVDYDTLERLPKDSYFWYQRLIEHHRARHRG

SEQ ID NO: 42040 - protein, 428 aa, Hordeum vulgare
MKMMAMAEAPCLCARPFLAARAWRPGPAPRLRRWRPNATAGKGVGEVCAAAVEAATKAEEEEDEEEEPVAEDRYALGGACRVLAGMPAPLGATALAGGVNFAVYSGGATAAALCLFTPEDLKADRVSEEVPLDPLMNRTGDVWHVFLEGELHGMLYGYRFDGTFAPHCGHYFDVSNVVVDPYAKAVISREEYGVPAHGNNCWPQMAGMIPLPYSTPDWEGDLPLRYPQKDLVIYEMHLRGFTKHDSSNVEHPGTFIGAVSKLDYLKELGVNCIELMPCHEFNELEYATSSSKMNFWGYSTINFFSPMTRYTSGGIKNCGRDGINEFKTFVRESHKRGIEVILDVVFNHTAEGNENGPILSFRGVDNTTYYMLAPKGEFYNYSGCGNTFNCNHPVVRQFIVDCLRYWVMEMHIDGFRFDLASIMTRGSR

SEQ ID NO: 42041 - protein, 419 aa, Mycobacterium leprae
MPPWQRWAAADRFGAMREVPQVLGIVLAGGEGKRLYPLTADRAKPAVPFGGAYRLVDFVLSNLVNARYLRICVLTQYKSHSLDRHISQNWRLSGLAGEYITPVPAQQRFGPHWYTGSADAIYQSLNLIYDEDPDYLVVFGADHVYRMDPEQMLRFHIGSGAGATVAGIRVPRSDATAFGCIDADDSGRIRRFTEKPLKPPGTPDDPDKTFVSMGNYIFTTKVLVDAIRADADDDHSYHDMGGDILPRLVDGGMAAVYDFSQNEVPGATDWDRAYWRDVGTLDAFYDAHMDLVSLRPVFNLYNKRWPIRGESENLAPAKFVNGGSVQESVVGAGSIISAASVRNSVLSSNVVVDNGAIVEGSVIMPGARVGRGAVIRHAILDKNVVVGPGEMVGVDPERDREHFAISAGGVVVVGKGVWI

SEQ ID NO: 42042 - protein, 332 aa, Guillardia theta
QTPSAEEMFKAIPEISKGKNIATREAGSIVINHISDLVPQFLSGSADLHGSNKNYIKNGGNFGRGFDKTYAGKNFYFGIREHGMGAIMNGISFHGLFRPSGATFLVFVDYMRATIRVAALAELPTTYILTHDSIGVGEDGPTHQPVETVSSLRVFPNLDVIRPADPEETVGAYVHSQQRQDGPTAIILTRQNVKTLDEIPVQTRREGVLKGAYVAKKESGALKMIIMASGSEVQHAMAAAEQLGDGIRVVSMPSMNLFNKQSKEYRDSVLPPSCLKRVAMEAGVGSMWYQYVGLDGKVVSVERFGFSAPGDIVMSELGMTAENLIKECKAYM

SEQ ID NO: 42043 - protein, 344 aa, Hordeum vulgare
MKMMAMAEAPCLCARPFLAARAWRPGPAPRLRRWRPNATAGKGVGEVCAAAVEAATKAEEEEDEEEEPVAEDRYALGGACRVLAGMPAPLGATALAGGVNFAVYSGGATAAALCLFTPEDLKADRVSEEVPLDPLMNRTGDVWHVFLEGELHGMLYGYRFDGTFAPHCGHYFDVSNVVVDPYAKAVISREEYGVPAHGNNCWPQMAGMIPLPYSTFDWEGDLPLRYPQKDLVIYEMHLRGFTKHDSSNVEHPGTFIGAVSKLDYLKELGVNCIELMPCHEFNELEYATSSSKMNFWGYSTINFFSPMTRYTSGGIKNCGRDGINEFKTFVRESHKRGQQQYILP

SEQ ID NO: 42044 - protein, 680 aa, Oryza sativa
MLVLLLLLAAAVSSPAPAAGDGGGALPVLNPISSFCNTTAARRTYLPNSTFEANLNGLFAVLSRNASASGYAAGAFGAAPDTAYGLLLCRGDFTGNDCSAARLASSFQQAASSCLYSKDVAVYYDQYQLRYSDQDFLAGAGAGAANEPETAAFNMNNVSDAGDVAAFDALVAELVNAVADRASNATRRYAAGKAGFAPEAMTVYAIAQCTPDLSPPQCRGCLAGIIDQMPKWFSGRVGGRILGVRCDFRYEKDPFFKIPNDMVVLSPLPDPSSQGSSSSGGLWIVAIVVPVAVLLLGFLGCFLWIRRRRRRAESVINMAGTVSVPTMSMEMEQVLKLWRIEESGSEFSLYDFDQIADATDNFSDACKLGQGGFGPVYKGQLPDGLEIAIKRLSSCSVQGLMEFKTEIQLIAKLQHTNLVRLLGCCVQADEKMLIYEYMHNKSLDCFIFDTEKGAMLNWDKRFRIIDGIAQGLLYLHKHSRLRVIHRDLKASNILLDREMNPKISDFGMARIFCSNVTEANTTRVVGTHGYIAPEYASEGLFSIKSDVFSFGVLLLEIISGKRTAGFYQYGKFFNLTGYAYQLWQEGQWHELVDQALGEDFPAMEVMKCVQVALLCVQDSADDRPNMSDVIAMLGSEGVTMPEPRQPAYFNVRISSLAVSSSSFGESYCMSNVTLMEEDGR

SEQ ID NO: 42045 - protein, 1143 aa, Mycobacterium sp. JLS
MFVESVGAHDEAIYSASDLAAAARCEYALLRSFDARLGWGPSVATEDELLARTADLGDEHEKRHLDTLRTDSDHNVTVIGRPPYTVAGLTAAAEATTRAVARRAPVIYQAAMFDGRFAGFADFLILEGDRYLLRDTKLARSVKVEALLQLAAYAEALTAAGVPVADEVELVLGDGATARYPLEELLPVYRPRRAALQRLLDDHLAGGTPVRWEDETVRACFRCPECSIEVRAQDDLLLVAGMRVSQRARFHEAGITTVAELAAHQGPVPELPARTVTALSAQARLQTAPRVDGKPPYEVADPQPLMLLPEPDKGDLFFDFEGDPLWTDDGHEWGLEYLFGVLDTADGFHPLWAHDRPQERKALEDFLELVRKRRKRHPNMHIYHYAAYEKTALLRLAGRYGVGEDAVDDLLRSGVLVDLYPLVRKSFRIGTENYSLKSLEPLYMGGQLRTGDVTTAAASITEYARYCELRAEGRDDDAAVVLKDIEDYNRYDCTSTRKLRDWLVCRAIDCEVPPRGPQPVRDGAEPEPVDALDRTLCRYAGDELEGRTPEQSAVAMVAAARGYHRREDKPFWWSHFDRLNNPVDEWADSTDVFLVDPGGAQVEVDWHTPPRARKPQRRVRLSGAMAAGGLSRDMYALYEPPAPAGLGDDPDRRAAGSVTVVECNAPDVPTEVVVVERTPRDGGVFDQLPFALAPGPPIRTTALRESIEATAADLAERLPRLPETAVTDILLRRPPRTRSGAPLPTGPDVSAAITAALLDLDSSYLAVHGPPGTGKTFTAAAIIATLVNTHGWRIGVVAQSHAVVENLFRGVMDAGVDAARVAKKRGHGDDANWTVLEEAGFPGFVADRDGCVIGGTAWDFANGNRIPRGCLDLLVIEEAGQFCLANTIAVAPAAANLLLLGDPQQLPQVSQGTHPEPVDTSALGWLVDGAHTLSAERGYFLDVSWRMHPAVCAAVSRLSYDGRLQSNEAVTTARTLEGWSPGVHEVTVPHDGNATESPEEADAIIARIGRLLGSVWTDEKGSRPLAQDDVMVVTPYNAQVVLLRQRLDAERLTDVRVGTVDKFQGQQAPVVFISMVASSIDDVPRGISFLLNRNRLNVAISRAKYAAVVVRSEALTEYLPSTPKGLVELGAFLSLSQSPSRRE

SEQ ID NO: 42046 - protein, 327 aa, Solanum demissum
MASDSIIPPLLLPDELITEILLKLPIKSLLKFMCVSKSWLQLISSPAFVKNHIKLTADDKGYIYHRLIFRNTNDDFKFCPLPPLFTQQQLIKELYHIDSPIERTTLSTHIVGSVNGLICAAHVRQREAYIWNPTITKSKELPKSRSNLCSDGIKCGFGYDESRDDYKVVFIDYPIHRHNHRTVVNIYSLRTKSWTTLHDQLQGFFLLNLHGRFVNGKLYWTSSSCINNYKVCNITSFDLADGTWERLELPSCGKDNSYINVGVVGSDLSLLYTCQRGAATSDVWIMKHSGVNVSWTKLFTIKYPQNIKIHRCAAPAFTFIHQRYCYL

SEQ ID NO: 42047 - protein, 372 aa, Solanum demissum
MAESIISVLPHEIIIEILLKVPPKSLLKFMCVSKTWLELISSAKFIKTHLELIANDKEYSHHRIIFQESACNFKVCCLPSMLNKERSTELFDIGSPMENPTIYTWIVGSVNGLICLYSKIEETVLWNPAVKKSKKLPTLGAKLRNGCSYYLKYGFGYDETRDDYKVVVIQCIYEDSGSCDSVVNIYSLKADSWRTINKFQGNFLVNSPGKFVNGKIYWALSADVDTFNMCNIISLDLADETWRRLELPDSYGKGSYPLALGVVGSHLSVLCLNCIEGTNSDVWIRKDCGVEVSWTKIFTVDHPKDLGEFIFFTSIFSVPCYQSNKDEILLLLPPVILTYNGSTRQVEVVDRFEECAAAEIYVESLVDPLLIS

SEQ ID NO: 42048 - protein, 374 aa, Trichodesmium erythraeum IMS101
MARDYYEILGVSRSADKEELKRAYRRLARKYHPDVNKEPGSEERFKEINRAYEILSDPEMKARFDRFGEAGVSGGAASGFSTDFSDSFADIFESFFSGFGGAGTQGRRRTGPVRGDDLRLDLNLEFIEAIFGGDKELTIKHLETCGTCNGSGAKPGTKPQTCSTCGGTGQVRRATRTPFSSFTQVSVCPSCNGSGQIIEEKCVDCGGRGQKEATKKIKITIPGGVDNGTRLRVSNEGDAGRMGGPPGDLYVFLSVKNHPEFQRDGINIISQIKISYLQAILGCCLEINTVDGKTELTIPSGTQPNAILTLEDKGVPRLGNSVSRGAHLITIEIDIPTKITPEEKELLEKLAKIKGERTGKGGIEGFLGSWFQQK

SEQ ID NO: 42049 - protein, 418 aa, Triticum aestivum
MVLQTAQQEPSLTRPPHCSVASARSPAAMDTSPATPLLLQPPAPSIDPFAAKAAVNKGGGAATAVYDLRREPKIPAPFVWPHAEVAPHHGPGAGRARWWTWACCAMATPRGSGRAVAQVAAACATHGFFQVSGHGVDEALARAALDGASGFFRLPLAEKQRARRVPGTVSGYTSAHADRFASKLPWKETLSFGFHDRAGAAPVVVDYFTSTLGPDYEPMGRVYQEYCGKMKELSLRIMELLELSQGVEKRGYYREFFADSSSIMRCNYYPPCPEPERTLGTGPHCDPTALTILLQDDVGGLEVLVDGDWRPVRPVPGAMVINIGDTFMALSNGRYKSCLHRAVVNRRQERRSLAFFLCPREDRVVRPPPGLRSPRRYPDFTWADLMRFTQRHYRADTRTLDAFTQWFSSSSSSAQEAA

SEQ ID NO: 42050 - protein, 347 aa, Bifidobacterium longum DJO10A
MSEPVVLGIESTCDETAAAIVRGRELLSNVVASSMEEHARYGGVIPEIASRAHAEAFVPCVSKALADANMTLADVDAIAVSAGPGLAGCLAVGVSGAKALAWAANKPIYGINHVIGHIAVTQLQFGPFPKDTLALIVSGGHTSLLHVEDMPRKIDVVGTTLDDAAGECFDKVARLLGFPYPGGPHIDRHGQNGDPHAIKVPMGLTQGKAGAAHPYDFSFSGVKTAVARWVESEQAAGHEIPVDDVCASLADSVATVLARKAMRGCRQYDSNTLIVGGGFSANSQLRAKLLEFGEKYGVDVRIPQIKLCTDNGAMVAMLGVNLVEAGVAPSAPDFPIDSAMPLTKVSM

SEQ ID NO: 42051 - protein, 219 aa, Haemophilus somnus 2336
MDQLSMKKMAAQAALQYVKPDSIIGVGSGSTVNCFIEVLGTIKETIKGAVAASKASEELLLRQGIEVFSANDVSGLDIYVDGADEINPQKMMIKGGGAALTREKIVAALAKKFICIVDSSKQVDVLGSTFALPIEVIPMARSQVARKLVALGGSPEYRENVVTDNGNVILDVYNFKIMNPIEMEKELNNVAGVVTNGIFALRSADIVIVGTPEGTKIIG

SEQ ID NO: 42052 - protein, 220 aa, Methanocaldococcus jannaschii DSM 2661
MICLPVVEDSVEKAIKTAEKYLEIADIVEFRIDMLKEVSEEDIEKFAKYPCIITVRADWEGGYWKGNNEERLNLIKKAIECNAKFVDIELREEKNKELVKFRDEIGSKTKIIISYHDFEKTPSKEKLVEIVEKALSIGDIAKFATMANSKEDVLNILEVINKYPGKIIGIGMGEKGKLTRILGVYFGSILTFASYKGKSSAPGQVDIDTLKEIWRLMDLK

SEQ ID NO: 42053 - protein, 370 aa, Oceanicola granulosus HTCC2516
MRTRAAVATAAGKPLEIMDVNLEGPRAGEVLVEVKATGICHTDEFTRSGADPEGLFPAILGHEGAGVVVEVGAGVTSLKPGDHVIPLYTPECRECEYCLNPKTNLCQSIRSTQGQGLMPDGTSRFSTLDGDPILHYMGCSTFANHTVLPEIALAKVREDAPFDKICYIGCGVTTGIGAVINTAKVEIGSRAIVFGLGGIGLNVIQGLRLAGADQIVGVDLNDDKQQMAERFGMTDFVNPSEVEGDLVAYLVHLTKGGADYTFDATGNVDVMRTALESAHKGWGESIIIGVAPAGAEISTRPFQLVTGRSWRGTAFGGARGRTDVPRIVDWYMDGKIDIDPMITHTMGLDEINKGFDLMHEGKSIRSVVVY

SEQ ID NO: 42054 - protein, 279 aa, Arabidopsis thaliana
  misc_feature (231)..(231): Xaa can be any naturally occurring amino acid
  unsure (1)..(279): unsure at all Xaa locations
MATSLQTKYTLNPITNNIPRSHRPSFLRVTSTTNSQPNHEMKLVVEQRLVNPPLSNDPTLQSTWTHRLWVAAGCTTVFVSFSKSIIGAFGSHLWLEPSLAGFAGYILADLGSGVYHWATDNYGDESTPLVGIHIEDSQDHHKCPWTITKRQFANNLHFMARGTTLIVLPLDLAFDDHVVHGFVSMFAFCVLFCQLFHAWAHGTKSKLPPLVVGLQDIGLLVSRIHHMNHHXAPYNNNYCVVSGVWNKVLDESNVFKAMEMVLYIQLGVRPRSWTEPNYE

SEQ ID NO: 42055 - protein, 475 aa, Acidobacteria bacterium Ellin345
MTELRNFLALPYDELEELNLKAKEQRMKRVAADKIQEERLKYLTDEKRIKAVTVLFSDLEGRLHMLDYDKKFLLKSYDNLTFDGSSIRGFTAQRESDLRLYIDWSAFYWGPADIFGPGKVLVFGEVISKEGKHYEADVRGVLKTFSETLHKKEGYTLNAANEIEGFLFKGEDAERRFHDTHAFEYVNTGGYYHSLPGDPLRTFIDTTAEVQRSMGFQNEKDHPEVAPSQFEINYSYGEVVAAADQIQLYKLICRQVATKMGLSASFLPKPVVGVNGSGMHTNVSISKGGKNLFWDPKGEEQLSSFGWSFVDRILTHGNDICLMLNASVNAYRRLDPHFEAPNQIKASPTDRGSMVRIPIGNEKSMRVEVRSVGPDANPYMVMYSVFKTGLHGEIAKIKNLRQAERYLPDNIYTALEHFRLADWTTKLLGADVKGRYADLKQASADRCARLLGTVVKAPEVQFHHDVYNQYLWNQF

SEQ ID NO: 42056 - protein, 418 aa, Zea mays
MKVELAAQTSQTSTPLPPSPEAASASPPAEDAPLLPDAGVRRRAACGRFAQRSGSFRREVGRAAAETFLLTRLTLILLRYLGIGYRWIRQFLALCCYTLLLMPGFIQVVYYYFFSSQVHRSVVYGDQPRNRLDLYMPTSTTGLKPVVAFVTGGAWIIGYKGWGALLGRRLAERGIIVACIDYRNFPQGTIGDMVEDASQGIAFVCKNITSYGGDPSRIYLVGQSAGAHIAACALLNQAIRESGEGDTSSWSVSQLKAYFGISGGYNLLNLVDHFHRRGLYRSIFLSIMEGEVSLQKFSPQMMIMESSARSAVSLLPRIILFHGTSDYSIPPAESQAFADALQQQGARADLFLYEGKTHTDLFLQDPLRGGRDKMLEEIARVIHSEDPDAAAQHLVVVPVARHLVPEFMLKLAGRVSPF

SEQ ID NO: 42057 - protein, 218 aa, Zea mays
MALLLWQTLKEAIHAYTGLSPVVFFTALALAFSIYQVVSGWFASPFDDVRRHQRARSSAAEEAPPIPQPVQVGEITEEELKQYDGSDPQKPLLMAIKHQIYDVTQSRMFYGPGGPYALFAGKDASRALAKMSFEEKDLTWDISGLGPFELEALQDWEYKFKSKYATVGTVKVTVSEAETASVSEPAETDDGDAHVIKQEPTVVDKNLETPAESDVKNE

SEQ ID NO: 42058 - protein, 263 aa, Guillardia theta
ALTSKDINNLTYEEVKGTGIANRCPEVESNGEDIVLQQNTKYKITDLCIEPKSFQIETEVQKKRGESRREFVDTKLVTRATYSLAGVEGPLFYDKDGSLTFQEKEGLDYAATTVQLPGGERVPFFFTIKELVAKATAPKGISPGTEFGGTFTVPSYRSGLFLDPKGRGATTGYDMAQALPAFEADGNEGQAELFKENNKVFQVTDGSMEFAVNKVDGQTGEFSGVFVSEQLSDTDMGSKAPKKVLIKGIVYGKVSTASGDEGY

SEQ ID NO: 42059 - protein, 277 aa, Setaria italica
MESQVFYRALMLSAVGGLSTAIGALFVVLNPAPNLKMLGLLQGFAAGLMLSISFLDLAHNAMNSIGFLKGNLWFFAGVLFFGFIVKFIPEPDFSPEADPSEKKADDGGSGKDMMRKHRRQVLFSGIITAVGISLHNFPEGMAVFLGSVKGLHVGLNLAVAIALHNIPEGVAVALPIYFATKSKWKAFYMAAGSGLAEPVGVIAVAYLFPSSLNPDILEGLLGSVGGVMAFLTLHEMLPLAFDYCGQKRAVKAVFVGMACMSASLYFLEISLPKEISL

SEQ ID NO: 42060 - protein, 272 aa, Pseudomonas syringae pv. tomato
MSDFEQLFAGKLPKLIMFDLDGTLVDSVPDLAVAVDTMLAELGRPTAGLESVRAWVGNGAPVLVRRALANNLDHSGVDEALAERGLDIFMRAYAEKHEFTVVYPGVRETLKWLQKMGVEMALITNKPERFVAPLLDEMKLGRFFRWIIGGDTMPQKKPDPAALFFVMKMAGVPASQSLFVGDSRSDVQAAKAAGVACVALSYGYNHGRPIAEENPAMVIDDLRRLIPGCLDLDAEILLPDIKRPSSRESIVVVTRKLWMKVIKALARWRWRA

SEQ ID NO: 42061 - protein, 321 aa, Zea mays
  misc_feature (31)..(31): Xaa can be any naturally occurring amino acid
  unsure (1)..(321): unsure at all Xaa locations
MFYGGYAYHGNSFEQTYRCYPASFFDKPHLXGGDKVIMPPSALDRLASLHIEYPMLFELHNDATQRISHCGVLEFVAEEGMIIMPYWMMQNMLLQEGDTVHVKNATLPKGTYVKLQPHTTDFLDISNPKAILEKTLRNFSCLTTGDSIMVAYNNKQYYIDIVETKPASAVSIIETDCEVDFAPPLDYKEPEKPRQPTVPASKAPAEDGNTAVEDEPKFKPFTGFGKRLDGKASKLQASEVPSTALSAPSDSNKRANQQISAPAASGASNYSRQKTGKLVFGSSASNNKEPQKAPAKEEQPAKKDDELRFQAFSGKSYSLKR

SEQ ID NO: 42062 - protein, 501 aa, Azoarcus sp. EbN1
MFQPPSPIYPVADIRAIEAHVAPLAQPTLMERAGRAAAEEAVRLTQDRTGHVLIVCGPGNNGGDGLVMARRLLQAGRSVTVAFAENPDSLPPDAAAAFAAWRAAGGETVSDFPGAPANGWALVVDALFGIGLRRPVEGRYARWIDTMNAQQAPRLAIDIPSGLDADTGAILGMAFQATATLTFIALKPGLLTLDGPDYAGTVHVHRLDIDPAAWLSPPGFEIRPAMVREFMRPRRQNTHKGSYGDVGIIGGAPGMTGAALLAGRAALKLGSGRVYVGLVDDYALPVDHTQPELMLKRPEQVLEQASVLALGPGLGTSATALALLERAARSDRPLLLDADALNLLADAPHLKAQVAAREAPTLLTPHPGEAGRLLGIGTPRVQADRIASALELSTRFGADIVLKGGGSVIATTTGQWFINTTGHPGMASAGMGDVLTGLIASLLAQGWPARSALLAAVHLHGAAADRLAREGIGPIGLTASEVAEAARGVFNGWIVKAARGR

SEQ ID NO: 42063 - protein, 351 aa, Oryza sativa
MADESWRAPAIVQELAAAGVEEPPSRYRLREKDRSDVKLVAAELPEPLPVVDLSRLDGAEEATKLRVALQNWGFFLLTNHGVEASLMDSVMNLSREFFNQPIERKQKFSNLIDGKNFQIQGYGTDRVVTQDQILDWSDRLHLRVEPKEEQDLAFWPDHPESFRDVLNKYASGTKRIRDDIIQAMAKLLELDEDYFLDRLNEAPAFARFNYYPPCPRPDLVFGIRPHSDGTLLTILLVDKDVSGLQVQRDGKWSNVEATPHTLLINLGDTMEVMCNGIFRSPVHRVVTNAEKERISLAMLYSVNDEKDIEPAAGLLDENRPARYRKVSVEEFRAGIFGKFSRGERYIDSLRI

SEQ ID NO: 42064 - protein, 248 aa, Oceanicola granulosus HTCC2516
MRRKLAAGNWKMNGSRAALAEVEALCAAHPDSAVELLLCPPATLVAPMADARGSHPLRVGGQDCHSSESGAHTGDISAAMLKEAGASHVIVGHSERRTDHGETSETVAAKAAAAHAAGLVAVICLGETLAEREAGTTLAVVADQLGASLPEGATAANTVVAYEPVWAIGTGKVPTLEQIAEVHEYLRKELATHLPDAADGIRLLYGGSVKASNAADIFSVRDVDGALVGGASLRAEDFSPIVSALEQA

SEQ ID NO: 42065 - protein, 503 aa, Sinorhizobium meliloti 1021
MSTFKELGLSEHIVATLSANGFEKPTPIQAQAIPLVLKDHDLIGLAQTGTGKTAAFGLPMIEKLVADGRRPDPRNIRALVLAPTRELVNQIAANLKLFVKKSPLKIGLVVGGVSINKQTEQLARGVDILVATPGRLLDLVSRKAVTLTQARYLVLDEADQMLDLGFIHDLRKISKLVPKNRQTLLFSATMPKLIAELAGEYLTDPVKVEVSPPGKAADKVEQYVHFVPGKDLKTTILKQTLTANPDGLSLIFSRTKHGAEKLMKHLDHVGFKAASIHGNKSQGQRERALKAFRDGEIRVLVATDVAARGIDIPGVTHVYNYDLPEVPDAYVHRIGRTARNGRDGIAIAFCAPDEIRLLRDIEKLMGIQIAVASGEAPADQARPSKGRGGRGNGQPRGNGQPRGNGAGQRQGGPRRDRPQRQAAAGGFAGDELLRDERSHERRDQRAAGHGPADGRPEGHRNHKAQKHHGRPGPQQARRGSEQSGERNGGGNRPQRADGRGHQR

SEQ ID NO: 42066 - protein, 215 aa, Oceanicola granulosus HTCC2516
MQHARPLPGYLVKRYHGWKATTYSENEGWYRHLAAQGQHPRAMVISCCDSRVHVTSIFGADTGEFFIHRNIANLVPPYEPDGNQHGTSAAVEYAVTALKVAHVIVLGHSGCGGVQGCYEMCEGRAPQLEEKSSFVGRWMDILRPGFERLGPGTDAERRGALEKQAVLVSLANLMSFPFVKDAVEAGTLSLHGLWNDIGAGGLEAYDPATDSFRQV

SEQ ID NO: 42067 - protein, 508 aa, Mycobacterium tuberculosis H37Rv
MSRRAFLAKAAGAGAAAVLTDWAAPVIEKAYGAGPCSGHLTDIEHIVLCLQENRSFDHYFGTLSAVDGFDTPTPLFQQKGWNPETQALDPTGITLPYRINTTGGPNGVGECVNDPDHQWIAAHLSWNGGANDGWLPAQARTRSVANTPVVMGYYARPDIPIHYLLADTFTICDQYFSSLLGGTMPNRLYWISATVNPDGDQGGPQIVEPAIQPKLTFTWRIMPQNLSDAGISWKVYNSKLLGGLNDTSLSRNGYVGSFKQAADPRSDLARYGIAPAYPWDFIRDVINNTLPQVSWVVPLTVESEHPSFPVAVGAVTIVNLIRVLLRNPAVWEKTALIIAYDEHGGFFDHVTPLTAPEGTPGEWIPNSVDIDKVDGSGGIRGPIGLGFRVPCFVISPYSRGGLMVHDRFDHTSQLQLIGKRFGVPVPNLTPWRASVTGDMTSAFNFAAPPDPSPPNLDHPVRQLPKVAKCVPNVVLGFLNEGLPYRVPYPQTTPVQESGPARPIPSGIC

SEQ ID NO: 42068 - protein, 512 aa, Mycobacterium tuberculosis H37Rv
MTRRQFFAKAAAATTAGAFMSLAGPIIEKAYGAGPCPGHLTDIEHIVLLMQENRSFDHYFGTLSDTRGFDDTTPPVVFAQSGWNPMTQAVDPAGVTLPYRFDTTRGPLVAGECVNDPDHSWIGMHNSWNGGANDNWLPAQVPFSPLQGNVPVTMGFYTRRDLPIHYLLADTFTVCDGYFCSLLGGTTPNRLYWMSAWIDPDGTDGGPVLIEPNIQPLQHYSWRIMPENLEDAGVSWKVYQNKLLGALNNTVVGYNGLVNDFKQAADPRSNLARFGISPTYPLDFAADVRNNRLPKVSWVLPGFLLSEHPAFPVNVGAVAIVDALRILLSNPAVWEKTALIVNYDENGGFFDHVVPPTPPPGTPGEFVTVPDIDSVPGSGGIRGPIGLGFRVPCLVISPYSRGPLMVHDTFDHTSTLKLIRARFGVPVPNLTAWRDATVGDMTSTFNFAAPPNPSKPNLDHPRLNALPKLPQCVPNAVLGTVTKTAIPYRVPFPQSMPTQETAPTRGIPSGLC

SEQ ID NO: 42069 - protein, 245 aa, Guillardia theta
KPIVGGNWKCNLDKAGVSALVTSLNGMDCTDCEVVVAPVAVHLGSVVDNVKAPIEVSGQNCNFKGNGAYTGEVSADQLVDMGAKWVILGHSERREYFKEDNEMLRQKLEYALSKGLKVIFCIGEKLEERNANKTLDVCKSQLEPVKDLLKPETVVIAYEPVWAIGTGVTATPEQAQETHKQIRDYLATVNADMASKIRIQYGGSANAANAPTLSACPDIDGFLVGGASLKPEFADIIKAIAAAKK

SEQ ID NO: 42070 - protein, 512 aa, Mycobacterium tuberculosis H37Rv
MSRREFLTKLTGAGAAAFLMDWAAPVIEKAYGAGPCPGHLTDIEHIVLLMQENRSFDHYFGTLSSTNGFNAASPAFQQMGWNPMTQALDPAGVTIPFRLDTTRGPFLDGECVNDPEHQWVGMHLAWNGGANDNWLPAQATTRAGPYVPLTMGYYTRQDIPIHYLLADTFTICDGYHCSLLTGTLPNRLYWLSANIDPAGTDGGPQLVEPGFLPLQQFSWRIMPENLEDAGVSWKVYQNKGLGRFINTPISNNGLVQAFRQAADPRSNLARYGIAPTYPGDFAADVRANRLPKVSWLVPNILQSEHPALPVALGAVSMVTALRILLSNPAVWEKTALIVSYDENGGFFDHVTPPTAPPGTPGEFVTVPNIDAVPGSGGIRGPLGLGFRVPCIVISPYSRGPLMVSDTFDHTSQLKLIRARFGVPVPNMTAWRDGVVGDMTSAFNFATPPNSTRPNLSHPLLGALPKLPQCIPNVVLGTTDGALPSIPYRVPYPQVMPTQETTPVRGTPSGLCS

SEQ ID NO: 42071 - protein, 411 aa, Medicago sativa
MASGGVAPASGFIDKNASSVGVEKLPEEMNDMKIRDDKEMEAATIVDGNGTETGHIIVTTIGGKNGQPKQTISYMAERVVGHGSFGVVFQAKCLETGETVAIKKVLQDKRYKNRELQTMRLLDHPNVVSLKHCFFSTTEKDELYLNLVLEYVPETVSRVIRHYNKMNQRMPMIYVKLYSYQICRALAYIHNSIGVCHRDIKPQNLLVNPHTHQLKICDFGSAKVLVKGEPNISYICSRYYRAPELIFGATEYTTAIDIWSAGCVLGELLLGQPLFPGESGVDQLVEIIKVLGTPTREEIKCMNPNYTEFKFPQIKAHPWHKIFHKRMPPEAVDLVSRLLQYSPNLRSTALEALVHPFYDDVRDPNTRLPNGRFLPPLFNFKVNELKGVPAEMLVKLVPPHARKQCALFGSS

SEQ ID NO: 42072 - protein, 622 aa, Prochlorococcus marinus str. MIT 9312
MCGITGIISFQSSIDPQNIHNMNETLMHRGPDHRDIWINEYSTVFLGHTRLSILDLSDNGNQPFHSKDGRFHLTFNGEIYNYKNLKDYLKTNGISNFKSNSDTEVLIELIALRGITNASKMLNGMFAFAVWDSLEKKIHLVRDRFGEKPLFYTLQKDTLYFGSEIKSILKIPTISKIINKEALSHYLRFNYIKNPLTIYKDIYKLEPGHILSIDQNITYKKYSYKNKNKKTIKLANQKEAEDLLQNQIIKSCLSRTISDVPIACFLSGGIDSSLVTSIIQRNSKQRIKTFTIGFDDQSIDESNYAEKIANFLGTDHTTINIEEKELLNNIDLQSEIYGEPFADQSSIATNILCKYASRDVKVCLSGDGGDEMFIGYDRYYKVNQLRLFLKAIKFYKKFKTIDRILEVLIHKIESNKNFSIKIDKIIKLISLLSDANDDNIYEKFNSLYRDQYFPLTPQNNQKHYIYKDLKNIQEMCEYDFETYLPDCILTKVDRASMHNSLEVRAPFLDHEIPEIIDSINPTYKKKLLNRKFILKKLLNKYLPKNIYERPKKGFSAPLNNWIKGPLKELTLDYLSIESLKKHNLLDIDIIERIKYEHYSGIRSWHNQIWNLLIFQQWYNKNF

SEQ ID NO: 42073 - protein, 292 aa, Pseudomonas fluorescens PfO-1
MIAGSMVALVTPMDAQGRLDWDSLSKLVDFHLKNGTHAIVAVGTTGESATLDVEEHIAVIKAVVKQVAGRIPVIAGTGANSTREAVELTRNAKEAGADACLLVVPYYNKPTQEGLYQHFKHIAEAVDIPQILYNVPGRTSCDMQAETVIRLSTVPNIIGIKEATGDLKRAKAIIDGVSKDFIVLSGDDPTAVELILLGGKGNISVTANVAPREMADLCEAALKGDAETARAINEKLMPLHKDLFIEANPIPVKWALVEMGLMHQGIRLPLTWLSAPCHETLRSALRQCNVLV

SEQ ID NO: 42074 - protein, 480 aa, Zea mays
  misc_feature (54)..(54): Xaa can be any naturally occurring amino acid
  misc_feature (81)..(81): Xaa can be any naturally occurring amino acid
  unsure (1)..(480): unsure at all Xaa locations
MGTTYKCCFIFKRRFHTRDAPPPEDVRALFSVHAGGGPHMGADDLRRYLVATGXRRPRWSGCWSRSSRAVPASRASPARSXSLDDFHRYLFSHDLNPPIRHPQVHHDMTRPLSHYFIYTGHNSYLTGNQLSSDCSDTPIIMALERGVRVIELDMWPNSTIDDINIVHGRTLTTPVSLIKCLRSIKKHAFVASPYPVIITLEDHLPSQLQEKVAKMVVEVFGNILYYPPDDTHELKELPSPEQLKGRVLLSTKPPKEYLETKLGDSTKEGDADLHLGKGTGDDAVWGKEVPDFRTEIQSAEKDDENDDVDDEEEQKLQPHIAPQYKHLITIRAGKPKDSLADALKSDPEKVRRLSLSEQQLVKAAKDHATEIVRKSLLPLLKRSASSVPNPNRFTQRNILRIYPKGTRVTSSNYNPFVGWVHGAQMVAFNMQGYGRALWLMHGFYKANGGCGYVKKPDFLMQTEPQVFDPREPQPVKKTLK

SEQ ID NO: 42075 - protein, 316 aa, Oryza sativa
  misc_feature (204)..(204): Xaa can be any naturally occurring amino acid
  unsure (1)..(316): unsure at all Xaa locations
MAKKGLVGILYKLRDVHHRAPPTPTSPSSSSSPHWHGRHQLCYPPAPSSWPWPSCRHPRTSSFRWPTAPQQGQADDDAAAAAGSVYRTVNTVYDTSSLEHFNPRRSSLDEASSCIADRSFFAVESEVEVEEEKEKEKELQLRETAVVRGVRSERLLFEPAGAEFLPKQRGFQEMARGKNDDEATGMDVVARKNDERRRREAITXPQTGKNEAEAGEAAALKGGAVVLTVESEDPYGDFRSSMADMVAAHGLRDWEGLEELLAWYLKLNAKGVHGVIVGAFIDMLVSLASSPIPSQSPSSSCITFEDYSSATMEEES

SEQ ID NO: 42076 - protein, 552 aa, Caulobacter crescentus CB15
MYQYDLIDKEFLADRSAEFRGQVARRLSGELTEDQFKPLRLMNGLYLQLHAYMLRVAIPYGSLNSTQARRLAQIARDFDKGYGHFTTRQNIQFNWIKLKDAPEILDKLAEVDLHAIQTSGNCIRNTTSDPYAGATAEEVDDPRVWSEVIRQWSTLHPEFSFLPRKFKIAITASAKDRTAAKVHDIGLMLRKGRDGTLGFEVIVGGGQGRTPYVGPTINEFLPTDRLLSYLEAVLRVYNRHGRRDNIYKARIKILVAALGAEEFARQVDEEWAKIDAARADLPTAELARIRAAFAKTPFETLPARSDAFETAKANDAAFARFVRNNVKPHKQPGYAIVEVSLKAQEQTPGDASAQQLEVVADLAERFSLNDLRVTHAQNLVLPHVKLDDLPTVFATLQASNLATPNIDLVSDIIACPGLDYCALANARAIPVAQDIARQFADLDRAEKVGELKIKISGCINACGHHHVAHIGILGVDKKGEEFYQLSLGGSGAEDASIGKILGPALPADKVATAVDQLVGAYLNVRNDGERFLDTYRRVGLEPFKEAVYAQAD

SEQ ID NO: 42077 - protein, 235 aa, Candida albicans SC5314
MSQLFEWAFGKKLTPQERLRKNQRALEKTQRELSREITKLQQQEKKLISDIKKSAKSGQISSAKIQAKDLIRTKSYVSKFTSMKTQLQAISLRIQSVRSNQQMAMSMRDATRVLGGMNRSMNLPQLSRIAQEFAKESDMMDQKQEFMDDAIDDAMAMDEDELGEEEQVDEILSKVLDEIGVDLNTTLKDTPTGINAGNIEQADRARVAEAVGANGASSHDADEDDLQARLDSLKK

SEQ ID NO: 42078 - protein, 477 aa, Sinorhizobium meliloti 1021
MTLHQNLIAGEWVGGDGVANINPSNTDDVVGEYARASAEDAKAAIAAAKAAFPAWSRSGILERHAILKKTADEILARKDELGRLLSREEGKTLAEGIGETVRAGQIFEFFAGETLRLAGEVVPSVRPGIGVEITREPAGVVGIITPWNFPIAIPAWKLAPALCYGNTIVFKPAELVPGCSWAIVDILHRAGLPKGVLNLVMGKGSVVGQAMLDSPDVQAITFTGSTATGKRVAVASVEHNRKYQLEMGGKNPFVVLDDADLSVAVEAAVNSAFFSTGQRCTASSRIIVTEGIHDRFVAAMGERIKGLVVDDALKPGTHIGPVVDQSQLNQDTDYIAIGKQEGAKLAFGGEVISRDTPGFYLQPALFTEATNEMRISREEIFGPVAAVIRVKDYDEALAVANDTPFGLSSGIATTSLKHATHFKRNAEAGMVMVNLPTAGVDFHVPFGGRKASSYGPREQGKYAAEFYTNVKTAYTLA

SEQ ID NO: 42079 - protein, 495 aa, Kineococcus radiotolerans SRS30216
MSVEKDTGPGVGVQRDFSHEDGGLHKGLKNRQLQMIAIGGAIGTGLFLGAGGRLVTAGPGLFIVYGVCGFFVFLILRALGELVLHRPSSGSFVSYAREFYGEKAAFVAGWMYWFNWAMTAIVDITAIATYMHFWDTFSAAPQWLLALIALVVVLGLNLVSVKIFGEMEFWFALIKVIALTAFLLIGIVFLAGRFPVEGQPTGLSVISGNGGWFPTGAVPLVVVVSGVVFAYAAVELVGTAAGETENPEKIMPRAINTVILRIVVFYCGSLVLLALLLPHTAYSADESPFVTFFSKIGVPGAGDVMNFVVLTSALSSLNAGLYSTGRIVRSMAQNGSAPKFTAKLNKGGVPFGGIAITGVVAVLGVGLNYVAPGRAFEIVLNASALGIIASWGTIVLCQLRLHAWSKKGIVTRPDYRLFGAPYTGYLVLAFLVAVLGIMAYDEDSRPTVYALGVIVPLLVLGWFAVRKRVLAAAEERMGYTGEFPVKANRPADGGK

SEQ ID NO: 42080 - protein, 457 aa, Ashbya gossypii ATCC 10895
MSYNNKKRNGSFKRRNGGDYYFPNKRPHHHHQPTGTTSRYNNQVRPPTEPEPAAPAPADVATSAAVAATRQSRFQPHRALPKAPRQVSRYNNGNLPAPPAGPASLRVPATIITHTHSVESSYQRITQVGEGTYGKVYKCRNIYTNKLVALKKLRLETERDGFPITSIREIKLLQHCQHENVSTIAEIMCEAQKTVYMIFEYADNDLSGLLMNKEIHFSDANCKHLFRQLLKGMEYLHECRILHRDIKGSNILIDNRGNLKITDFGLARKMKQEPDYTNRVITLWYRPPELLLGTTRYGTEVDMWGCGCLLVELFLKAAFFQGTNELEQLRCIFQVLGTPTIEQWPGLFDMPWWFMMIPQQKENYPSRFDEKVSGVLPTQSCRDLARGLLLYDQKKRFSASEALKSAYFYELPRPEPLNLGDFDGCHEFEARRQRRKEREETKKAAAASASSASKKSA

SEQ ID NO: 42081 - protein, 454 aa, Haemophilus somnus 2336
MTIKTPVQATLASNQYFLDRQDIMESNVRSYPRKLPFAYQKAQGVWVTDVEGNEYLDFLAGAGTLALGHNHPKLIQAIKDVLDSGLPLHSLDITTPLKDAFTEELLSFFPKDKYILQFTGPSGADANEAAIKLAKTYTGRGNVIAFSGGFHGMTHGALSLTGNLGAKNAVQGLMPGVQFMPYPHEYRCPFGIGGEAGVKAVEHYFENFIEDVESGVVKPAAVILEAIQGEGGVVPAPISFLQKVREVTQKHGILMIVDEVQAGFCRSGKMFAFEHANIEPDIVVMSKAIGGSLPLAVLAIKKEFDAWQPAGHTGTFRGNQLAMATGYVSLKIMREENLAQNAKERGEYLTKALTELSQEFPCIGNVRGKGLMMGIDIVDEHQAKDATGAYPRDCDLAVAIQKYCFKNKLLLERGGRGGNVVRVLCAVNITQAECEEFIKRFKQSVAEAVKAVRG

SEQ ID NO: 42082 - protein, 418 aa, Porphyromonas gingivalis W83
MTIEQFNFAGKKAFVRVDFNVPLDDNFKITDDTRIRAALPTLRKIIADGGMTIIGSHLGRPKGVAPEFSLRHILPHVSELLGVDVLFADDCIGADAMDKAAKLKAGQVLLLENLRFYAEEEGKPRGLSDDASDEEKAAAKKAVKAAQKEFTQKLASMADCYVNDAFGTAHRAHASTALIADYFDRDHKMFGYLMEKEVKAVERVLHDIKRPFTAIMGGSKVSTKIEIIENLLNKVDNLILTGGMTYTFTKAAGGRIGLSIVEDDKLDLARDIVKKAAEKGVNLILSVDTKVADRFDNDAATQVCSNMEIPDDWMGMDIGPRSIEKFRKVILESKTILWNGPTGVFEFDNFSIGSKAVGEAIVEATANGAFSLVGGGDSVACVNKFGLADKVSYVSTGGGALLEAIEGKTLPGIAAIQG

SEQ ID NO: 42083 - protein, 466 aa, Ehrlichia canis str. Jake
MQNYDIVIIGGGPGGYKCAIRASQLGLKVACIDKNKILGGTCLRVGCIPSKALLHFSHEYYHLKNNLSEVGITFDNLNFDLNKIMSFKDKNIAELGSGISQLFSSYKIDYLCGAGKIKSVGSNDFIIAINGDNAEQQITSKNIVIATGSDVSSFPGITIDEENIVSSTAALSFKEPPKRLVVIGAGAIGLEMSSVWSRFGSEVTVVEFLDKIAPSMDGDISKALLTSLKKQCINFKLSTKVVSIDNKGSNLTVHLESVKDGKSEVIEADKVLVSIGRVPYTKGLIDNNLIECDSRGFIKVNSRYETNIPGIFAIGDVIGGAMLAHKAEEEGIAVAELISGHIPHVDYEIIPSVIYTHPAVASIGKTEESLKNANYSYSVGKSNFAANGRSRITNNAVGFVKVLTSKVNNAILGVHIIGTYADTMINEAAIAMAYRASSEDVFRICHSHPDVNEAFRDACEAAFLNH

SEQ ID NO: 42084 - protein, 112 aa, Pseudomonas putida GB-1
MSQELQIIDLVEGDGKAAVKGALITTQYTGWLADGSEFDSSWSRGKPFQCVIGTGRVIKGWDQGLMGMRVGGKRKLLVPAHLGYGERSVGSIPPNSDLTFEIELVEVLTRDD

SEQ ID NO: 42085 - protein, 198 aa, Zea mays
  misc_feature (155)..(155): Xaa can be any naturally occurring amino acid
  unsure (1)..(198): unsure at all Xaa locations
PSILSIKVKVGPVSVAPPHRACRSFAVVRSSKAEGPIRRPAAPPLSPPPKTPALSTPPTLSQPPKPAAPPTSSESTPPSPQPKAAVATAPAAALQRPLAGAVTLEYQRKVAKDLQDYFKKKKLDEADQGPFFGFVPKNEISNGSRDANRVRNRLXFCSAIEDPSFQFRNCGLGLIMPGLVFSLCISLLNVMYLIDMAI

SEQ ID NO: 42086 - protein, 275 aa, Candidatus Desulfococcus oleovorans Hxd3
MPGIRELKDKVVVITGAGSGIGRAAAHAFAKEGACVVITDIHAERLAAVEDELVRMGARASSRVVDVADKAQLEDLCRFVIDTHGRVDVLHANAGIGYGGPLEVFPMADFEKVMAVNFWHVVYSVGFFLPHMIKQHFGHIVVTASAASYFGLPGLGAYTASKFAVAGYLELLRAELRRHNIGVTTICPGFINTNIVKDGKSTLLPGAKADQEKMAAFYKRFGWPPERVAKAVLKGVRKNKALVPVGPEAWAQWYLKRLSPGLYNLILRIGAKLSL

SEQ ID NO: 42087 - protein, 112 aa, Fulvimarina pelagi HTCC2506
MTDFSLSDLEKIVAERANASPSESYTAKLKAMGVSHVAKKLGEESTETVIALVSQDDDRVVSESADLIYHLLVALNLRGIPAADIFSELGRRTSTTGLEEKAARPPDGPREG

SEQ ID NO: 42088 - protein, 383 aa, Abies grandis
MAYSGMATSYHGLHFMNIATQECNLKRLSIPSRRFHGVSPSLWASNGFQGHLKRELSANSFLVSSSRYSNTIAKFTNLPEKVKEKVIEFDFKEYLRSKAMAVNEALDRAVPLRYPERIHEAMRYSLLAGGKRVRPVLCISACELVGGTEEVAMPTACAMEMIHTMSLIHDDLPCMDNDDFRRGKPTNHKVFGEGTAILAGDALLSFAFEHIAVSTSKSVGTDRILRVVSELGRTIGSQGLVGGQVADITSEGDASVDLDTLEWIHIHKTAVLLECSVMCGAIISGASDNEIERIQRYARSVGLLFQVVDDILDVTKSSKELGKTAGKDLISDKATYPKLMGLEKAKQFASDLLIRAKEDLSCFDPMKAAPLLGLADYIAFRQN

SEQ ID NO: 42089 - protein, 472 aa, Thermobifida fusca YX
MSTTGEAPSSGEVNIAHVVMIAAAAAMGGFLFGYDSAVINGAVSAIQDTFRVGSTVIGFTVAAALIGSAVGAAIAGALADRIGRIRVMQLAAVLFAASAVGSALPFTVWDLAWWRVVGGVAIGIASVIAPTYIAEVSPPAFRGRLASLQQLAIVLGIATSQLVNYGLAAAVGGSALHRLGPLQAWQWMLGIEVLPAATYFVLTLVIPESPRHLVRIGRDARARRVLAEVEGGDVDGRVAEIRRVLGRERRPRLRDLRGRYGLLAIVWVGMALSAFQQLVGINVIFYYSAVLWQSVGIAETDSLLLSLFTSIVNIVGTLIAIGLVDRVGRKPLLLAGSAGMTVALAFTAFAFSHARGEGDDVVLSTAWALTALVSASTFVLFFALSWGVVTWVLLGEMFPLRIRAAAMAVATATQWITNWLVTVTFPSLRDWSLPGTYLVYTAFALLSFGFVLRFVRETKGRTLESMDELAGQ

SEQ ID NO: 42090 - protein, 459 aa, Arabidopsis thaliana
  misc_feature (50)..(50): Xaa can be any naturally occurring amino acid
  unsure (1)..(459): unsure at all Xaa locations
MSTKRVDMGSRDYISSLPDEILGKILSLFCTNRAACTSVLSKRWRNLLEXVDNLDLNDAYGNHQYFCDFVDRTLALLSNSTTVKRFSLNCAFHNDASRVNSWIRTVFDRGFLDLHLETAHMHRIDTEFFTSNTLLELTICGGFYAEGRLPPGRVFFPALKSLSLVSVEFTDTLMYQNFISGCPVLEELFLHYDNETQCPAWKGLVSSPSIKRLNIYDNPSELRYEAYKCCFQIPSLVYLDYSSYVAKQYAVDLVSLEEARLNIRYPERLVDQNEDIFGDVTDLLKGISNVKTLHLSSDSLEVFHLCCDTMPVFHNLLTLSFESDEEIGWQVVPLLLNKSPNLETLVIKSLVHQVTDMCGNACACISKRRKKKKKTTEDDECCLSTCQVKVLNISGYRGTCKELKQMRHFLENLKCLETVNVGVDVKRREYKNGNNKYQRITNAVMELPRFSSNCQIQFF

SEQ ID NO: 42091 - protein, 256 aa, Synechococcus sp. WH 5701
MKDFRLDGKRALISGGSKGLGAAIAERFSEAGADIGVIGRDREGLGRIQGIVENNHRNCWVIEEDVSSIEGARRAGDKALALDPEWDVLVNNAGIARVQSILETTQDNWNDIFSVNLRSALLLSQAIVPQMIKRGHGKVVNISSIGAFIGTPGLGAYAASKAALNQLTRTMAVEWGPHNVQVNALCPTVILTQMGHDIWDSPSMEEPRKEKEKRIPLHRFGEPTEVANVALFLASPASNFVHGVSLPLDGGMSIAP

SEQ ID NO: 42092 - protein, 855 aa, Oceanicola granulosus HTCC2516
MTSPETAAAYEVTLENCAREPIHVLGRIQPFGCLIAVSKDWIIGHASANTDDILDLAPERLVGAPFADFFPGQSIHDLRSKMQLLAHDDQPARVFRFDLFEDGRLFDIAIHGSGRHFVFEFEPKSSSEFRDDLALVQPLIARVRRREDIVGAATEAARCLKAMTGLDRVMVYRFEEDDSGTVIAEAREPKLEPFLHLRYPASDIPAQARELYRRNTFRIIADVDGEVHPIVPELGPDGRPLDLSFAVTRAVSPIHLEYLRNMGVRASLSVSILRRGKLWGLFACHHGEPFYVDYELRTAVELFGQLFSYELARLETDAELADVEKARRLHDNLMSQVSGGMDLLQSFDRVADEIDEVIPFDGIAIYTGGRYIARGAAPTEEEFRPLARFLNTAENSRIFHTDRIGARYPDASDFSDRVAGVLALPVSRAPRDYIVLFRHEVAQSVKWAGRPEKSLEVGPDGPRLTPRKSFEAWQEVVTGQSMPWKASELRAAESLRITLLEVVLKLSDEANANELRAREQQELLIAELNHRVRNILNLIRGLVSQGRRDAGSVDDYAAILDSRIHSLARAHDQLTERDWGWMSLKALIDNEVNAYLGGDGERVRVDGADVELSPTGFTTLALVMHELVTNSAKYGALSGDAGLVTIDLGWEGDDFTLAWRESGGPAVVAPTRQGFGTTIIERSIPFELKGTARTRYEAGGLEADFSIPAAHVRPGSGAPGAAGAPAPRPGHAGRARIEGRALVLDDNMIIAMDAADMLTALGARQVHVASSVGEAHQLLDGHDIVFALLDVNLGAETSLSVAERCKADGVHAVLATGYGASGERIAEFPAMPVLKKPYTIDHVAVAIEGFADGDG

SEQ ID NO: 42093 - protein, 140 aa, Bartonella quintana str. Toulouse
MAVERTFSMIKPDATRRNLTGAITKMLEDAGLRVVASKRVWMNRREAERFYAVHRERPFFSELVEFMSSGPTLVQVLEGENAIAKNREVMGATNPADAQEGTIRKVHALSISENSVHGSDSAETAKTEITFWFSEMEIVG

SEQ ID NO: 42094 - protein, 487 aa, Gibberella zeae PH-1
MIANPSLQHHHSHDSSSSYRSGSRSRHSTTPRAQRTAAELADFNSNHSSTAWSPATTTATATAPTSESTPTPASAGQTAHVSATGGASRFPSPPPSSSPAAATGPAYADDAKSSSMASDARDSGPLGHASRSGPVSHASAAQQPSPASDDFQISNQAYPLSGGPSQPPEQKVIHIRDLAHIQSLASADLLSGNGGSGILNDPPLQQMKYEISGMPIGDIIEMVAALLTKITTTNDLQHDAMQRNVAHQQQANQSGDSSGSSISSLNHSVLAFHGKNVPAITILSYLSRIHKYCPTTYEVFLSLLVYFDRMTERVNDMVTKNEEIRRQTQSQQTNTKTPQDTPMRGEGMNDTDESDSDLADDDDEEMTDAARQSRPSSNKGAATPTEHPAIAAATYFVVDSFNIHRLIISGVTCASKFFSDVFYTNSRYAKVGGLPLVELNHLELQFLLLNDFRLAVPVEDLEAYATMLVEFYAREVVAKQAGAGSTE

SEQ ID NO: 42095 - protein, 501 aa, Ehrlichia canis str. Jake
MTNHSVILCILDGWGNGENNQFNAIAQAYKPCWDNITLQYPKSHLITHGSSVGLPDGQIGNSEVGHVNLGSGRIVLQDLCKINNEIKYIKDNVYLLEFINKIKKNNGICHIAGLLSDGGVHSSYTHILDIINTLSDFQIQVAVHIFLDGRDTPPISATKYISILCEHIKHLNNINIATLSGRYYAMDRDNRLDRTTKAYNAIAFANAKRYEDPLTAVQDSYNLGITDEFILPCIIGNYQGMKPQDGFIMTNFRSDRVIQIIKMIIGDIKTDNHITLDNTIGMVKYSDKINIPCLFPNNNITNTLGEVIANNQLHQLRIAETEKYAHVTFFFNGGKEDMFENEDRIIIPSPSVATYNLTPEMSAEKVTDTIIEKIKLQKYSLIIVNYANADMVGHTGNIDATKQAITTIDQCLSKILNCIQNTNYVLVITSDHGNAEEMFDVKNNMPYTAHTLNPVPFIICNYNKKIRLKNGRLCDVAPTILEILNLAKPKEMTGVSLIEQV

SEQ ID NO: 42096 - protein, 613 aa, Xanthomonas axonopodis pv. citri str. 306
MCGIVALRSFVAEAPLQALAERALDALSRRGPDAQGLLCLEQPVPTALGHRRLAILDLSAAATQPMRCAETGNVLVFNGEIYNFLELRRELEGLGHQFRTDSDTEVILHGWRAWGEGLFPRCNGMWALVLLEQASGDLIYCRDRLGVKPLYLHHDGRQLVLASEIRAIAASLGGYPPPNPAAVFDFLVTGLSDHTSDTFYAGIRAVPPGWLYRVSPAGHSRRTPYHQWPLPGAVAPLDAQATMELLEDSTRLRLRSDAPTVSLLSGGLDSSILTTLSVQAGALPRTCFAGAFTYGYDDTEQAGFDETEAAASLMQTLGQSERHFVHRARAIPDEEELLALVAAQEEPFCTPSILASFRMYRAIRAAGYKVVLNGEGADELFGGYVRLYLALSARSALHQARLPTAIRLLSTGAVDPRLLLNRLAWDLPAGALGALLRRQRPSVACMSSALWHDQAARLQSLQVDRRVDIEARLRRDVLSTNLPMVLRMTDRNSMSAGIEVRAPFLDYRVVERALSTPALQRMGDYHGKAMLRHAFAERLPARVTTQRKSTGFGHAEQFLVDRMPLQQALATLPEGVNELLNVARLRREFASGRSHSTLWFAVSVALWYRSVYA

SEQ ID NO: 42097 - protein, 202 aa, Fulvimarina pelagi HTCC2506
MAGNAGRRDATVSRATKETEIEVRVDLDGTGKADVATGVGFFDHMLDQLARHSLIDMTIKAKGDLHIDDHHCVEDVGIALGQAIRQALGERKGIRRYASVDLAMDECLTRAAIDVSGRPFLVFSAEFTRAKIGTFDTELVREFFQAFAQNAGLTLHVTNLYGENSHHIAETCFKAVARVLGEAISIDARQADLVPSTKGMLA

SEQ ID NO: 42098 - protein, 548 aa, Landoltia punctata
MGVCFSKASKPSGNGYQPPPPQPYKPPPPPAARPAQPSVQIPQTHHTQQRQQSDHQSASQAAPSPAKQHLPSPRNSPAAAVSAATPATVLGKPFEDVKAKYTIGKVLGRGQFGVTYLCTCNSTGAKYACKSISKRKLVNRNDREDVKREIQIMQHLSGQENIVEFKGAYEDRHSVHVVMELCAGGELFDRIIAKGHYSERAAAAMCRSIVNVVNICHFMGVMHRDLKPENFLLSTKDPGAALKATDFGLSVFIEEGKVYRSIVGSAYYVAPEVLMRSYGKEIDVWSAGIIVYILLSGVPPFWGETEKKIFDSIMKDDIDFQSDPWPSISASAKDLVSKMLTRDPKKRITAAQVLDHPWIRVDGEASDKPIDSAVLSRMKQFRAMNKLKKMALKVIAESLSEEEIKGLRQMFQNMDTDQSGTITYEELKTGLARLGSRLSEAEVKQLMDAADVDGNGSIDYIEFITATMHRHKLEREEHLYSAFSYFDKDNSGYITRDELKQALEEHGMGDADSIREIISEVDTDNDGRINYDEFCAMMRSGTHPPGRP

SEQ ID NO: 42099 - protein, 182 aa, Landoltia punctata
MGNCFSQSTQTRGSKRNQKPDPLDEPSTRQAQNGGSANAPPQKPPGAVTGVLRQPPAKGSAAVGPVLGRRMEDVRQTYAIGKELGRGQFGVTHLCTDRVTGKQFACKTIAKRKLVNKEDIEDVRREVQIMHHLTGQQNIVELVGAYEDKQSVHLVMELCAGGELFDRIIAKGHYTERAAASL

SEQ ID NO: 42100 - protein, 125 aa, Pseudomonas fluorescens Pf-5
MSNDIQRYPSHLPYPFSRAIRVGGFLFLSGQVPMSAEGEVVRGDIRVQTEAALARIGETLAECGASFDQVVKSTVWLTDMQHFAGFNEVYQRHFKNGFPVRSTVSAQLALGVDVEIEVQAWVGEN

SEQ ID NO: 42101 - protein, 277 aa, Bacillus cereus ATCC 14579
MRKSEMEESRMWNYEAEEAKAVIVIVHGAMEYHGRYEAVAEMWNHIGYHVVMGDLPSHGTPSRNRGHIDSFDEYIEEVKLWVKEARKYRLPIFLFGHSMGGLIVIRMMQETKREDVEGIILSSPCLGVVTGPSAPLQFASKILNVVAPKLQFATNLTVEMSTRNHEVRDAMENDSLFLRKVSVRWYSELIKSIEIAHKKIDDFPDVPLLLMQACEDKLVDKTRVRTWFDNVKISDKAFKEWPNCYHELLNEYERDEILSYIQSFTEMHVNNIVKTNK

SEQ ID NO: 42102 - protein, 187 aa, Solanum demissum
MAQVTGDDGESGGDQHASIFVLGRQLFVAMLMLDTWQYFMHRYMHQNKFLYKHIHAQHHRLIVPYAFGALYNHPLEGLILDTIGGALAFLVSGMSPRTSIFFFSFATIKTVDDHCGLWLPGNLFHIFFKNNSAYHDIHHQLYGTKYNYSQPFFVTWDRILGTYMPYELERRPEGGFEAKPVKDCKEH

SEQ ID NO: 42103 - protein, 320 aa, Brassica juncea
MEKNIKFPVVDLSKLIGEERDQTMALINDACENWGFFEIVNHGLPHDLMDNAEKMTKEHYKISMEQKFNDMLKSKGLENLEREVEDVDWESTFYLRHLPQSNLYDIPDMSDEYRTAMKDFGKRLENLAEDLLDLLCENLGLEKGYLKKVFHGTKGPTFGTKVSNYPACPKPEMIKGLRAHTDAGGIILLFQDDKVTGLQLLKDGDWIDVPPLNHSIVINLGDQLEVITNGRYKSMMHRVVTQKEGNRMSIASFYNPGSDAEISPASSLACKETEYPSFVFDDYMKLYAGVKFQPKEPRFEAMKNANAVTELNPTAAVETF

SEQ ID NO: 42104 - protein, 670 aa, Synechocystis sp. PCC 6803
MVVATQSLDELSINAIRFLAVDAIEKAKSGHPGLPMGAAPMAFTLWNKFMKFNPKNPKWFNRDRFVLSAGHGSMLQYALLYLLGYDSVTIEDIKQFRQWESSTPGHPENFLTAGVEVTTGPLGQGIANGVGLALAEAHLAATYNKPDATIVDHYTYVILGDGCNMEGISGEAASIAGHWGLGKLIALYDDNHISIDGSTDVAFTEDVSKRFEAYGWHVLHVEDGNTDLAAIAKAIEEAKAVTDKPSMIKVTTIIGYGAPNKSDTAGIHGAALGTDEVAATRKNLGWDYAPFEVPQEVLDYTRKAIERGASYEAEWNQAFAQYKTKYPTEAAAFERQLSGALPEGWDKTLASFTPDQKGLATRKYSEECLNALAPVLPELIGGSADLTHSNLTELHCSGDFQKGAYQNRNVHFGVREHAMGAICNGIALHGSGLLPFGATFLIFTDYMRAAIRLSALSEAGVIWVMTHDSIGQGEDGPTHQPIEVLASLRAIPNLTVIRPADGNETSGAYKVAIAKAKENAPTLLSLTRQAVPNLPGTSIDAVAKGAYTIVDSEGVPELILIGTGSEVQLCVAAAEKLAAQGKKVRVVSMPSWELFETQDAAYKESVLPKAVTKRLSVEAATNFGWHKYVGTEGDTVSIETFGASAPGGVCLEKFGFSVDNVLAKAKTLLS

SEQ ID NO: 42105 - protein, 185 aa, Synechococcus sp. WH 5701
MALSTTVPELGEPIDLRGLVRDVPDFPKPGILFRDLTPLMRDPRGWKEVVRLLAGVCAQLRPDLIVGIESRGFIVGTALATTVEIGFVPVRKPGKLPGQVRAVDYALEYGHDRLEIQHDALAGGPRVLIVDDLLATGGTAAACAQLVTEAGGDLCGFGFVAELADLGGRSRLPGDHPVESLIVYA

SEQ ID NO: 42106 - protein, 472 aa, Ashbya gossypii ATCC 10895
MELQRMMQYLRKLGHFIGPGIMVSVAYMDPGNYSTSVAGGAQYKYHLLFSIFVSNIFAVVLQCLCVKLGTVTGRDLAENCRRHLPRKLNYVMYAFAEVAIIATDLAEVVGTAVALQILFGIPLIWGVLLTILDVLLILVFYRPEKQTMREVRMFEFFVSIFVAGTMVCFVLELFKLSVPSKLELFRGFLPSPVLFKEQRAIFISLGILGATVMPHSLYLGSALVKPRVQEYDIKKYGKLKESGPSLEAIKYTLNFSYAELIVSLFFIATFVNSAILIVAGATLFGEPEAEDADLISIYQLLCKTISPAAGLIFALAMLFSGQSAGVICTMAGQIVSSGFLKWNLDPWIIRLVTRLIAIVPCFIVALFMGEKGISNILNLSQVVLSLILPIVSAPLIYFTSSKKIMTVVDHDGNEDDLDEPSERTNLVTIKKPFVDYSNDKWLAYVSVGIWALIGSLNCYLVVSFLLGADVQF

SEQ ID NO: 42107 - protein, 682 aa, Methanocaldococcus jannaschii DSM 2661
MISSYGDVDMELRDEDLILEEVRDYLTAYLRNIHQEDIILDNERVVVDLNQLYNYGLMEFVEFLINNPQKGIDFIKECYNDAYYTLRNEYPTNVIIAVKNLPKIFKTTRKGKIFTIEDIRSKTLGKLVEFEGIIVMASKIRPMLKKAYYICPKCGREVVREIDILNTDSEKAVCECGAELNLIEHKSIYTDFQEIKVQQPLDLMENPEEPPKYITVFLENSPGIYAGRVKITGIPIKVKKSKKLPIYDIHVKALHCEVLDGEVKIKLTNSDIENIKKIAKRKDVVNILADRLIPEIKGHSAIKKAVLLQQIKGVKKPGKRADIHILLITDPGIGKTVILRKIAEIPGNLYGSVTTATGVGLTAAVVREKTEIGEDTWVIKPGLLVKAHKGTACIDELTVNKELQSYVLEAMESQTIHISKGGINAKLPAECAILAACNPRWGRFNPEVSVAEQINIPAPLLSRFDLIFPIRDVSDKDKDKDIAEYIVDLHRAYLDEKINREMGLDYLEVDGVKIDKEFIIKYIYYARQKKPIISEKAKELFVNYYVEMRKKHQITARQLEAAIRIAEAHAKAKLKDVVDEEDAKEAINIITECLKEIAYDPETGIFDVDKILGVSKKERDKLTTVYEIIKELSEKSELVEHEDIAEEAKKKGIKEDELENIIKKLIKYGDIDEPKPGRYRLL

SEQ ID NO: 42108 - protein, 1429 aa, Arabidopsis thaliana
MQSLTLTRYPTPISPPRLNLYPLRQIAASVLSAPTAGINRRDMASRHQSTSFKPLAVGRNLTGDDDDGYCTLIDFAGSGGGEGKNVGEDLVVLLYHLQHACKRIASLVASPFNSSLGKLSVNSSSGSDRDAPKPLDIVSNDIVLSSLRNSGKVAVMASEENDSPTWIKDDGPYVVVVDPLDGSRNIDASIPTGTIFGIYNRLVELDHLPVEEKAELNSLQRGSRLVASGYVLYSSATIFCVTLGSGTHAFTLDHSTGEFVLTHQNIKIPTRGQIYSVNDARYFDWPEGLRKYIDTVRQGKGQNPKKYSARYICSLVADLHRTLLYGGVAMNPRDHLRLVYEGNPLAFLVEQAGGKSSDGKRGILSIQPVKLHQRLPLFLGSLEDVAELESYGDVQQTVNPGYETTKDFSQVLCAGNRRDEIGEGERGEIMERNSVKFHAEKRSGAFDPGSGFGSSKRVKTHHTQLLSALVVPVGHAAFRLLCPLSHVGAVIGKSGNVIKQLQQSTGAKIRVEEPPSGSPDRVITIIAQADSKSRVKLGANNNGNAEGEKKEEEVEVSKAQGALIKVFELLAAEADSDTVVCRLLTESSHAGAVIGKGGQMVGSIRKETGCKISIRIENLPICADTDDEMVEVEGNAIAVKKALVSISRCLQNCQSIDKVRMVGNRPLEKEFQASLHRPIETIIQESLPRSVEVNPYDYRLRNDEIFPRGTVARANDVIPHDTLHLRRIEAVPQGALRMHIEADRQDVLRRHVEADRQDALRRRIDVVPQETLYMPSDVLRGDCFRQHRERDDSHDSLHRPFEMVPRDAMGMPFESFPRDAYGRPIETMTQETLRGQSADYLAHRYSTLDTHPHSFTTSASMANTATMKPPPSEVEVGNQDVVFKILCSTENAGGVIGTGGKVVRMLHSETGAFINVGNTLDDCEERLIAVTASENPECQSSPAQKAIMLIFSRLFELATNKILDNGPRSSITARLVVPTSQIGCVLGKGGVIVSEMRKTTGAAIQILKVEQNPKCISENDQVVQITGEFPNVREAIFHITSRLRDSVFSNSMKNSLAKSSSALTTERFYDRQSDNPLSIGSHQSVSNPATNSSSLHRRSEDSFLSGSHSSVNYSRSVGTDPYIRPEDPFPDRFNPSAGYSHNFGRRFTMDHSDNSHHLTEAPSRLWASPPPAAPRGLSDASGGLSSARAGHVLGSGHKSAIVTNTTVEIRVPANAMSFVYGEQGYNLEQLRQISGARVIIHEPPLGTSDRIIVISGTPDQTQAAQNLLHAFILTGRSAPRPRPAAARSPAPQPVHRAPPPAPAQASGGGGGMFSGIGSTIAQGMAFGTGSAVAHRAVDSVMGPRTIQHEAVEAASASAAPAGSAMLSSTCDIHAKAFQDVSFKSFSHAFTLSLYFCYRIRFVRILNCMIEFVLKHLNSFLSLLNVYIAQ

SEQ ID NO: 42109 - protein, 337 aa, Brassica napus
  misc_feature (248)..(248): Xaa can be any naturally occurring amino acid
  unsure (1)..(337): unsure at all Xaa locations
MSAFTSKYADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSEHSIHENAYGLARYAVICQENGLVPIVEPEILVDGSHDIHKCAAVTERVLAACYKALSDHHVLLEGTLLKPNMVTPGSDSAKVAPEVIAEHTXSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 42110 - protein, 641 aa, Xanthomonas axonopodis pv. citri str. 306
MSDFAGVWRLDGAPVAPGDIQRLGQALDARGIGPVRVWQDGPVAIVHRQHVFTPQDADEAMPWVGASGAVLAADVRLAARQELASALQHPANVTLPDGVLLLEALQCWDTAALPRLHGCYALALYRPDRHRLLLARDPIGLRSLFVHRGPHLIAFATRLRALLALPQVPKDLDERALADKLIMDRARPERTIYRAIDRVPMAHAVVLTPEATHCQRWWSPPEAGSLRLRNDAEVEAAAAEVLDRAVADALRARGPVATCLTGGLDSGSITLSAARQQAPSPLLVLTRQPLPATAAATATHYYDESPRARRLAASHPGIDWHLVGDDDADWGEHDPACWWREGAQPVRSPSNMAWFFPLYRFLHARGSQVMLGGELGNAFFSYDGLLRLPQLARQRQWRVLAGQVGALAGSLGLSRRKTVQRYLLRPFAPVALLRLWHGLPAAVWEAQAALQPALAQSLGMQQSLDRSRYRLRLGGGHTSLPTFREWMLGDAGPMDLVNTLRAVSGVDTRYPLADRRVIEFFGSLPLDQFLRDGVSRSLPRRLLAARGAPPEIHANRAVGVQQGDWFARLNAQRDALHAQLSQARTSPLANRVVDLQRLQALLDHWPQDAAAAEARRFEYLQLLASGLQMAGFLAWHERGGA

SEQ ID NO: 42111 - protein, 421 aa, Ehrlichia canis str. Jake
MIFLANPFFHYKNNILNIENVNVLDIAKDIGTPVYCYSLNAIKNNYRQFQENLPNNSIICYAVKSNSNLSILSLLNSLGAGADVVSEGEIRRAIAVGISPNKIVFSGVGKTEQEISFALDNRILQFNVESIEELSLINTIACKKNIIAPVSIRINPNISADTNDKITTGLKVNKFGIPEELLDQIFNNNFIGIRIIGISVHIGSQISNLNIFQNTIDKIKKIVKIFEQRNMQIIRVDLGGGLGIPYKNADVFPTIPEYANLLKKNFENENYQIICEPGRALIGNTGVLLTKVLYHKHNQEKSHIILDAGMNDLIRPALYNAEHTIIPAISTSTPLQLYDIVGPICESDDTFAYNYHINNLQNGEIVAICTTGAYGSSMSSNYNSRPLVPEVMVSNSNYDIIRHRQTYEDMLKDEVILDFNK

SEQ ID NO: 42112 - protein, 475 aa, Fulvimarina pelagi HTCC2506
MDAMMSEPYDLVVIGSGPGGYVCAIKAAQLGMKVACVEKRETYGGTCLNVGCIPSKALLHASERFHEAGHHYASLGIKVSPELDLPAMMTHKDKTVKSNVDGIAYLFKKNKVDGFIGTGSIEAKGKVKVEKEDGSSETLDAKNIVIATGSEVAGIPGVDLTFDSDTIVSSDWAIALEKVPEHMIIVGGGVIGLELGSVWSRLGAKVTVIEYLDKVLGPMDVELSTAFQKLLVKQGIEFKLGAKVTGVEKHDGGGASVTFEPAKGGESETLDAEVVLVATGRKPHTEGLGLANAGVKADDRGRVEIDDHFKTNVDGIYAIGDVVRGAMLAHKAEDEGVALAELLAGQSAHVNYDAIPSVVYTAPEVASVGKTEEELKKAGIEYKVGKFPFLANGRARAMLATDGFVKMLVDAKTDKLLGCHILGASAGDLIVEAALVMEYGGASEDVALTSHAHPSLSEAMREAAMAAAYGKPIHI

SEQ ID NO: 42113 - protein, 473 aa, Solanum demissum
MHIIFYELETEGWFERSKAYIAIERYLSKNSSTQAKRLKANAVKDGQSLVLTMDDHEEITDEYKGKKVWWISSQKPASRQTISLYREDEKRYFKLKFHKKNRDLITNSYLKYVLDEGKAISVKERQRKLYTNNKGDGGGYRYRGGRMWSGVVFEHPSTFDTLAMDPNKKQEIIDDLETFSKSKDYYAKIGKAWKRGYLLYGPPGTGKSSMIAAMANFLKYDVYDLELTSVKDNTELRKLLIDTTGQRETNKKKKEEEDKGKNEEDAVKEKMKKGGEVKEKQSEVTLSGLLNFIDGLWSAIGGERLIVFTTNYVEKLDPALIRRGRMDKHIVLSYCCFESFKVLAHNYLDVVESHVHFPEIRRLLEETNMTPADIAENLMPKSSKENAETCLERLIKALETAKEEAKLKAEEEERAKAAEKEKEEERAKAAEKEKEEKDREEKKEVTATEEAKNADDVNEKDNGVKENGDVSKD

SEQ ID NO: 42114 - protein, 410 aa, Methanosarcina mazei Go1
MFFNSMKAIILAAGEGLRCRPLTLTRSKVMLPVANRPILEHVISSLEKNEIKEIILVVGYEKERIMNYFEDGLNFGVNISYVEQKAQLGTAHAIEQAKKLIGPEDSEFLVLNGDNLVEPKTIADLLNNYEGDASLLTVRMEDTAGYGVVLKEKKKVTQILEKRPGGLSRLVNTGIYIFTPQVFETIEKTPISENGEYAITDTLQLMIDEGKMVTSIPTESKWLDAVHSWDLLKANATVLNASKNLKQEGELEEGVIIRGNVAIGKNTIIRSGTYIVGPVVIGENCDIGPNVVILPSTTIGDNVSIRSFTEIQNSIIMNDCRISSHGQISNSIIGSNNTLGPGFTAEEKENLEININCKVHKAPKLGTILGDDNRIGGRVLVKAGVMIAVNCQVESGNTIYRDLSRDSVVL

SEQ ID NO: 42115 - protein, 318 aa, Spiroplasma kunkelii CR2-3x
MVILAIETSCDETSIAIFKNRKILANIISSQIKEHTKYGGVVLELASRLHLKNFSYVLLEALQKANIHITELQYIAYTAKPGLIGALHIGKTIAETLSNYLEIPILPLNHLYGHIYASAIDNDFLFPLLAVLVSGGHTQLILMKKHLNFKILGSTLDDAIGECYDKVARMLDLGYPGGPVIDKLAATGTTTQYNLPLPLNDQSYNFSFSGLKSAVANLIAKEQRNTKINLSNFCATFQKTCVDIIMRKTILAIQNFQPQMVTLVGGVSANSALRAAILNLATPNLKIVIPKLEYCTDNAAMIARLAAQELLENNIKGD

SEQ ID NO: 42116 - protein, 254 aa, Bartonella quintana str. Toulouse
MSPNIRPFIAGNWKMNGTVESLGELRAIAAGVSSDLGHLFEALICVPATLLSRASDALSGENLLLGGQNCHFDDCGPYTGDISAFMLKEAGASHVIIGHSERRTVYQESDAIVCAKVQAAWRAGLVALICVGETLEERTSNKVFNVLTRQLEGSLPDGATAENVIIAYEPVWAIGTGNSPTSAVVAEVHDFIRHKMCSRFGDDGRKMRLLYGGSVKPSNAFELLSTVHVNGALIGGASLKAIDFLTICDVYRKL

SEQ ID NO: 42117 - protein, 530 aa, Trichodesmium erythraeum IMS101
MKNMYTDKNTFAITTPLYYVNDLPHIGSAYTTIAADTLARFQRLQGRSVLMITGTDEHGQKIQRTAENKGRNPKEHCDSVVRGFESLWEQLNIQYDRFIRTTAPNHEKIVKEFFQRVWEKEDIYLSQQKGWYCVSCEEFKEERELTEDKHCVIHTNQKVEWRDEQNYFFRLSRYQERLQAFYQDRQEFIQPQSRRNEVLSFVNQGLQDFSISRVNVDWAFKLPVDSSHTIYVWFDALLGYVTALLDPDSEPTLENALSKWWPINLHLIGKDILRFHAVYWPAMLMSADLPLPERVFGHGFLTKDGKKMGKSLNNTLDPFELIQKYGSDAVRYYFLKEIEFGVDGDFNENRFINVLNADLANDLGNLLNRTLKMAHKYFNGQIPKINVQEVEVTHPLKKIGMGLGEKVTQAYTSLDFSQVCEAVLILVRTGNKYIDETAPWSLYKQGQLEALTEVLYSVLESVRLVAYLLSPIIPNISNAIYQQLGFSNNFNDKSAINSSETFVKQVSWGALPGNQLLGQPQPIFQRIDMI

SEQ ID NO: 42118 - protein, 422 aa, Bartonella quintana str. Toulouse
MTIIVDIIGREILDSRGNPTVEVDVHLENGIVGRAFVPSGASKGAHEAVELRDGGIRYQGKGVERAVAAVNGEILEELVGRDARNQIAIDQAMIALDGTPNKARLGANAILGVSLAVAKAAAESLCLPLYRYIGGTQAHVLPTPMMNIINGGVHADNSIDFQEFMIIPVGASTLKEAVRYGAEIFHMLKKRLKDAGHNTNVGDEGGFAPQFKSAEQAIDFIMESIITCGYKPGEQIALGLDCASTEFYKNGSYFYKGEGKCRNTQEQVDYLAQLVKTYPIITIEDGMAEDDWEGWKLLTDSIGKQCQLVGDDLFVTNSARLRDGIKMGAANSILIKMNQIGTLSETLDAVETAHRASYRAIISHRSGETEDSFIADLAVATNCGQIKTGSLARSDRLAKYNQLIRIEEMLGAQACYAGNWHC

SEQ ID NO: 42119 - protein, 454 aa, Bartonella quintana str. Toulouse
MSIDILMPALSPTMEEGKLSKWLKKEGDKVSSGDVIAEIETDKAMMEVEAVDEGTLGKIYVHEGSEGVKVNTVIAVLLEEGENPENILQPAATVQELRGGSPSLSSSMPEPPTFDTISDSDIPTGTRMVTMTVREALNQAMAEEMRRDEMVFLLGEEVAQYQGAYKVSQGLLEEFGARRVIDTPITEHGFAGLAVGAAFGGLRPIVEFMTFNFAMQAIDQIVNSAAKTRYMSGGQMSVPMVFRGPNGAAARVGAQHSQCYAAWYSHIPGLKVIMPYSAADAKGLLKAAIRDDNPVIFLENEILYGYQFEVPQIDDFILPIGRARVHKSGQDVTIVACGIGMHYALQALPEIEKLGIDVELIDLRTIRPMDLPTILASVKKTGRLVTVEEGYPQSSVGTEIATRVMQQAFDYLDAPVATISGKDVPMPYAANLEKLALPNTAEIIEAVKTVTYRV

SEQ ID NO: 42120 - protein, 673 aa, Neurospora crassa
MLRTYRVARASGLATAPRTLTLTSTTATRHLFTLPKSLQLRRPEKLSLISQRQLSGRPLPRTQSRLLNFGYRTAAWFGSSIAFVGLSFVAFFLYDASTYSSHATNQGDITVPKLALNPRRGGPKNLPILEIFLDDDDSEEKKKHKEKPRLVILGGGWGSVALLKELNPDDYHVTVVSPANYFLFTPMLPSATVGTLELNSLVEPIRNIIDRVKGHYIRAAAEDVDFSSRLVEVSQKDPRGNEVRFYVPYDKLVIAVGSTTNPHGVKGLENCHFLKDINDARQIRNKIIQNLELSCLPTTSDEERKRLLSFVVCGGGPTGVEFAAELFDLLNEDLTLHFPRLLRNEISVHLIQSRDHILNTYDEAVSKYAEDRFSRDQVDVLVNSRVAEVRPESILFTQRGPDGKTTVTKECPMGFCLWSTGVSQAEFCKRISRQLGPAQTNRHALETDTHLRLNGTPLGDVYAIGDCSTIQNNVADHIITFLRNLAWKHGKDPESLELHFSDWRDVAQQIKKRFPQATAHLKRLDKLFEEYDKDQNGTLDFGELRELLKQIDSKLTSLPATAQRAHQQGQYLAHKFNKLARAAPGLSANEIHEGDLDAAVYKAFEYRHLGSLAYIGNSAVFDWGDGWNFSGGLWAVYAWRSIYFTQCVSLRTRVLMAIDWGKRALFGRDLMRY

SEQ ID NO: 42121 - protein, 439 aa, Bartonella quintana str. Toulouse
MPIKITMPALSPTMEEGNLLKWNIKEGDKVSYGDVLAEIETDKATMEVEAVDEGTVAKIVVPAGTQGVRVNSLIVVLAEEGEDLAEAAKVAEKALSSIAVIESKRKKQTDSKSAQMSRLLSARQVRQQDGRLFASPLARRLAAQEGLDLLCISGSGPHGRIIKRDIDKAMSNDGLEDSCSLQNKQPVATDSADKKILQLFKEDEYTFILHSNMRKTIAKRLVESKQKVPHFYVTVDCELDALLELRTQLNAAAPMVKMQEGFKPAYKLSVNDMVIKTVALSLKAVSDANVSWLEGGILHHKHCDVGVAVSVSNGLITPIVRHAEEKSLSIISNEMKDFVKRARERKLKMEEYQGGTTAISNMGMYGVKSFSAILNPPHATIFAIGAGEKRAVVKNDALGVATIMSVTLSADHRAVDGALAAELMRTFKKIIENPLAMLI

SEQ ID NO: 42122 - protein, 225 aa, Triticum aestivum
MMMGTDVCSSRMLSLPRYESGDEELTVLPRHTKVVVTGNNRTKSVLVGLQGVVKKAVGLGGWHWLVLKNGVEVKLQRNALSVLEAPTGNEDDDEIDGGNNSFCGSFHMGDKDMNYSSIEYQKPTKPRVRHTRPWSSCTTTSSSRANNLHSTSKLRARVNLTKLGTPTLWRYWKHFNLVSMNPTPSEEQLFHGVQQHFQSQQLDELQVILGFIQTAKRLKTLYKNN

SEQ ID NO: 42123 - protein, 442 aa, Triticum aestivum
MATRHNQQNAAAAPQPAANRGAAVPAGKQKDAAAAGGRPGAGGNRRVLGDIGNVVHAHVLDGKIQLPAGINRPITRSFGAQLLQKAQADPSKNGVAVPPAARAGLKPVAKKVPVKLKPAAPRPEPAAKIVTGSGENRKPSEVAAVCSAPRKKVVHTLTTVLSHRSKEASIDDIDKLDGDNELAVVDYIDDIYRYYKEAQHECRPIDYMGSQPEINPKMRAILIDWLVEVTHKFELMPESMYLTMYVIDRFLSLQAVPRRELQLVGMAAMLISCKYEEIWAPEVDDFISIADYSYSRQQILSMEKNILNSMAWNLTVPTPYVFLVRFAKAAGSDKELEHMIFFFAEMALMEYGLVTVRPSLVAAFAVYAARCTLKRSPIWTETLKHHTGFAEPQLLEPAKVLVMAHAAAPECKLKAIYKKYSSEQYGRVSLRPPAVAAPQRLA

SEQ ID NO: 42124 - protein, 374 aa, Synechocystis sp. PCC 6803
MPLDNGSITDDTRIRAALPTIKDLLSKGAKVILGSHFGRPKGKVVDSMRLTPVGDRLGELLGQPVVKCDDCIGAEVTAKIASLPNGGVALLENLRFHAGEEGNDAEFAKALAANADLYVNDAFGTAHRAHASTEGVTHFLSPNVAGYLIEKELQFLQGAIEAPKRPLVAIVGGSKVSSKIGVIETLLDKCDKLIIGGGMIFTFYKAQGLNTGKSLVEEDKLDLAKSLMAKAKEKGVEFLLPTDVVVADNFAPDANAQTVGVDAIPDGWMGLDIGPDSVKTFQDALAGCGTVIWNGPMGVFEFDKFAVGTEAIACSLAELTASGTVTIIGGGDSVAAVEKVGVAEKMSHISTGGGASLELLEGKVLPGIAALDDR

SEQ ID NO: 42125 - protein, 598 aa, Candidatus Desulfococcus oleovorans Hxd3
MNRIRNFSIIAHIDHGKSTLSDRLIQVSGIVAARDFRDQILDSMDLERERGITIKSQTICLPYKAKDGAVYSLNLIDTPGHVDFSYEVSRAIASCEGALILIDASQGVEAQTVANLYLAVDHDLEIIPVINKIDLISADVERVMEQIEEDLGLDSSAAVKVSAKEGVGIEDLMETIVAKLPPPKGNLEAPLQALIFDSTYDDFRGTVIHVRVFEGKVKPGDMIMFMSNDSVYKVEEVGIFQIVRKPRKVLAAGEVGYIIAGIKSLSDTRCGDTITLKTNRCAAAMPGFREAKPVVFSSIFPIGSDEYEDLATAIDKLKLNDASLVYEKTSSLALGFGFRCGFLGLLHLEIVQERLEREYDQSLIITAPTVRYEVVYHDGTSMFIDNPELFPDPTLIQTTREPFIKASIIIPDKYMGAVMTLCMERRGISTTYHYLTGSRMEMVFELPLAEVMYDFYDKLKTVTQGYGSFDYEMLDYRDSRLVKLDILVNGERVDALSQLAHEDKAVERARHACKMLSEEIPRQMFKIPIQGAIGGKIISRETISALRKDVTAKCYGGDISRKRKLLEKQKKGKKRMKTIGKVAIPQSAFLAVLKSDQT

SEQ ID NO: 42126 - protein, 481 aa, Methanococcoides burtonii DSM 6242
MKGIKSSRMKAIDENCEHLGLKGLQLMENAGAAIAHEVRERVQKGNVLIVAGRGNNGGDAFVAARHLAYDPAITINIALIGSASQIRSEDAINNYGLLEHCRINALIEITDPQKLKEMGWLDNADIIVDALLGTGITGKLKETEATIIDLINDSNVPVIAVDVPSGFDPDGGEFERSVRADVTLTFHRMKKGLVSGHAKEYTSEVKVINIGVCEDAEKYVGEGDINAFRTRHGDSHKGQHGKILIIGGGPYSGAPALTAMAALRAGADIVTVAAPANVADIIASFSPNIIVKALSSNILCKEDMGTITKLIESHDVVVIGMGLGRAEQTKDTVSKIIPLCTKVVADADALYGIDLPVPKGIEMIITPHAGEYNALGGNGKEDTLEFSKRNNVTILLKGREDHISNGKRIAINRNGNPGMTVGGTGDVLAGIAGALFATACKMDAACGAAYINGAAGDLAFERMGSGLLATDIIDMITEVMK

SEQ ID NO: 42127 - protein, 449 aa, Zea mays
SAWSFARPSRDSAEASAAATEGSVRGGGNAAIARAAEAAWLKSLYDDTGRQQSKHAIAVAAATAAAADAAVAAAQAAVEVVRLTSQGPVFGGGGPVPVLDPRGRAGAAVKIQTAFRRFLAKKALRALKALVKLQALVRGYLVRRQAAATLQSMQALVRAQAAVRAARYSRALPALPPLHHHPPVRARFSLQERYGDDTRSEHGVAAYSRRLSASIESASYGGGYDRSPKIVEMDTARPRSRASSLRTEDEWYAQSVSSPLLPPPPPPPCQHLHQYHHLPPRIAVPTSRHFPDYDWCAPEKPRPATAQCTPRCAPPTPARSVCGAGGNGGGYLAASPGCPGYMSSTRSSEAKSSSRSQSAPKQRPLEQQEQQQQPARKRVPLSEVVLEARASLGGAGVGMHKPCNTRAQAQDAFDFRTAVVSRFDRRASDAAAAAAERRDRELFFLQRRW

SEQ ID NO: 42128 - protein, 611 aa, Arabidopsis thaliana
MDPIESVEYNGFETSNGNVDHGWKKVVYPKRHRKQKQADQATANGGKTVASNGTVANGGDNVFRSLEEQAEDRRRRILAAKMTAIDSDDDGVVRSKHRSNGYGDDGYDFDGSDDEIATLKVEEEVKKPKPKKEKKPKVSLPEAASKIDPLNLEAFLVEASESYASQPEIQLMRFADYFGRALSGVSSVQFPWVKMFKESPLSKLIEVPLAHIPEPVYKTSVDWINHRPIEALGAFVLWAFDCILTDLAAQQGGAKGGKKGGQQTTSKSQVAIFVALAMVLRRKPDALTNVLPTLRENPKYQGQDKLPVTVWMMAQASQGDIAVGLYSWAHNLLPVVGNKNCNPQSRDLILQLVEKILTNPKARTILVNGAVRKGERLIPPPSFEILLRLTFPASSARVKATERFEAIYPLLKEVALAGAPGSKAMKQVTQQIFTFALKLAGEGNPVLAKEATAIAIWSVTQNFDCCKHWDNLYKENLEASVAVLKKLVEEWKEHSVKLSSSPNDALTLNRTMKSFRLKNEEVITEGGANASLYKEADKSCKTISGRLSRGSGCLKGTAITLVFLAAAGAAAAAVLSSNPEVTNELKNLVDSLELHEYINKYTEVISTALKK

SEQ ID NO: 42129 - protein, 99 aa, Methanococcoides burtonii DSM 6242
MTDADMSVLNEVFDVIMDRKNNPVEGSYVCSLLDHRKGINKILEKVGEETAETILAVKDNDRAEIIYETSDLLFHLLVMLAATDITLDDIAEEMKKRRH

SEQ ID NO: 42130 - protein, 855 aa, Mycobacterium avium
MSADGISRDGCAPRHIIVVGHGMVGHRFVEALRARDTEGRWRITVFAEEADAAYDRVGLTSYTESWDRALLALPGNDYQGDPQVRLVLNQRVTEIDRATKSVVTADGQRHHYDTLVLATGSYAFVPPVPGHELPTCHVYRTLDDLDAIRADAQRAAQTDHARAGVVIGGGLLGLEAANALRQFGLATHVVEMMPRLMAQQIDEAGGALLARMIGDLGISVHVGTGTEAIEPVEGPDGSTTVRVRLSDGQVIDAGLVIFAAGIRPRDELAVAAGLARAERGGVLTDLSCRTSDPDIYAIGEVAAIDGRCYGLVGPGYTSAEVVADRLLDGSAEFGEADLSTKLKLLGVDVASFGDAMGTTENCLEVAINDAVNRTYAKLVLSDDAKTLLGGVLVGDASSYGVLRPMVGSELPGDPLALIAPASSGGGTALGVGALPDSAQICSCNNVTKGDLKCAIADGCADVAALKSCTSAGTSCGSCVPLLKQLLEAEGVEQSKALCEHFSQSRAELFEIISATEIRTFSGLLERFGRGKGCDICKPVVASILASTGSEHILEGEQASLQDSNDHFLANIQKNGSYSVVPRVPGGDIKPEHLILIGQIAQDFGLYTKITGGQRIDMFGARVDQLPAIWKRLVDGGMESGHAYGKALRTVKSCVGTDWCRYGQQDSVQLAIDLELRYRGLRAPHKIKMGVSGCARECAEARSKDVGVIATEKGWNLYVGGNGGMTPKHAQLLASDLDTETLVRYIDRFVMYYIRTADRLQRTAPWVESLDGGLDHVREVVCEDSLGLAEEFEAAMERHVRNYKCEWKGVLDDPDKLSRFVSFVNAPDAVDSTVAFTEHAGRKIPVSIGMPKIRQG

SEQ ID NO: 42131 - protein, 508 aa, Thermobifida fusca YX
MGSTATPAAPHVRIAIIGSGFGGIGLGVRLRQAGQTDFVILERAGDVGGTWRDNTYPGCACDVPSHLYSFSFAPNPHWPRSFSGQPHIRAYLEDVTDRFGLRPHIRTGHEVVEARWDPAQLRWTVRTTATTYTCDILVSAAGALADPVIPDIPGLDGFPGQVFHSSRWNHDHDLAGERVAVIGTGASAIQIIPAIQPLVQRLVVFQRTPAWVMPRADRPITRLEQWLFRTIPATQKLARAGVYLTRESMVGAFVRYPALLQAATVVARAHLRRAVRDPELRAKLTPDYVMGCKRILLSNDYYPALSRPNVDVVASGLQEVRGSTLVAADGTTHDVDTVVFATGFHVTDMPIANRIYDGAGRSLADHWRDGMSALRGTTVTGFPNFFLIVGPNTGLGHSSMIYMIESQLNYILSALRHLDSTGSAALEPRRSAQDAWNARLQQRMRRTVWARGGCASWYLDARGCNTTLWPGSTLSFRAATRRIDPAEYHLFPARTPTAPSAPTAPEVV

SEQ ID NO: 42132 - protein, 334 aa, Oryza sativa (indica cultivar-group)
MECSISRTNLNCISLGDPDTKKSVALLKQACLDSGFFYVVDHGISQELMDDVFAQSKKFFDLPINEKMELLRDEKNRGYTPMLDEILDPENQVNGDYKEGYYIGIEVPEDDPQANRPFYGPNQWPSDEVLPRWRKVMEQYHSEALRVAKSIARIIALALNLEEDFFDKPEMLGEPIATLRLLHYEGGQKTGKVSNPAEGVFGAGAHSDYGLITLLATDDVVGLQICKDRNAQPQVWEYVAPVKGGFIVNLGDMLERWSNCIFRSTLHRVVLDGRERHSIAFFVEPSHDCVVECLPTCKSESNPPKFPPITCSAYLSQRYKDTHADLTAYSSNKA

SEQ ID NO: 42133 - protein, 374 aa, Pseudomonas fluorescens Pf-5
MAKRDYYEVLGVERGSSDAELKKAYRRLAMKHHPDRNPGDKASEDMFKEANEAYEVLSDSSKRAAYDQYGHAGVDPSMGGGGGGFGGQNFSDIFGDVFSDFFGGGRGGSRGGAQRGSDLRYTLELNLEEAVRGTTVNIRVPTLVNCKPCDGSGAKKGSSPVTCPTCGGIGQVRMQQGFFSVQQTCPRCHGQGKIISDPCDSCHGEGRVEEYKTLSVKVPAGVDTGDRIRLSGEGEAGTQGGPTGDLYVVINVREHAIFQRDGKHLFCEVPISFVDAALGGELEIPTLDGRVKLKIPEGTQTGKQFRIRGKGVAPVRGGGAGDLMCRVAVETPVNLSRRQRELLEELRGSLDDDNSHSPKTTGWFEGVKRFFGDL

SEQ ID NO: 42134 - protein, 641 aa, Oryza sativa (indica cultivar-group)
MLSARAAATAAAAAAAASPLWKRGEGGSSGSGSGCTSCREVRRRAAAVRVRAAAPRRVEAVAMESAAETEKEEEVAAAGGGVEDMATEEVPVTPWAFSVASGYTLLRDPHHNKGLAFSEKERDAHYLRGLLPPAVVSQDLQVKKIMHNLRQYSVPLQRYMAMMDLQERNERLFYKLLIDNVEELLPVVYTPTVGEACQKYGSIFRQPQGLYVSLKDKGKVLDVLRNWPERNIQVIVVTDGERILGLGDLGCQGMGIPVGKLSLYTALGGVRPSACLPITIDVGTNNEQLLNDEFYIGLRQRRATGKEYHELMEEFMSAVKQIYGEKVLIQFEDFANHNAFDLLAKYSKSHLVFNDDIQGTASVVLAGLLSSLKVVGGTLAEHTYLFLGAGEAGTGIAELIALEISKQTKAPIEECRKKVWLLDSKGLIVNSRKESLQAFKKPWAHEHEPVTTLLDAVQSIKPTVLIGTSGVGKTFTKEVIEAMASFNERPVIFSLSNPTSHSECTAEEAYNWSQGRAVFASGSPFDPVEYNGKIHVPGQSNNAYIFPGFGLGVVISGAVRVHEDMLLAASETLADQATQENFEKGSIFPPFTNIRKISARIAASVAAKAYELGLATRLPQPRDLEKYAESCMYTPVYRSYR

SEQ ID NO: 42135 - protein, 1073 aa, Pseudomonas fluorescens Pf-5
MPKRTDIKSILILGAGPIVIGQACEFDYSGAQACKALREEGYRVILVNSNPATIMTDPAMADATYIEPIKWQTVAKIIEKERPDALLPTMGGQTALNCALDLEREGVLEKFGVEMIGANADTIDKAEDRSRFDAAMKSIGLACPRSGIAHSMEEANAVLDKLGFPCIIRPSFTMGGTGGGIAYNREEFEEICARGLDLSPTKELLIDESLIGWKEYEMEVVRDKKDNCIIVCSIENFDPMGVHTGDSITVAPAQTLTDKEYQILRNASLAVLREIGVETGGSNVQFGICPNTGRMVVIEMNPRVSRSSALASKATGFPIAKVAAKLAVGYTLDELSNDITGGKTPASFEPSIDYVVTKLPRFAFEKFSKADARLTTQMKSVGEVMAIGRTFQESLQKALRGLEVGVCGLDPKLDLSNPESMNVLKRELTVPGAERIWYVADAFRAGMTVEQIFGMNMIDPWFLVQIEDLIKEEEKVKTLGLSAIDRDLMFRLKRKGFSDQRLAKLLGVTEKNLRTHRQKLEVFPVYKRVDTCAAEFATDTAYLYSTYEEECEAAPSTRDKIMILGGGPNRIGQGIEFDYCCVHAALALRDDGYETIMVNCNPETVSTDYDTSDRLYFEPVTLEDVLEIVRVEKPKGVIVQYGGQTPLKLARALEAAGVPIIGTSPDAIDRAEDRERFQQMVERLNLRQPPNATVRSEDEAIRAAAKIGYPLVVRPSYVLGGRAMEIVYEEDELKRYLREAVQVSNDSPVLLDHFLNCAIEMDVDAVCDGTDVVIGAIMQHIEQAGVHSGDSACSLPPYSLPAHIQDEMREQVKKMALELGVVGLMNVQLALQGDQIYVIEVNPRASRTVPFVSKCIGVSLAMIAARVMAGKTLKELGFTKEIIPNFYSVKEAVFPFAKFPGVDPILGPEMKSTGEVMGVGDTFGEAFAKAQMGASEVLPTGGTAFISVRDDDKPLVAGVARDLINLGFEVVATAGTAKLIEAAGLKVRRVNKVTEGRPHVVDMIKNDEVTLIINTTEGRQSIADSYSIRRNALQHKIYCTTTIAAGEAICEALKFGPEKTVRRLQDLHAGLKA

SEQ ID NO: 42136 - protein, 379 aa, Prochlorococcus marinus str. MIT 9211
PHANERTPHASGTGSRSGSLRQSRPGFGGDLMTLPNTMKALEKSHPEAGLWMVQAPVPEIGPDEVLIKVRKTGICGTDIHIWNWDDWASATVPTPMITGHEFAGEIVEIGRDVTGLSIGQRCSGEGHLIGTDSRQSRAGKFHLDPGTRGIGVNEQGAFAQYLRLPAFNVVPLPASIPDEIGAILDPLGNAVHTALSFDLLGEDVLITGAGPIGIMAAAVARHAGARNVVITDINPDRLKLAEHVVPTVRAVDVRNEALEDVIHELGMKEGFDVGLEMSGNQVALDQMVESLVMGGKIALLGIPPGKSPVDWSRIVFKAITIKGVYGREMFETWYKMIAMLENGLDVSRVITHEFAVDQFRDGFEAMLSGRSGKVVLNWA

SEQ ID NO: 42137 - protein, 371 aa, Campylobacter coli RM2228
MTYDIAVIGSGSVGSFAGYYAAKMGLKTCLIDKFQAPHTQGSYHGDTRIFRIAYGEGEKYIPLLQEAYTLWGEFEKEQNIKLFERCGLLNIGSNSTFMQNVLSSVKNYDLKAKILNAKELQENYNICVSDDFFGVLETDTGFVYSDLSVKSAINAACKLGAHTLCDEIVRICKENGVYKIQTQNSSIQAKQILISAGSYVNEVLGVCEFDLPKVPVGIRRKVVNWFDTDSYKLSQGFPAFILEFEDDYFYGFPDFADGLKVGRDKVGEIISTREERVEFGSYEQDTLDIGKHIKEFFPDLKDFSKGSVCTYPLSPDDDFIIDFLDENLFFMGGLSHGFKFAPALGLLGVKALQTQKLDPSIKQYFSLKRFG

SEQ ID NO: 42138 - protein, 498 aa, Magnetospirillum magnetotacticum MS-1
MCGIAATIGLSDATAFTSLFGAIGHRGPDESGIRESGDIRIGMHRLAIVGRMGDSVPLIGADGLVLAFNGEIYNHQALRADFPDYPFAGQSDAEVLFPLLKRHGLGGLDRLRGMFAFVLTDMESGEFLAVRDPFGIKPLYYAETGGGFAFASEMKAFAAMGITPRFLPPGHLLTRHGLRRWYRVPGRFRLSRRPNLRALLERAVASHLPPEGPCGVFLSGGLDSSLVAALAARSRPDMVAYSVVLPGSPDEEPAALMAAHLGIRHKVLRATADDIRAALPEVIGALESFNPIMVRNAVPLYLLSKMAAKDCKVVLGGDGADELFAGYDYLSRVPRRFWPQAMDYGFSNLHRTELQRVDRMTMAHGLELRVPFLDREVAEAAVNLPLSAKFGIKDGTPMPKLALREAAEGLLPPSIQWRRKLPLADGSGFGGLDLGAGRDKADPVPGWDVGDEDAVAFFPLWRVRFPLARPDSAIWRDCGRYHDFEECHGRPLLELFRR

SEQ ID NO: 42139 - protein, 661 aa, Ehrlichia canis str. Jake
MGNRYNDMVNMANAIRVLSVDAIQNAASGHPGMPLGMADVATVLFAKFLKFTPKDTSWFNRDRFVLSNGHGSMLLYSILYFLGCLDIEEIKRFRQIHSLTPGHPEYGCTPGVDATTGPLGQGLACAVGMAIAERVLSEKFGSELVDHMTYVMVGDGCLMEGISHEAASLAGHLQISKLIVLFDDNGISIDGDTSLAVSDDIKARFLSYGWDVFEIDGHDFDEIESSIENARRSSKPSLICCKTIIGKGLVSKENTSAAHSWPFSEEEVILMKEKLGWCDKPFDVPEEILQLWKSIASKSENEYKAWLNKCDDKASQSFVDVIKEGVSDSVFLSLKKLKKELCNLNLNEATRKSSGRILEVVMENTSKLIGGSADLTGSNNTKPQFASIINKDNFSGSYLHYGIREHAMAACMNGMALHGGVIPYGGTFLVFADYCRPAIRLSALMKRHVIYVMTHDSIGVGEDGPTHQPVEHVSSLRAIPNLYVFRPADAVEVLECWEIALRLTSSPSAFILSRQNVGNVRSLYVEENLSSKGAYIIREYEKDLDVTIFATGSEVEVALKAADILKGKGLDARIVSVPCWELFAQQDKKYIFSLLNNKSIKAAIEAASSFGWHKYIGEDGVFVGLDDFGLSAPCKDLYKHFGITAENLVNKILDKLKINID

SEQ ID NO: 42140 - protein, 591 aa, Candidatus Desulfococcus oleovorans Hxd3
MTDGRNEIKLVGVAGSPGICIGKAYLIDTDTSGVEVVEKYFIDSKNISKEVNRFKAAVKKAKDELSAIIKDVPEDLQDHVHILETHMVMFKDKMLYGKTIETIENEQVNAEWALKKTVADVREMFRDIADPYIKGRVTDIAQVTNRIMQQLLGTTTVDIGKIDKRVILVAHDLSPADTSQIQLDKIKGFVTDRGGRTSHTAIIAKTLDIPSVLGMENATKMIRNDDIIIVDGESGIVIVNPTDESIIKYQNREQEYEAYKIDVAKSSHLPVQTVDGVSVKVLANIELPAEIGHAKEYGADGIGLFRTEFLYLSRKEFPTEEELFLEYRKVVETMAPKPVTIRTLDINGDKVVAYDQTEEEANPALGLRAIRFCLKRPEVFQTQLRAILRASAFGNVKVMFPLISAYEEMVQAREALDTAADSLKKDGLAYNGDIEVGAMIEVPATVIIADMLADIVDFFSIGTNDLVQYSLAIDRGNRQVAHLFQTFHPAVIRMIRQVIEVGKSKGVDVVMCGEMAGFPINLPILLGLGLERLSMNPPAIPIMKNAIRSMKAGDTKSFMDEVFTKNTAAQISDLVHQRFGDLFPSLPDITQ

SEQ ID NO: 42141 - protein, 526 aa, Oryza sativa
MASESESNGHHHAGDEARAENSGAGCLHGGDDGGGTPRTTPEIRYTKLFINGRFVDAASGKTFETSDPRTGDVIARVAEGDKEDVDLAVKAAREAFDHGEWPRMSGSERGRVMAKYAEVVERHADELAALESLDAGKPLAAARAVDVGECVGILRYFAGAADKIHGETLKMSRQLQGYTLREPLGVAGLIVPWNFPAIMFFSKVSPALAAGCTVVVKPAEQTPLSALFLAHLSKQAGVPDGVINVVTGFGPTAGAAISSHMDVDVVAFTGSTEVGRLIMEASAKSNLKPVALELGGKSPFIVFDDADLDRAVELAIGGNFFNKGEACVAGSRVFVQEGIYDRFEQKLADTMKSWVVGDPFDPRVNQGPQVDKAQYERVLGYIEQVKAEGATVLTGGKPCGKKGYYIEPTIFTNVKDDMVIAREEIFGPVMCLMKFKTVEEAIERANGTRYGLAAGLVTRDIDVANRMARSIRAGVVWVNCYFAMDRSCPFGGRKMSGFGKDDSMHALDKFLAVKSVVTPVHGSPWF

SEQ ID NO: 42142 - protein, 230 aa, Triticum aestivum
  misc_feature (173)..(173): Xaa can be any naturally occurring amino acid
  misc_feature (180)..(180): Xaa can be any naturally occurring amino acid
  unsure (1)..(230): unsure at all Xaa locations
TSLYKKAGWYRVRNSLGYRRPTRPPLLAPLALSPAPISASQSSLLFLRTPVPALLSLRSASPGARLVTAVASKGPELGGGGSGGGDGAGSGGGGSGGSDPQGGGDEGEEDKMGEGLSMSQKLTLAYAALVGPGGVMGYMKSGSQNSLAAGGISALVLFFVHTQLPVRPLFASXIALSISXALLSVMGSRFNKSGKIFQQARGSLSSLTPRMGIPPRAFFGTSHTITVIPV

SEQ ID NO: 42143 - protein, 892 aa, Oryza sativa (indica cultivar-group)
MAAVVVDVLLACLALLLPASSCAAGAPTVAAAQTSAGAGGGYGAGCAKSCGDLTFDYPFGIGAGCARGHDFQLVCNTTTQPPTLFLSDGFTQVINSIGAAGYAVYVNFSLDIPMRSGVDLYNVSWTVPGDSFSVRDSARVTIGHGNFDVYLLDAYSSKRIILCSLTQPTNIDDTSDEGECQRNIPIVRGFQLQFVHRHEHGEGQRTSVDSVRIENDGVRLGWAIVDHSTCAEAKRDKSSYACASKHSRCDDNLSFTASRAGYLCKCTDGYQGNPYAPNGCRRDVGLPDARYDRFPSKNNCSPSCGNISVPYPFGLEKGCSANQHFLLRCTYYKDNKSTNPDLLWWATRYTDEPSTPTKLVRIDISEGLIILAGEHYEEFLAMDGTASARVSDGSAKDFVVKNLHFAITNQTCKEAQQNTTGYACVSVNSTCLAVNTGDGYIGYRCKCKHGFEGNPSIKDGCQGICPEICNNTVGNYTCIKCPAKSEYNDKTKRCTSVKKQKNLLFGIVIGLSAGFGILLPGLSAKMLFHKWKKGIQKRLRRKNFRKNEGLLLEQLISCDETTTDRMSIFTLEELEKATNNFDHTRILGQGGHGTVYKGILSDQRVVAIKKSMTIKQGEITHFINEVAILLRINHRNIVKLFGCCLETEVPLLVYDFISNGSLFELLRYNSSNGSLLSWEDTLRIATEVAGALYYLHSAASVSVFHRDVKSSNILLDANYTTKVSDFGTSRLVSIDQTHIVTKVQGPFGYLDPEYCQTECLNEKSDVYSFGVVLLELLLMKEPIFTSENGLKLNLAGYFLEEVKVRPLSEIVTTKIYEEATEEEINNVTLLAEMCLSPRGEERPTMKQVEMTLQSLRNVTQTTAVHRANASDQLSQRCYSLEHEFIASAELPR

SEQ ID NO: 42144 - protein, 118 aa, Spiroplasma kunkelii CR2-3x
MKMNLTEEITKDQLRSDLPQFSSGDTIKVHYKIKEGNKFRIQAFEGVVIKLQGSGIVESVTICKISNGTGVERKFPLHSPLIDKIEIVKYGRVRRARIYYMRNRTGKAARIKEIIKTK

SEQ ID NO: 42145 - protein, 796 aa, Cryptococcus neoformans var. neoformans JEC21
MSTTIQQGDTDTGAGNHLPAWLLAMSGIFTAVATAISMMSIVLQLKNYRKPTLQRAVVRIMVMVPLYAISSLIALFSLEAAFFIDAIRDLYEAFVIYTFLQLLITYLGGERSLLIILHGRPPIPHPFPVNIFLQPMDVSDPWVLLNLKRGVLQYVQVKPLLVLATVALKATGTYQEGRFAADSGYTYVSIAYNTSICLSLYCLAMFWVAVNKDLKPFRPVPKFLCVKGILFFSFWQSIGISLLVAMGAIRKVGPYTDPEHMSLALVDSLICFEMPIFAIAHQYAFQASDYIDHNLVYAARLPFIYAFRDAFGFKDVWQDTIDTFKGRGVSYQAYEPAEGGLHYGVGRQKRIRAGLRYAKGGKMKYWMPKPGDEARMKGQSGLITSMKRRVDERLAEREGYAPLLPQQAARVVHLDPGRYTTYTGGERMFDSDSSDDSDAPSLTFHSADEMEDAMYDRARRIGYAGFPNVDVSKEEARRKRREEEEGILKGRWTRSGLRVRDGTGLGGGEGQGEGRMRAGSAAKGKSNGKNKDKGKGKGQSRKVYGTWADHPPSVQRFNSSSSSTRNGNGNGHPADFDEADDEGVVRQEEEGRAIKKKRQRQSPPVWVTRTGATTGVGSSSSPFSIGDDDDDDDEDGEGVKNRETQGDRSMSFNHPDNSSHNSDSDSEHSVKPSTTKKLPADAVDLVKEDYEAVEAARERERRRGEPQTNAPAHVYRKTIIDEIPETDTNAGAMKRRRGIGGRIEEIQEVYAHDPHVMTKDEIQTGVKEVVDHVETSLTVEPPKHAMSLDLEDNPWS

SEQ ID NO: 42146 - protein, 251 aa, Pseudomonas fluorescens Pf-5
MRRPMVAGNWKMHGTRASVAELINGLRHLALPSGVDVAVFPPCLYINQVIDGLKGKSIQVGAQNSAVESMQGALTGEIAPSQLVDAGCSLVLVGHSERRLIMGERDATLNRKFAAAQACGLKPVLCVGETLEQREAGKTLEVVGRQLGSIIEELGVGAFANAVIAYEPVWAIGTGLTATPQQAQDVHAAIRAQLAAENSEVARGVRLLYGGSVKAANAVELFGMPDIDGGLIGGASLNADEFGAICRAAGN

SEQ ID NO: 42147 - protein, 861 aa, Nicotiana tabacum
MMMVGKLFSLLHFFTLFCLFTVTFASTKEATALLKWKATLQNQSNSLLVSWTPSSKACKSWYGVVCFNGRVSKLDIPYAGVIGTLNNFPFSSLPFLEYIDLSMNQLFGSIPPEIGKLTNLVYLDLSFNQISGTIPPQIGSLAKLQTLHILDNHLNGSIPGEIGHLRSLTELDLSINTLNGSIPPSLGNLHNLSLLCLYKNNISGFIPEEIGYLSSLIQLDLNTNFLNGSIPASLENLHNLSLLYLYENQLSGSIPDEIGQLRTLTDIRLNTNFLTGSIPASLGNLTSLSILQLEHNQLSGSIPEEIGYLRTLAVLSLYTNFLNGSIPISLGNLTSLSSLSLYENHLSGPIPSSLGNLDNLVYLYLYANQLSGPIPSELGNLKNLNYMKLHDNQLNGSIPASFGNLRNMQYLFLESNNLTGEIPLSICNLMSLKVLSLGRNSLKGDILQCLINISRLQVLKIPDNNLSEEIPSSICNLTSLRILDLSRNNLKGSIPQCFGDMGGHLEVLDIHKNGISGTLPTTFRIGSVLRSFTLHENELEGKIPRSLANCKELQVLDLGDNLLNDTFPMWLGTLPKLQVLRLKSNKLYGSIRTSKDENMFLELRIINLSYNAFTGNIPTSLFQQLKAMRKIDQTVKEPTYLGKFGADIREYNYSVTVTTKGLELKLVRILTVYIIIDLSSNRFEGHVPSIMGELIALRVLNLSRNGLQGHIPPSLGNLFVIESLDLSFNQLSGEIPQQIASQLTSLAVLNLSYNHLQGCIPQGPQFHTFENNSYEGNDGLRGFPISKGCGNDRVSETNNTVSTLDDQESTSEFLNDFWKAALMGYGSGLCIGLSILYFMISTGKLKWLSRITEWLQNRFII

SEQ ID NO: 42148 - protein, 470 aa, Oryza sativa (indica cultivar-group)
MGKAARWFRSLWGGGGGKKEQGREHGRTAAAPPPPDRKRWSFAKSSRDSTEGEAAAAAAAAAVGGNAAIAKAAESAWLKSMYSDTEREQSKHAIAVAAATAAAADAAVAAAQAAVEVVRLTSQGPPTSSVFVCGGVLDPRGRAAAVKIQTAFRGFLAKKALRALKALVKLQALVRGYLVRRQAAATLQSMQALVRAQAAVRAARSSRGAALPPLHLHHHPPVRPRYSLQERYMDDTRSEHGVAAYSRRLSASIESSSYGYDRSPKIVEMDTGRPKSRSSSVRTSPPVVDAGAAEEWYANSVSSPLLPFHQLPGAPPRISAPSARHFPEYDWCPLEKPRPATAQSTPRLAHMPVTPTKSVCGGGGYGASPNCRGYMSSTQSSEAKVRSQSAPKQRPEPGVAGGTGGGARKRVPLSEVTLEARASLSGVGMQRSCNRVQEAFNFKTAVLSRFDRSSEPAAERDRDLFLQRRW

SEQ ID NO: 42149 - protein, 555 aa, Staphylococcus aureus subsp. aureus Mu50
MTHLSDLDIANQSTLQPIKDIAASVGISEDALEPYGHYKAKIDINKITPRENKGKVVLVTAMSPTPAGEGKSTVTVGLADAFHELNKNVMVALREPALGPTFGIKGGATGGGYAQVLPMEDINLHFNGDFHAITTANNALSAFIDNHIHQGNELGIDQRRIEWKRVLDMNDRALRHVNVGLGGPTNGVPREDGFNITVASEIMAILCLSRSIKDLKDKISRITIGYTRDRKPVTVADLKVQGALAMILKDAIKPNLVQSIEGTPALVHGGPFANIAHGCNSILATETARDLADIVVTEAGFGSDLGAEKFMDIKAREAGFDLAAVVVVATIRALKMHGGVAKDNLKEENVEAVKAGIVNLERHVNNIKKFGVEPVVAINAFIHDTDAEVEYVKSWAKENNVRIALTEVWEKGGKGGVDLANEVLEVIDQPNSFKPLYELELPLEQKIEKIVTEIYGGSKVTFSSKAQKQLKQFKENGWDNYPVCMAKTQYSFSDDQTLLGAPSGFEITIRELEAKTGAGFIVALTGAIMTMPGLPKKPAALNMDVTDDGHAIGLF

SEQ ID NO: 42150 - protein, 1230 aa, Arabidopsis thaliana
MINLSLYQTNSLSYTIIWMLFVIPSCVLSVDERQKHCSPTFRCGKQTDLYYPFWSPDREECGHPVFKVNCSGDFAEFTISTVKFHVLEMNYESRIIRLVRTEYLNNLCPWHPENRSINQEVLPFLQDTELGTFYYNCSGPTVDELANGYIRQLGCDEEVGGKSYFVSSPSHPGNRAILDGLSASCERNVDIPVSRSAMETTATNQSLEAIKKVLDVGFELGFNSDCSLCVASKGACGFNQSSKAFVCYCKDEPHEHTCGKMGIGIGLGCGFLGATLITVCLLCFFFQKRRTSHHLRPRDNNLKGLVQLKQYSYAEVRKITKLFSHTLGKGGFGTVYGGNLCDGRKVAVKILKDFKSNGEDFINEVASMSQTSHVNIVSLLGFCYEGSKRAIVYEFLENGSLDQFLSEKKSLNLDVSTLYRIALGVARGLDYLHHGCKTRIVHFDIKPQNILLDDTFCPKVSDFGLAKLCEKRESILSLLDARGTIGYIAPEVFSGMYGRVSHKSDVYSYGMLVLEMIGAKNKEIEETAASNSSSAYFPDWIYKNLENGEDTWKFGDEISREDKEVAKKMTLVGLWCIQPSPLNRPPMNRIVEMMEGSLDVLEVPPKPSIHYSAEPLPQLSSFSEENSIYTEIWMTTRITTICSQKRKFAVMFPHSKTESCEKRDGQCGDITVGFPFWGENRQSDCGHFSLKLNCNKPSNTTSLTISGHNYSVLHIDNKSNILSLSRQDFSGPFCSASFSSTPLRSDLFQNLQPYRNLTVFYMCDPRRHFFGNFTCPVKGLGSVVQNSTYRKLCDKSFSVTVPTSYVPEEEALNLTHLESVLRKGLEVKLKISEMSGQECVTTDGNSGFTRFCCTNVSGPEISCLTSITTMNNGTYSDNRPFLVTIGTAFYLNERRIAKAARIQHLEALGTLRGYNYKQIKKITKSFTEVVGRGGFGTVYRGRLRDGRKVAVKVLKDSKGNCEDFINEVASMSQTSHVNIVTLLGFCYEGSKRAIIYEFLENGSLDQSLNLDVSTLYGIALGVARGLEYLHYGCKTRIVHFDIKPQNVLLDENLRPKVADFGLAKLCEKQESILSLLDTRGTIGYIAPELFSRMYGSVSHKSDVYSYGMLVLEMIGARNKERVQNADPNNSSAYFPDWIYKDLENFDNTRLLGDGLTREEEKNAKKMILVGLWCIQFRPSDRPSMNKVVEMMEGSLDSLDPPPKPLLHMPMQNNNAESSQLSVESSIYSEV

SEQ ID NO: 42151 - protein, 323 aa, Silicibacter sp. TM1040
MTPRELTCDETLAEMARVLTVEAAALTQMASEVGDPQLKAVEILEAMEGRVIVSGVGKSGHIGNKIAATLASTGTPAQFVHATEASHGDLGMVTPRDVCLVISNSGETSELADIVTYSRRFAIPLIAITRKADSTLATQADVVLLLPDAPEACGIGMAPTTSTTATLAMGDALAVALMKRRGFEREDFKVFHPGGKLGAQLMLVDGLMHTGEALPLVAPETPMTEALLIMTAKGFGLAGLVEGGRLTGIITDGDLRRNMDGLMARSAGEVATRGPKVIRRGSLASEALHDMNSRKISALFVLDNEDRVAGLLHIHDCLRAGLA

SEQ ID NO: 42152 - protein, 431 aa, Trichodesmium erythraeum IMS101
MIKEIFMPALSSTMTEGKIVSWQKTSGDWVEKGETVVVVESDKADMDVESFFSGYLATIIVEAGDVAPVGSTIGLLAETEAEIEQAKQQGVTTLNKEPANTSSSTTPVATAPISTATENQENSSRRNGRIIASPRARKLAKDLKVDLSTLKGNGPHGRIVAEDVEMAAGRIPAVVAASAKSTIPTTPTQVSIPAPPPPPSVVSAPVTPGQVVPMNSLQNAVVRNMNVSLSVPTFHVGYTITTDNLDRLYKQIKSKGVTMTAILAKAVAITLQKHPLLNAVYVDQGIQYPSGINIAVAVAMPDGGLITPVLPNADKMDIYSLSRTWKGLVDRARAKQLQANEYSTGTFTISNLGMFGVNRFDAILPPAQGSILAIGASQPQVVATDDGMIGVKRQMEVNITCDHRIIYGADAAAFLQDLANLIENNSQSLTM

SEQ ID NO: 42153 - protein, 113 aa, Colwellia psychrerythraea 34H
MSQITTHILDTTRGLPAKNVPITLFAQDGEGWKEVNGGVTNEDGRLPGLLAVDETLAAGVYRMHFATAVYFKANNEAGFYPYVDIVFEIDASGTHYHIPLLLTAYGYSTYRGS

SEQ ID NO: 42154 - protein, 329 aa, Triticum aestivum
NKFVQKSRLVPVRNSRDIVDPRVRSASLTGLPALHQKFDLPAPFVLHTDCPHYWRFHLPGETEEEFATRLAKNLEDLILKEGPETIAAFIAEPVMGAGGVIPPPKTYFDKVQAVVKKYGILFIVDEVITAFGRLGTMFGSDMYNIKPDLVTLAKALSSAYVPIGATLVSPEIAAVVDSQSNKLGSFAHGFTYSGHPVACAVAIEALKIYRERNIPDHVKQIAPRFQEGTKAFAGSPIVGEIRGVGLILGTEFANNKSRDDPFPAEWGVGAIFGQECQKRGMLVRVAGDSIMMSPPLTMTPGEVDELVSIYGEAMKATEERVAELKSKKN

SEQ ID NO: 42155 - protein, 123 aa, Zea mays
MSAMETDINAPPPAPAGEGSSVVGPSSSSSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 42156 - protein, 541 aa, Zea mays
  misc_feature (61)..(61): Xaa can be any naturally occurring amino acid
  unsure (1)..(541): unsure at all Xaa locations
CVKYLLQYISGSLCVRALTAAEPHSCSCAVYLSLVVLCRPSYCGREKGVCRPAAKHCYPAXAAMEVSSVEFGHHAAAASKCFDDDGRLKRTGTMWTASAHIITAVIGSGVLSLAWAIAQLGWVAGPTVMLLFSFVTYYTSALLADCYRSGDACTGKRNYTYMDAVNANLSGVKVWFCGFLQYANIVGVAIGYTIAASISMLAIQRANCFHVEGHGDPCNISSTPYMIIFGVVQIFFSQIPDFDQISWLSILAAVMSFTYSTIGLGLGIAQVVSNKGVQGSLTGISVGLVTPVDKMWRSLQAFGDIAFAYSYSLILIEIQDTIRAPPPSESKVMRRATVVSVAVTTFFYMLCGCMGYAAFGDNAPGNLLTGFGFYEPFWLLDVANAAIAVHLVGAYQVYCQPLFAFVEKWARQRWPKSRYITGEVDVPLPLGTAGGRCYKLSLFRLTWRTAFVVATTVVSMLLPFFNDVVGLLGALGFWPLTVYFPVEMYIVQKKVPRWSTRWVCLQLLSVACLVITVASAAGSVAGIVSDLKVYKPFVTTS

SEQ ID NO: 42157 - protein, 446 aa, Rubrobacter xylanophilus DSM 9941
MDASEARGERAGDHPALRRAVTPLLLLFFIVGDMVGGGIYALVGEVGAITGGAIWSAFLLALVLALFTAFAYAELVSKYPRAGGAASYVHRAFKTPFFTFMVAFAVVMSGVTSASALSIAFGGDYLAEFIAGPTVIIALVFILVVGFVNFYGIRESVTLNAIFTCIELGGLLLIVLIGVVALVSGSGEPSRAFEFREGVSVPLAVLSGAALSFYALIGFEDSVNVAEEVQDPQRSFPRALFGGILLAGIIYLLVTFTAAMVVPVERLAASSGPLLEVVEASPLGVPTWLFALIALFALSNGALINMIMASRLIYGMGDQGVMPSVFARVHPLRRTPWVSIAFTTLIAVGLISTGDIEDLASTTVVLLLLVFVVVNATVLVLRRDRVEHEHFRAPSVFPVLGILVCVGLLTQQEADIWLRALVLLVVGAVLYGVNYLATRYLDRRGA

SEQ ID NO: 42158 - protein, 355 aa, Zea mays
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAEYTVRTLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 42159 - protein, 398 aa, Pasteurella multocida subsp. multocida str. Pm70
MTQYNREIFDQVMIQNYVPAQFIPVRGKGSHVWDQQGKDYIDFTSGIAVNSLGHCADEIVDVLKQQSEKLWHSSNWFTSEPTLALATKLVEKTFAERVMFVNSGAEANEAALKLARRYAVDHFGYQKSKIIAFKQSFHGRTLFTVSVGGQAKYSDGFGPKPADIVHVPFNDLAAVQAVMDENTCAVIVEPIQGESGILPASQDFLQGLRELCDQHNALLIFDEVQTGVGRTGYLYAYMKYEVVPDILTSAKALGNGFPIGAMLTTHEIAKSFAPGVHGTTFGGNPLACAVAEKVIDIISAPPFLQKIQRTSEKFMQKLQEINQQCGLFKEIRGEGLLIGAELIEQYHGRASEFVKKAADNGLMILVAGPNVLRFAPALNISEEALALGFERLAKTLHI

SEQ ID NO: 42160 - protein, 357 aa, Prochlorococcus marinus str. MIT 9312
MLTNQNFIKVFFLETHVERISNLQDIKKAKLDRETGLFLYEDMTLGRRFEDKCAEMYYRGKMFGFVHLYNGQEAISTGVIGAMRKKHDWFCSTYRDHVHALSAGVPSFEVMSELFGKATGCSKGRGGSMHLFSKEHHLLGGYAFIGEGIPVALGAAFSSKYKKEVAGNNSSDSVTAAFFGDGTCNNGQFFECLNMAQLWKLPIIFVVENNKWAIGMAHDRATSNPEIWRKASAFGMHGEEVDGMDVLAVRGAAQRAIERARAGEGPTLLECLTYRYRGHSLADPDELRSEREKEFWSKRDPIKKLAHEIINGKFATEEELKIIEKKIDTEISESVKNALEAPEPPSQELTKYIWAED

SEQ ID NO: 42161 - protein, 452 aa, Cryptococcus neoformans var. neoformans JEC21
MLRNLRPLLRTVPAPSRSVIRPLSTTSKAFATAQSSPVRAHSVEELHALTAEEILKEGGVRKEAEMRHFTVNFGPQHPAAHGVLRLILELNGEEILRADPHIGLLHRGTEKLIEYKNYTQALPYFDRLDYVSMMTNELSYSIAVERLLNIEVPERAKWIRTLFGEITRVLNHLMAVLTHAMDVGALTPFLWGFEEREKLMEFYERVSGARMHAAYVRPGGVAFDLPHGLLDDIFKWATQFSSRVDEVEEVVTGNRIWKQRTIGIGPVTAQQALDYSFSGVMLRGSGIPWDIRKVAPYDAYDKVEFDVPVGKNGDCYDRYLCRVQEFRESLRIIGQCLNKIPDGAYKVDDHKIVPPPRASMKESMESLIHHFKIFSEGYSVPPGETYAAIEAPKGEMGVYLVSDGTNRPYKCKIRAPGFAHLAGADFMMRHHFLPDAVAIIGTMDLVFGEVDR

SEQ ID NO: 42162 - protein, 420 aa, Methanosarcina acetivorans C2A
MVSKDLPFTKEEILKITEKYPTPFHIYDEKAIRENARRMKSAFKDVPGFKEFFAVKALPNPFILKILKEEGFGADCSSLPELILAEKAGMTGDDIMFSSNDTPAEEFAKAKELGGFINLDDISHIHYLEKAAGLPEIVCFRYNPGPLKEGNAIIGKPEEAKYGFTREQMFEGYRVLRDKGVKRFGMHTMVASNELNSDYFVETARILFELIVEISKELGIQFEFVNLGGGIGIPYRPEQEPVSLEAVAKGVKEAYNATITANGLAPLKVYLECGRIITGPYGYLVSQVRHLKSTYKDYVGMDSCMSNLMRPGMYGAYHHITVLGKENKPPVHKYDVTGSLCENNDKFAIDRMLPEVEVGDILVIHDTGAHGHAMGFNYNGKLRSAELLLREDGSVVQIRRAETIEDYFATLDFEQLKSFR

SEQ ID NO: 42163 - protein, 705 aa, Cryptococcus neoformans var. neoformans JEC21
MKGLKKAMNLSRTKSSEKSKSPNPPAHKQSTASSGPSSPSVNSPSRQASDAPGLQGGAPITPRRSPINDKTSPAPPLVVISGAPQPPPINTEMPSDPIPHSPHGRYGSPERTLGADGQPTPPKVGPMNRLRGPKDTIPAVGKTPRKQRSSRFYVTEKVEIEKLPNFADVRPEQRNELFVQKLQQCRVVFDFNDASSDLEGKQIKSQTLHEMLEYITSQRGVITESIYPEVVSMFATNLFRSIPPQVNPTGDAFDPEEDEPVLELAWPHLQIVYEFFLRFVESPDFNTNIGKRYIDQSFVLQLLELFDSEDPRERDFLKTTLHRIYGKFLNLRAFIRRSISHVFFQFVYETERHNGIAELLEILGSIINGFALPLKEEHKTFLTRALIPLHKAKSLALYHPQLAYCVVQFLEKDPALTEEVVLGLLRYWPKVNSPKEVMFLNEVEEILDVIEHNEFIKIMQPLFVQLARCINSAHFQVAERALYYWNNEYIVNLMGEHISIILPIVFPALYQNSKTHWNRTIHGMVYNALKLFMEINQEVFEECQNNYRAQRKAESDRAIERYDEWLQLREQAIQNWESAHPSSPLPERLQEPPPPRPEPYEDEPMMDVSVDMTANGFDPSESFTLDRSIAEETVPVADPGVDRAPPLSPTSPTQLLGQQGQAPSSPTPSGGGTAPHLRRKSVLPIDAGVMRDLQNHRSLENDANP

SEQ ID NO: 42164 - protein, 682 aa, Zea mays
MLLRVRANPHTIPLAFGSGGGSPRLAAVQSSTTSSTPRTCWTAASAPTRSSRTSPRAWRRHYPESAPWGGRLRARRWPALVRHRPALLPARRAPVPRRRWLLMRRPPRVLGWVPSGGARRHWARAPASPALPPRPRPLRPGAPARRRRRTLPAVPAAAPRRGRRVPGATPNVQGWVRGYPRARPPHRPPGAGLRRSPASLAVGKSTPTQRPCFPGAFSDEDIPVVMEPDEIVPVVEQDPVVPMDISGEVEAGGNAAQRGMAIKDHIDLESAQSKKASPKDLAGSFWVAASVFSKKWQKWRRKQKLKKEAAVSKAAAAAMPPPEKPSKPSFLRRSRLRGEAGSELADGRRSCDTDPRFSLDAARMSIDDAGFSWDEPRASWDGYLFGGGAGIGLGRAPPPLSRLPPILSVLEDTPTDVVERSDGQIPVEDDFDPDPPGGSLQTRDYYLDSSSRRRRSLERSSSVRRPSFEVTDPTRPMAPAVNGTGRESPIGGGSEFYHFQHAEDLLDRGFSSNSLIEDISASLEAALSGRAKKPRRWRKAWSLWGLIHRRAAGRRSGGGPSDITDRSFSEPWPDLRVRGANPKMQRCNSSNLSARSSFSSNSGGLGSSRRSYVDANGNVRRREEPHAQAQVERTRSARYSPGRAAADNGMLRFYLTPMRSGSGRPRGGGGLPSKAGSVLRLY

SEQ ID NO: 42165 - protein, 351 aa, Glycine max
MRPMQLPPPSGSGANPAPTNNSKDRPQRRRKDLTLPLPQRDTNLAVPLPLPPSTASAAAAQQVIPFSELERLNRIGSGSGGTVYKVVHRTSGRVYALKVIYGHHEESVRRQIHREIQILRDVNDPNVVKCHEMYDQNSEIQVLLEFMDGGSLEGKHIPQEQQLADLSRQILRGLAYLHRRHIVHRDIKPSNLLINSRKQVKIADFGVGRILNQTMDPCNSSVGTIAYMSPERINTDINDGQYDAYAGDIWSFGVSILEFYMGRFPFAVGRQGDWASLMCAICMSQPPEAPPSASPHFKDFILRCLQRDPSRRWSASRLLEHPFIAPPLPNHNQTPPNLHQLLPPPPRPLPS

SEQ ID NO: 42166 - protein, 347 aa, Hyphomonas neptunium ATCC 15444
MKALVYRGPRDIAFETMKDPDLHDDRDAIIKVDKCAICGSDLHIYHGETFSEDTGYCVGHEAVGEVVEIGRGVRQLKVGDKVMISAAVGCGQCRACLAGVVNRCEFNAGSCYGLSAKLQGCQAEAVRVPAADFNAQKIPDGISLDQALMMTDALATAWFGARNADIQRGATVAVVGLGPIGLLAAEAAFIMGASRVFGIDLVEERRAAGRAIGLETPDPADARAIIQEATKGRMCDSVIEAVGHSATIRAALGLSGKRATVSVVGVAQDRTFDFPMSKAFGMGLTFRIGTCSVPQEWPELIPLVQSGRIKPEKYITHTLPLSDGARAYDIFDKRTEGAMKMVFDLTL

SEQ ID NO: 42167 - protein, 589 aa, Burkholderia pseudomallei K96243
MSLIEVKVPDIGDFSGVDVIEVNVKPGDVIEKEQTLITLESDKASMEVPSDVAGTVKEIKIKAGDKVSQGTVIAIVEASAGAAAPAPAKAPEAPKPAAAAPAPAAAPAPAPQAGSYSGSADIECDMLVLGAGPGGYSAAFRAADLGMKTVLVERYSTLGGVCLNVGCIPSKALLHTALVVEEAQALASHGITFGKPQVELDKLRDFKGGVVKKLTTGLAGMAKARKVEVVTGVGAFVDPYHMEVQGENGKKIVKFKQAIIAAGSQAVKLPFMPEDPRVVDSTGALELRQLPKRMLVIGGGIIGLEMATVYSTLGAEIDVVEMMDGLMMGADRDLVKVWEKYNAKRFGNVMLKTKTVGAQAKEDGIYVTFEGEKAPAQAQRYDLVLVAVGRSPNGKKIGADKAGVAVTDRGFIDVDKQMRTNVPHIFAIGDIVGQPMLAHKAVHEGHVAAEAAHGEKAYFDALQIPSVAYTDPEVAWAGKTEDQCKAEGIKYGKAVFPWAASGRAIANGRDEGFTKLLFDEETHRVIGGGIVGLNAGDLISEVCLAVEMGADAEDIGKTIHPHPTLGESIGMAAELYEGVCTDLPPQRKK

SEQ ID NO: 42168 - protein, 667 aa, Cryptococcus neoformans var. neoformans JEC21
MHEPPHGTASRQAALHKALSTAYLNHQIAELENRVNAAHIKSPAPQAKAKAKGGDSARSPDASARQLQPQPQPPQQPPGDPNDDLGRPDDVEIDVDDEAEDWRVVVVDISALMWAKNAVKRLVAKGWEVIIPAEAISTLDLLKKGSNATAVAARQAARYIEHALRFHDVLSSDPSLAIQSGTNYKRGSGMRLQRAKETASVNSIVDELAIPPMDGEEDLPKWVEAVFSCVAYFKKIMDAEEKEWDAEDNGYERERGPILYVGNPPVFVELEQGRAEPTPSARDGDAKDGLDYMARAEGHVILQEAARFDLTLQVLRDDDVEVEASGLGGKKQRERRRGRKRGGDGGKRRDREAAKKEPEPEREVKILLRRPSPTREASPDSYPSHLPSPTSPIIPGPEIKSRDHPRAPPLLVRPPPLPSGRPPPPVPPPQSKGLHHHHRPPPPPPLAPESGVDMGLRMGMHTRPHPNPEMRPSLPLHPSMAHHLENGIPRDGGGGGHHHYPHPHLGHHRPPPPPALFDELSDGSRGAHGHGRRGGHGGHGGHGGHGFGRGRGGHHGHGGGGGGGGGGGGGGGGGGGKGHGRRLKNRDNEFVLLQRPHSFVRPPPPGRPGQSQTPGSELFPSINTAPAGAAGANAGAGASSGNGKGNGKSSMPRIDDDPPVVLLQRPK

SEQ ID NO: 42169 - protein, 509 aa, Capsicum chinense
MEGTTWTAYAAVFLGTLFLLLLSKFLRQKKLNLPPGPKPWPIIGNLHLMGNLPHRSIHELSVKYGPILQLQFGSFPVVVGSSVEMAKIFLKSMDINFVGRPKTAAGKHTTYNYSDITWSPYGSYWRQARRMCLTELFSAKRLDSYEYIRAEELHLILRNLNKLSGKPILLKDYLTTLSLNVISRMVLGKRYLDESKNSIVTPEEFKKMLDELFLLNGVLNIGDSIPWLGFMDLQGYVKRMKVLSKKFDKFLEHVLDEHNVRRKAVENYVAKDMVDVLLQLADDPSLEIKLERHGVKAFTQDLLAGGTESSAVTVEWAISELLKRPDIIKKATEELDRVIGQNRWVQEKDIPNLPYIEAVVKETMRLHPVAPMLVPRECREDCKVAGYDVQKGTRVLVSVWTIGRDPTLWDEPEAFEPERFLEKSIDVKGHDFELLPFGAGRRMCPGYSLGLKVIQASLANLLHGFKWSLPDNMTPEDLNMEEIFGLSTPKKFPLSAMIEPRLPPSLYSV

SEQ ID NO: 42170 - protein, 431 aa, Synechococcus sp. WH 5701
MGSSPTAPITLPRASSQPPPQPQAPLAVAHTPVSAVMDTYARLPLELVKGRGVWVRDQHGRRYLDCVAGIATCTLGHSDRVMRRALGKQLGRLQHVSNLYKIPEQEELARWIVGRSCADRVFFCNSGAEANEAAIKLARKHGHQVRGIERPLILTAQASFHGRTLATVSATGQPKYHKGFEPMVEGFHFFPYNDTAAFEALLSRSEADGPRVAAVMLEPLQGEGGVNPGDPAFFQRVRQLCDQHRILLIFDEVQIGMGRSGCLWGYEKLGVEPDAFTTAKGLGGGFPIGALAVKQAFDHFRPGDHASTFGGNPLACRAALTVAQELERRLLVPHVQRMGELLQQLLAELVSRHPQLLEGVRGWGLLQGLVLRPEAPTAPQIVQSALEKGLLVVPAGPRVVRLVPPLVIQPRQLRQAVALLEQALLAISAGT

SEQ ID NO: 42171 - protein, 666 aa, Ostreococcus tauri
TMADDAVTDDEAVAATSNEILSASPLDSLVEIERFVDVVETTLADDYSSDVQGSTALDIAAKYCRDCHVSSQRLYHVNALSKVCEGLDDEHAFPVDLIAELAEDDDNEVRRSVAAQLDRFASCLGRLSSRLDTVNAIKLLGVMFMLIEDDCEDVIEAAESTCGAVAALLSSEKQRSLLISTLKSFGESEEEEIRISAAKTLGRLSEVVGLEITKSEMLPCLLNLARDEEFRVREAVASALSDTFEVLGAHDTLDLVYPEFMFLSRDAIWAVRAACARNIVHLVKAVPSDVMLQVASEAFEPLANDVSFKVRSSAFEQLGPLIFALSSVEVPSIFVDYFTSMAESSTVNGALHETCAYNLPAVALSLTELRWGEIRQTFRLLASSLNWRVRRTLACSLHEVAKIIGRDNSEKDLLPILEKILEDTDEVKIGVIEHLSEVCNVIGSAARLSLIRLLSSMHSEDAENIGNWRIRFALAEQILPIAESLSGAASAEFLFPILLSFLHDAASVVREKAVEITGRVLFIAAKDLTWYSESIVNALSSIKLLATSHRWSDRRAYVNICLTLTREVEQRLIVDELLPLLVMLAEDTAAVVRVALCHFLDETLRLDPTYASLPDISAALSILKIDEEASVRAAAERAEAGSTSKPGETSEGFTSARELQFSPTGL

SEQ ID NO: 42172 - protein, 295 aa, Silicibacter sp. TM1040
MTRIVVIGECMVEMAPVDGGLYRMGFAGDTFNMAWHLRYLLGSDHCVDYLSAVGDDSTSNAMLDFIQSQGVGIAHIRQIAGMTTGLYLIRQENGDRAFSYWRETSAARQLADDPAALARALQEADLVCLSGITLAILSPKAREVLWAAITESGAQVAFDPNIRPTLWSSQEDCRAALTYAAVRSDVILPSFDDDAALFGDVAPQATVARYTRLGVGEVVVKDAARPAIYSGSDGTLEIAADRLAVPVVDATGAGDSFNAAWLAARLQGAAPKEALIAAHKHAACVLQVSGALLVS

SEQ ID NO: 42173 - protein, 120 aa, Synechocystis sp. PCC 6803
MFKLFNQASRIFFGIALPCLIFLGGIFSLGNTALAADLAHGKAIFAGNCAACHNGGLNAINPSKTLKMADLEANGKNSVAAIVAQITNGNGAMPGFKGRISDSDMEDVAAYVLDQAEKGW

SEQ ID NO: 42174 - protein, 456 aa, Campylobacter coli RM2228
MKTITDDIKTLEQNAINKGLDELILMENAGLNLAKLIKKEAKKIRKQYKIKKVKILFLLGGGNNAADGLVALRNLKHAKAYKLGFKENEIFKKQEQILKNFGFKFAKKEPKFKKFHIVVDCILGTGTNREVDEKTKEILEKVNQSKALKIACDIPTNLGFTPCFKADITQCMGALKEILLEDFAKEFVGKIKLANLGINAKKFSLDSKAFLLEEKDLKTIERNTSSNKGNFGHIYIIASASAGTLAGLGALNFGSGLVSLVAKKSFSPLLMLKEKIENNASAIALGMGLENLDILKDEILQNIPLVLDANCFLSEAVLWYLSRKDVVITPHPKEFIRLYKMCFDEDLSIEDLQRNRFFYAKKFAQNYDCVLVLKGANPIIIQKEKIFVVNLGNEALAKGGSGDVLSGMIATLLGVKFSALEAAKNACLAHALVAKKYKFNKNSFDAIKLIKGLKCL

SEQ ID NO: 42175 - protein, 399 aa, Gibberella zeae PH-1
MAYSQHDDTFFVESDEPQHRITAQEAARMMARQRQDIIGVELSRLAGDEYLEDIMQHMRQMEDETLPDASLIDMQREIQWFMRPYLIDFLIEAHAAFGLLPETLFLTVNLLDRYCSKRVVYKQHYQLVGCAALLIAAKYGDKKDRVPQIHELNNMCCGLYDAGMFTQMEMHVLNTLDWIIGHPTVDFFSQLMVAEEGDDQEVSHMAAYLCEIALYHRDFVSTKPSVLARSSLALARAILGRTEVNDGGWDQTENVTLITLSHHLHQPSPTLARKYSTTGFSRVSQKLAEFMAEQAAIARRAASANPATPLAEPINKHTSNIYSTPSKGHSAMGFDGYLTPPITPDGNTLMGNHNLAKESYVLPPRCPVTPTPPHHAAVYGQQQQQNQYVGYVNQHGMNQ

SEQ ID NO: 42176 - protein, 430 aa, Rubrobacter xylanophilus DSM 9941
MRPRPRYRPQERPPYREFPHRVLVAGGGFAGYSAAMELCRLTRGRDDVGVMVLSRENYFTFWPMLPGVISNDVDARNLAQPLRRALIRAGASFRRAQLEGVDPERGVVRADGVEIPYDHLVLALGGEPAYFGIPGVEEHCISLRGIADAEKIRNRVIERYEEATLARGEVPDSRLSFVVIGGGATGVETVAALHELVHGALAEDYPNLHPRRVRLTLVDRNPEILKELDPALRRVARRRLERLNIRILNGATAREVLKDRVVLEDGREIPSENVIWTAGARASRKLEELPFPHHDRRGLEVDAGMRVRGFANVWGVGDCAANVDAEGNPVPPNAQAAVQEGRAVARNVLAAIDGGRPEPFRYRPLGQLVELGSRFAVNEVLGVRFSGLLASLFWRLTYLYKLESPQNRARVAADWLLDLFTEPAVTEIRR

SEQ ID NO: 42177 - protein, 340 aa, Coprinopsis cinerea
MSQVNVGINGFGRIGRIVLRNALQHGKINVVAVNDPFIDLEYMVYMFKYDSVHGRFKGHVEAKDGKLWVEGKPISVFQEKDPANIPWGSVGADYIVESTGVFTTTEKASAHLKGGAKKVIISAPSADAPMFVVGVNLESYDPKYTVISNASCTTNCLAPLAKVINDKFGIVEGLMTTVHSTTATQRTVDGPSHKDWRGGRAVGNNIIPSSTGAAKAVGKVIPSLNGKLTGLAFRVPTIDVSVVDLVVRLEKPASYDEIKQAVKEASEGPLKGILEYTDEKVVSTDFTGSTSSSIFDAEAGIALNKNFVKLISWYDNEWGYSRRVCDLITYAAAKDKEAGV

SEQ ID NO: 42178 - protein, 418 aa, Methanosarcina mazei Go1
MFTEAYELTEEEKLLLQKVLDGDIAFRKIEEFADPLTAVKIRRLAIQEYGKLEFEHIQNFSLDVESVTKRNIENMIGAVQIPLGVAGLLKVNGEYAAGEYYIPLATTEGALVASVNRGCSVITRSGGANVRVFEDEMTRAPVFKFESLERARKFYDWVKSPETFEQMKQAAEKTTRFGKLLSVKPFVTGTYIYLRFSYDTKDAMGMNMVTIATDAVMHLIEDEFGAHPVTLSGNMCTDKKPASISAILGRGKTVVAEVTIPQEIVKETLKCTPESMFEVNYSKNLLGSARAGAMGFNAHAANIIAAVYLACGQDAAHVVEGSTAITSMELTKYEEIHCSVTLPALPVGTVGGGTGLGTQRDCLNILGVAGAGDTPGINSRKFAEIVASAVLAGEISLIGAQAAGHLARAHAQLGRGKF

SEQ ID NO: 42179 - protein, 330 aa, Pasteurella multocida subsp. multocida str. Pm70
MTKQHNLMSIDDIQKLIHRDMQKTNETILAQLNSDVTLINQLGYYIIQSGGKRIRPMIAILAARALGFHGEQPITCATFIEFIHTATLLHDDVVDESALRRGNPTANAEFGNAASVLVGDFIYTRAFQLMTQLDSLRILKVMSDATNVIAEGEVQQLMNVNDPNTTEENYMQVIYGKTARLFEAATHCAAILAHATEAQENALREYGCYLGTAFQLVDDILDYSADAQALGKNIGDDLAEGKPTLPLLHAMHHGNPAQAKLIREAIEQGGKRDILEDVLTIMTEHKSLDYAMMRAKQEAQKAVDAIALLPENEYKQALISLAYLSVDRAY

SEQ ID NO: 42180 - protein, 731 aa, Burkholderia pseudomallei K96243
MNARRRFLQGTATTGIAAATLAAFPLSIRRALAIPANNRTGTIRDVEHIVILMQENRSFDNYFGTLRGVRGFGDRFGIPLPNALTVWQQRNATGALVLPYHLDGSKGNAQRVSGTPHSWDDGQNAWDGGRMYQWPRYKNTASMGYFRESELPFQFALANAFTICDAYHCSMHAGTNSNRMFMWTGTNGPTGAGVASVVNEWDDIGPSTFGYEWKTYPERLQEAGVSWKVYQNMPDNFTDNALAGFRQYRRANEASGKPVSNSDKVVSPAYDPASDDVRNPLYKGIANTMPDGGFLGAFKEDIRAGKLPQVSWVVAPAAYSEHPGPSSPVQGAWYIQEVLDALTATPDVWSKTVLLVNFDENDGYFDHVPSPSAPSLNPDGSPAGKTTLPEADIAFERFTHPKPPGTKSQPQPDARVYGPGVRVPMYVISPWSRGGWVNSQVFDHTSTLRFIEARFGVREPNISAFRRSVCGDLTSAFNFVRPNNEPLPTLAGRKTRAQADALRAAQQQMPQIVPPANGLLPRQETGTRPSRALPYELHVNAVARTLDGTLRLVFANTGQAAAVFHVYDKLNLGRLPRRYMVEAGKQLDDVWAAMTDNGGKYDLWVLGPNGLHRHFTGDMNRLRAGGAPVPEVRVEYDRQHGNVQLLLRNEGARECVFTVRAKAYRDDGPWTFKVKGGAERKHHWKLDGSGNWYDFVVTCDADTGYSRRFAGRVETGEHSVSDPAMGFGDRF

SEQ ID NO: 42181 - protein, 194 aa, Rubrobacter xylanophilus DSM 9941
MARVGELERKTGETFVRVRLEVDGEGRADVSTGVGFLDHLLHLLAHHSGMDLEVRAEGDTWVDDHHTVEDTGLVLGRALDQALGDRSDLVRFADASVPLIEALSTAAVDLGGRSHLTCNTGPLPEKIGTFDTELFPEFLRAFTQYGRFTLHLNCHYGHNAHHKVESGVKALAVALRAAVSRRSSGTASTKGVVD

SEQ ID NO: 42182 - protein, 321 aa, Glycine max
MEEACEFRSWAELIPDALGVIFTNLSLQERVTVIPRVCKSWANAVTGPYCWQEIDIKDWSNRCQPDQLDRLLEMLITRSCGTLRKLSVSGLQTESIFTFIAENACSLHTLRLPRSSMNDSIVEQIAGRLSMISFLDVSYCIKIGPYALEMIGKNCKLLEGLCRNMHPLDTAEKPHQDDEAYAIASTMPKLKHLEMAYHLISTSGVLQILANCPKLEFLDQRGCWGVTLDHMFLKQKFPKLKVLGPLVLDTYESDGWDDFSDVSDSSEYLAWDFVAGGMGEYYVDDSDSYDGMWDDEARLDELQFGFYEGIEDAGMYWPPSP

SEQ ID NO: 42183 - protein, 675 aa, Porphyromonas gingivalis W83
MNDKKLMNKAADNIRVLAAAMVEKAKSGHPGGAMGGADFVNVLFSEYLIFDPKNPQWAGRDRFFLDPGHMSPMLYAQLALTGKYSMDDLKAFRQWGSITPGHPEVDVMHGVENTSGPLGQGHTYAVGAAIAAKFLAHRFGWMMSQTIYAYISDGGIQEEVSQGAGRIAGHLGLNNLIMFYDSNDVQLSTTVKEVASEDVAMKYRAWGWKVIEIAGNDADEIRKALTEAKGEGERPTLIIGHTLMGKGAVGEDGSSYENMVSTHGQPLSAAGASFAETVKNLGGNPEEPFAIFPEVREMYAARLAELEQIMAERREEEQRWRSTHPDLAAKFDAWFAGQTPQIDWKAIEQKPNQATRSASATVLGTLAGEVENMIVTSADLSNSDKTDGFLKKTHAMKKGDFSGAFLQMGVSELTMACLCIGMALHGGVIPACGTFFVFSDYMKPAVRMAALMELPVKFIWTHDAFRVGEDGPTHEPVEQEAQIRLMEKLHNHSGRRSMLVLRPADVQETTVAWKMAMENTHTPTALILSRQNITDLPANDSRYEEALQAEKGAYIVNTDQNIEVVLLASGSEVSTLVEGAELLRKRGVKLRIVSVPSEGLFRSQSAEYQEEVLPIGIRRFGLTAGLPVNLEGLVGESGAVWGLNSFGFSAPYKVLDEKLGFTAENVYEQVLKILH

SEQ ID NO: 42184 - protein, 521 aa, Prochlorococcus marinus str. MIT 9312
MNEIIWPTIDSKHLIVDSKQMLILEKEMFSDGMPQAALMEKAGIQISRWLLKRKPLLKNGITVLIGPGHNGGDGAVIARELFLQGYLVKVWCPFPIKKTLTIDHVNYLTSIGVTKLEEAPDANGKELWIDAVFGNNQTRKVDIKLIKLFNQKFHNKYGKVISIDIPTGLCPDKGEPVFDDAVKADYTLAVGLNKIGLTLDSALPFIGELNHIDVGVPISKLSNVEKKIFKVTYKDLKNIDLPFLPKNSNKYKRGRTLLIAGSEKYPGAAYLALKGAISSGAGFISAVLPDLVAESIWQVAPEIVLKGTMQSNQNGNASLLSALKNIDLSAFDSLAVGPGIGIDSDDWEKSKDYLLSFEGLLILDADALNRISESKLGSKFFLGRKFKTWITPHSKEFSRLFPNIKGETNVEIALNAAKEFNISVLLKGANSTVADNKKAWQLFGTDSQTARAGLGDLLSGFVAGSSAIDLTFSRNITTEFFAKYVLLHSFAASKCKKGSNASAIGDELSKLMRNRKTRQIS

SEQ ID NO: 42185 - protein, 364 aa, Prochlorococcus marinus subsp. marinus str. CCMP1375
MMQSTNVTNQETTNNISLRSAHAERVSKLSTQEPAQVNRETGLKIFRDMTLGRRFEDKCAEMYYRGKMFGFVHLYNGQEAVSSGVICAMQQKHDWFCSTYRDHVHALSAGVPAREVMSELFGKESGCSKGRGGSMHLFSKEHHLLGGYAFIGEGIPVALGSAFTSRYKKEVFNEKGSNSVTAAFFGDGTCNNGQFYECLNMAQLWKLPILFVVENNKWAIGMAHDRATSDPEIWRKANAFGMKGEEVDGMDVLAVRGAAQRAIERARAGEGPTLLECLTYRFRGHSLADPDELRSAEEKDFWASRDPLKLLEKNLTEKDLVSSKELRAIEKEIDQEVADAVEFAIGSADPKPEELTKYIWAEDI

SEQ ID NO: 42186 - protein, 136 aa, Triticum aestivum
  misc_feature (69)..(69): Xaa can be any naturally occurring amino acid
  misc_feature (79)..(79): Xaa can be any naturally occurring amino acid
  misc_feature (133)..(133): Xaa can be any naturally occurring amino acid
  unsure (1)..(136): unsure at all Xaa locations
MAPTVMASSATSVAPFQGLKSTAGLPVSRRSNGASLGSVSNGGRIRCMQVWPIEGIKKFETLSYLPPLXSTEALLKQVXDYLIRSKWVPCLEFNKLGSSSREHNASPWGTNNGRYWTMWKLPMFGCTDPHKVXNEV

SEQ ID NO: 42187 - protein, 950 aa, Flavobacteria bacterium BBFL7
MPKRTDLKSILIIGSGPIVIGQACEFDYSGTQALRSLREDGIETILINSNPATIMTDPSMADHVYLLPLNTNSIRKILKEHPQIDAVLPTMGGQTALNLCIEAQEKGIWEDHNVDLIGVNIDAINVTEDREQFRNLMGEIGVGMAPQATATSFLKGKEIAQEFGFPLCIRSSFTLGGAGAAIVYKEEDYDELLTRGLEASPIHEVMIDKALLGWKEYELELLRDDNDNVVIICSIENMDPMGIHTGDSITVAPAMTLSDRTYQKMRDMAIHMMRSIGAFAGGCNVQFAVSPDEKEEIIAIEINPRVSRSSALASKATGYPIAKIAAKLAIGYTLDELDNQITKSTSALFEPTLDYVIVKIPRWNFDKFEGSDRTLGLQMKSVGEVMGIGRSFQEALHKATQSLEIKRNGLGADGKGYKDYNQVIDKLTHASWDRVFALYDAIAMGISLERIHEITKIDMWYLKQFEELHSLEIEISKFDINTLSRKLLLEAKQKGFADRQIAHMLGCLESEVYTKRDELNINRVYKLVDTCAAEFPAQTPYYYSTFEAEMETADGKRYAENESIVSDKKKVIVLGSGPNRIGQGIEFDYCCVHGVYAAQECGYETIMINCNPETVSTDFDTADKLYFEPVFWEHIYDIIRHEKPEGVIVQLGGQTALKLAEKLERYGIKIMGTSYKALDLAEDRGLFSKMLQENDIPYPEFATATTPAEALQVAEQLDFPILVRPSYVLGGQGMKIVINKEELEEHVVDILRKIPNNVLLLDHYLDGAIEAEADAICDGENVYIIGIMEHIEPCGVHSGDSNALLPPFTLGDLVMQQIKDHTKKIALALDTVGLINIQFAIKDDKVYIIEANPRASRTVPFIAKAYGEPYVNYATKVMLGHNKVTDFDFNPQLDGYAIKQPVFSFNKFPNVDKRLGPEMKSTGESILFIDSLKDDDFYELYARRRMYLSK

SEQ ID NO: 42188 - protein, 519 aa, Prochlorococcus marinus subsp. marinus str. CCMP1375
MSWPKSDADHLIVSSSQMKEIEQKLFSYGMTEEALMEKVGLSMKDFLISNFNLLESGVVVLVGPGHNGGDGLVVARELFLDGVDVSLWCPFPIKRSLTKSHLSYCISIGITQLQSEPDVTGNCFWIEAFFGLGQTKPLPKEIGNLFKKREKFTPGKLISLDVPAGICSDTGKTFDTCAARAISTLTVGLIKVGLLQDMALPYVGSLKRIDIGIPSGVLNLLPKDVPLKISSNDIISLKAPQIECNASKYERGRLAVIAGSKKYRGAALLTLQGAIASGTGSVQAFLPKSISKYAWIKVPEVVFEEESNEEIELIKCLKKIKFDRIESLVVGPGIGLSIEKWEDSALILEEFLGLLVLDADALNRISCSQQGWEWFRKRKGPTWITPNPNEFCRLFPEIDISSPINAASLAARISGVGVLLKGANTVIAVPNGPIWQLTNTSSFVARAGLGDVLAGFVGGIGALGMISEGSFDHGLLAVAALIHSYAASECEEGTNAAFVSKKLGKLFKAIQMKKVQFDT

SEQ ID NO: 42189 - protein, 223 aa, Prochlorococcus marinus str. MIT 9312
MQTVILTGIVAGFVHVVSGADHLIAMAPAAINDPRKALKNSFSWGLGHSSGVLLLAFIAIFIKDITPLNKFSNFAEFLVGISLLIVGVFAIKNSFQLSIHSHSHKHENGIAHRHFHFHVKEQKNNNKHSHALTGLGLLHGIAGGSHFLAVLPALALPLTSACLYLISYLIGSLTSMNLFTCLISFTTFKASQKFIKRLKAIAGGLSFSLGLFWIQRSASVFLN

SEQ ID NO: 42190 - protein, 546 aa, Burkholderia pseudomallei K96243
MSQAIEVKVPDIGDYKDVPVIEVLVKPGDAVEPEQSLVTLESDKATMDVPSPSAGTVKEVKVKVGDAVSQGSLIVLLDGAQAAAQPAQANGAATSAAQPAAAPAAAPAPAAAAGGGTVDVKVPDIGDYKDVPVIEIAVKIGDTVEKEQSLVTLESDKATMDVPSPAAGVVKDIKVKVGDAVSEGSLIVVLEASGGAAASAPQAAAPAPAPAPAPAPAPQAAPAAAPAPAQAPAPAASGEYRASHASPSVRKFARELGVDVSRVTGTGPKSRITKDDVTAFVKGVMTGQRAAPGAAAAPAGGGELNLLPWPKVDFSKFGPFEAKPLSRIKKISGANLHRNWVMIPHVTNNDEADITELEALRVQLNKEHEKAGVKFTMLAFVIKAVVAALKKFPTFNASLDGDNLVFKQYYHIGFAADTPNGLVVPVIRDADKKGLVDIAKEMAELSKAAREGKLKPDQMQGGCFSISSLGGIGGTHFTPIINAPEVAILGLSRGQMKPVWDGKQFVPRLMLPLSLSYDHRVIDGAEAARFNAYLGALLADFRRIIL

SEQ ID NO: 42191 - protein, 347 aa, Cichorium intybus x Cichorium endivia
MALHTPGQVAPLLLLLGMVVNFHIFIDAQAVGVCYGRVAVPGSLPSEEATVNLYQQNGITAMRIYDPNQATLQALQGIDIELMLDVPNSELESLNNPVAATTWVRNNIQNYPGVNFRYIAVGNEVDPNNNATSDYVKLVLPAMRNVHQAIVDASLANQIKVSTATYTGLLENSYPPSDGVFHENVKAFIEPIIAFLVQNNLPMLANIYPYFAAQGSMQVNLSYALLQPDAPVVNDNGIMYSNLFDAMLDAHYAAQAPFGGENLEIVVSESGWPSCCDSIATVENAGTYYRNLIGHVTQVGGTSAKPGKSIETYQFAMFDENIKDGDESEKHFGIFSPNQTPKYQVNF

SEQ ID NO: 42192 - protein, 518 aa, Methanococcoides burtonii DSM 6242
MNFTKRPFLLTILDGWGYSPEVEGNAIHAANTPNLDDLLETYPNTLLSASGEDVGLPEGQMGNSEVGHLNIGAGRVVYQDLTRINRDIGNGDFFKNPVLKQAIENAKAQGSALHLMGLFSYGGVHSHMKHLRALIEFAKDEGITEIFIHAFLDGRDVSPRAALEDMKEHVEYCNNLSVGKIATVSGRYYAMDRDNRWDRTEDAYNAITRGDGVYYSKGPVDAISEGYGRGENDEFIKPTVIVDENGRPIGRMNENDTVIFFNFRPDRARQLTYAFVNDEFDNFERKSHPKVHFVCMTEYDEKLEVPIAFPSEELKNTLGEVLSKEGIKQLRIAETEKYAHVTFFFNGGVEKQNEGEERCLIPSPKVATYDLKPEMSAYEVTEELIERIGSGKYDVIVLNLANMDMVGHSGIMEAAVKAVEVVDDCVGKIITAIKEVGGEAMVMADHGNAEKMVEFCNNTERQCYTAHTSNPVRCIYVTQEKRVELQKGRLSDVAPTILKIMGIEKPPEMTGVPLIKNT

SEQ ID NO: 42193 - protein, 898 aa, Burkholderia pseudomallei K96243
MSAVPNEVMKYVAAERDDDAQETVEWLEALDGVISSVGPGRAHYLIEKQIEFARMHGEHLPFSANTPYINTIPVEAQAKIPGDQDIEHRIRSYTRWNAIAMVLRAGKHTNVGGHIASFASAATLYDVGYNHFWHAPSAEHGGDLVFVQGHSSPGIYSRAFLLGRLTEDQLDNFRQEVGGNGISSYPHPWLMPDFWQFPTVSMGLGPIMAIYQARFMKYLQARGIVKTEGRKVWAFLGDGETDEPESLGAIGMASREKLDNLVFVINCNLQRLDGPVRGNGKIIQELESEFRGAGWNVIKVIWGSRWDALFARDKTGALMRRMMEAVDGEYQTYKSESGAYVREHFFNTPELKALVADWSDDDIWNLNRGGHDPHKIYAAFHEASNSKGAPTVILAKTIKGYGMGEAGQAMNITHQQKKLPVEQLKKFRDQFRLPIADDVIADVPYLKFDEGSKELEYMRAHRQALGGYLPQRRQKAQSLPVPALDAFEPLLKGTGEGREISTTMAFVRILNILLKDKALGKRVVPIVPDESRTFGMEGLFRQIGIWNQEGQKYVPEDSDQLMFYKESETGQILQEGINEAGGMCDWIAAATSYSTHGEIMVPFYIFYSMFGFQRIGDLAWAAGDMRSRGFLLGGTAGRTTLNGEGLQHEDGHSLMWAASVPNCVSYDPTFGYELAVIVQDGLRRMVQEQEDVYYYVTVMNENYEHPAIPQGEHVAADIIKGMYAFRKADADKKAPRVQLLGAGTIFNEVIAAADLLKNDWGVAADLWSVPSFTELAREGHDVERWNLLHPAEARRLSHVQTCLKDTQGPVIASTDYVRALADQIRGQIDRRYVVLGTDGFGRSDTRGALRHFFEVDRYWVTVAALNALADEGTIERKVVADAIAKYNLDPAKPNPMTV

SEQ ID NO: 42194 - protein, 202 aa, Fulvimarina pelagi HTCC2506
MAHEQISSDVRDAVLESLEDRIEDHFFRFGELTLVVTPENVVKVMTTLRDDPKMQFINFVDLCGVDFPQREKRFEVVYHLLSPRQNCRIRVKTMTAEDDPVPSVSDVFPAADWFEREAYDLYGILFTGHPDLRRILTDYGFEGYPLRKDFPLTGFVEVRYDEERKQVVYEPVDLRQEFRNFDFLSPWEGTEYVLPGDEKAPN

SEQ ID NO: 42195 - protein, 222 aa, Prochlorococcus marinus subsp. marinus str. CCMP1375
MLISILTGFAAGAVHVVGGADHLIAMAPSAFRKPKLALRNGLAWGLGHSTGVLILSAVAILVKDFAQIERMSSFAELSVGVFLLVVGFLTIRTSLGLNIHTHDHHHGSGNKHKHFHLHFRGSRKHSRHSHASTSLGLLHGLAGASHLLAVIPALALPPFGASLYLFFYLLGSIVAMGAVVSAMSLATLRAGKNNLPIIFRFTGLLSILTGFFWIHKTSSYIF

SEQ ID NO: 42196 - protein, 153 aa, Brassica napus
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNM

SEQ ID NO: 42197 - protein, 142 aa, Solanum lycopersicum
MIKPDGVQRGLVGEIISRFEKKGFSLKGLKLITVDRAFAEKHYADLSAKPFFNGLVEYIVSGPVVAMVWEGKGVVATGRKIIGATNPLESAAGTIRGDFAIDIGRNVIHGSDAVESARKEIALWFPEGIAEWQSSLHSCIYE

SEQ ID NO: 42198 - protein, 310 aa, Vibrio vulnificus YJ016
MNHIKRVAVIGECMVELRRNNGVLEQGFGGDTLNTAVYLSRLTHEHGVASSYVTGLGRDAFSQQMLSAWQVEALDTEHVFISEDKLPGIYVIETAADGERSFFYWRNDSAAKYWLRGQEIPQLAHALRHHQMIYLSGISLAILPSDCCDALLELLRLLRAQGATIAFDNNYRPALWPSQQQAQSVYRQVLALTDIAFLTFDDEQALYGDETEQQAVDRTQTLGVKEIVIKRGAEPCMVVTQVGIESIASQPVEKIVDTTAAGDSFSAGYLAKRLLGGSTGESALAGHTLAGAVIQQRGALIGTDAMPTII

SEQ ID NO: 42199 - protein, 953 aa, Pseudomonas fluorescens Pf-5
MLELTVEQISMGQSAVDKSAALHLLADKLVADGLVAEGYLAGLQAREAQGSTFLGQGIAIPHGTPETRDQVFATGVRLLQFPDGVDWGDGQIVYLAIGIAAKSDEHLRLLQLLTRALGETDLGQALRRASSPQALLKLLQGAPQELALDAQMIGLGVAAEDFEELVWRGARLLRQAECVSNGFAAVLQQVEALPLGDGLWWLHSEQTVLRPGLAFVTPDKPIRYLGQPLSGLFCLASLGEAHQALLERLCALLIEGRGQELGRATSSRAVLEVLGGELPADWPSARIALANAHGLHARPAKVLAQLAKNFEGEIRIRIVDGKDSAVSVKSLSKLLSLGARRGQVLELIAEPSIAADALPALLAAIEEGLGEEVEPLPAVSTPRQEPQEVVEPLSAPASGSLIQAIAAAPGIAIGPAHIQVQQSIDYPLRGESTAIERQRLQQALAEVREDIQGLIQRSQAKAIREIFITHQEMLDDPELSDEVDTRLKQGESAEAAWMTVIESAAKQQEALQDALLAERAADLRDIGRRVLAQLCGIETPAEPDQPYILVMDEVGPSDVARLDPTRVAGILTARGGATAHSAIVARALGIPALVGAGASVLLIKSGTSLLLDGQRGRLHVDADSTTLQRAAEERDNREQRLKAAAEQRHQLAHTADGHAVEVFANIGESAGVAAAVENGAEGIGLLRTELIFMAHPQAPDEATQEAEYRRVLDGLAGRPLVVRTLDVGGDKPLPYWPIVKEENPFLGVRGIRLTLQRPLIMEAQLRALLRSADNRPLRIMFPMVGSVEEWRQARDMTERLRREIPVADLQLGIMIEVPSAALLAPVLAKEVDFFSIGTNDLTQYTLAIDRGHPTLSAQADGLHPAVLQLIDITVRAAHAHGKWVGVCGELAADPLAVPVLVGLGVDELSVSGRSIAEVKARIRELRLAQAQTLAQQALAVGSANEVRALVEAM

SEQ ID NO: 42200 - protein, 302 aa, Antirrhinum majus
MVSSHRSLMEQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEETWPGVTSLPDFKSAFPKWPAKELAAVVPNLDASGLDLLDKMLRLDPSKRITARNALQHEYFKDIGFVP

SEQ ID NO: 42201 - protein, 231 aa, Oryza sativa (japonica cultivar-group)
MTGFGSPCGACKFLRRKCVRGCVFAPYFCHEQGAAHFAAIHKVFGASNVSKLLAHLPLADRPEAAVTISYEAQARLRDPIYGCVAHIFALQQQVMTLQAQLASLKAAAPKGIHHQDWCGSNGGRAPAASQPGAYSSNGGAGHGHDSITALLAAGSDYMQHSLYHAFEHSEGAGAVDDGHAAAAAFEAAAESSSCGMAASFAADESVWRSSSSGYQDCEDLQSVAYAYLNRS

SEQ ID NO: 42202 - protein, 276 aa, marine gamma proteobacterium HTCC2143
MEHHSKYFHSKGRLVFCQRWQPANHVKGVLLIAHGLAEHSGRYAEIAAFFVANNYAVCCLDHIGHGQSEGPRGFINQFTDYTDTLDIFSTQVSDWYPNLPIFLIGHSMGGLISAQFLIKNQERFAGSILSGPAIRAPNEPSSLLLIIARLLSTLAPKIGVMQLSADNISRDTAVVKTYRDDPLVYTGKISARLATEIFSSMTLVQEHASAITLPMLLLHGSEDRLAAPEGSSLLNDKIASLDKQLIIYRGLYHELFNEPEKQQVFTTMLDWLEKRS

SEQ ID NO: 42203 - protein, 201 aa, Synechococcus sp. CC9605
MSSKLRLGVAGPVGSGKTALVEALCRRLRDDLQLAVVTNDIYTQEDAQFLTRAGALDPERIRGVETGGCPHTAIREDCSINRAAVAELEAQFPELDLVLVESGGDNLAASFSPELVDLCIYVIDVAAGDKIPRKGGPGITRSDLLVINKIDLAPQVGADLALMEQDTRRMRGDRPWCFTNLHSGEGLEQVLAFLSQQLPNS

SEQ ID NO: 42204 - protein, 428 aa, Campylobacter coli RM2228
MVVIALALVLLNGFFVLSEFSIVKVRRSKLEEMVKEKKVGAKKALEVTSRLDTYLSACQLGITLSSLALGWIGEPAIAKMLEIPLANLGFNGVIIHTIAFIIAFSIITLLHVVLGELVPKSIAIAIADKAVLWVARPLHWFWILFLPCIKIFDFLAAMTLKLFGIKPAKESELTHSEEEIKIIASESQKGGVLDEFETEIIRNAVDFSDTVAKEVMTPRKDMICLNKQKTYAENMQIICDHKHTRFPYIDGSKDTILGMIHIRDIVQNELSDKSENLDTFVKPLILVPENISISKVLVMMNKERSHTALVIDEYGGTAGILTMEDIMEEIIGEIKSENEEDSYKKLAENIYEFQGRCDIETVEEMLLISYDEDLEQVTIGGYVFNLLGRLPVAGDRIEDELCYYEVKKMDGNSIERVKVVKKTNKDEE

SEQ ID NO: 42205 - protein, 387 aa, Pseudomonas fluorescens Pf-5
MSINVEDYFARETFQKMKSFADQQETPFVVIDTQMISQAYDDLRAGFEFAKVYYAVKANPAVEIIDLLHEKGSSFDIASIYELDKVLGRGVNPANISYGNTIKKSKDIRYFYDKGVRLYATDSEADLRNIAKAAPGSKVYVRILTEGSTTADWPLSRKFGCQTDMAMDLLILARDLGLVPYGVSFHVGSQQRDISVWDAAIAKVKVIFERLKEEDGIELKLINMGGGFPANYITRTNSLETYAEEIIRFLKEDFGDDLPEIILEPGRSLIANAGILVSEVVLVARKSRTAVERWVYTDVGKFSGLIETMDESIKFPIWTEKKGEVEEVVIAGPTCDSADIMYENYKYGLPLNLAIGDRLYWLSTGAYTTSYSAVEFNGFPPLKAFYL

SEQ ID NO: 42206 - protein, 481 aa, Rubrobacter xylanophilus DSM 9941
MEAIPSASYSMTLRVEFPHRAGALGRILTTIGDAGGMVGAIDIVRMGQERSIRDITVNARDSEHGQRIVRAVGALPEVRVVNVSDRTFLLHLGGKIEVHSKIPVRTRDDLSMAYTPGVARVCRAIAQEPERAFNLTIKRNSVAVVTDGTAVLGLGDIGPYAAMPVMEGKAMLFKEFAGVDAFPVCLDTKDPEEIVRTVKYVAPAFGGINLEDISAPRCFEIEERLKQELDIPVFHDDQHGTAVVVLAALINALRIVGKRMEELKVVVCGVGAAGVACAKILLAAGVKNIVGCDRYGVVYRGRGDADTSRGWFAENTNPENIRGTLADAIRGADVFIGVSAPDVLTVEHIESMADEPIVFAMANPDPEIRPEIAYGHARIIATGRSDYPNQINNVLCFPGVFRGALDIRAREINEEMKLAAARAIAGVIPEESLSEDYIIPSVFDERVVPAVAGAVAEAGVESGVARRVRERSETDFSAASF

SEQ ID NO: 42207 - protein, 302 aa, Ashbya gossypii ATCC 10895
MEICHHKGLLILFSRTELSESRSTGHIEVVMVSLHELVKGLKAAFQIRDYRTCVDLLGPIKIELIKTRLLVPDLLAASEGNATYLEDLEVAKKILEIGALSSINLLDFAGFENYYAQLRAFYFGLPENHTLADSENKKKLISLYLLILLSQGDVTKFHSELEFLSKRDLGNIEENKYLSYPVRLEKLLMEGSYQKAWDMLQNGREDDKIEEFNIFDETLMNAIRDSIARNTEVAYARLPLSNVKALLFFKSEKDTEAFAKARGWNIVNGCVLFDEDDVSEKKEQTSIVSKALSYATNLESIV

SEQ ID NO: 42208 - protein, 349 aa, Chenopodium rubrum
SKTHFKMTTLETEQEQQPFSQNSPLFLDCLYCEEKYWDYDYHDEDDFGSLNSSKLHDCSLICCEDDEEIQLNALVSKEEKINFDEGDLGGNQLVMETRREALEWMIRVNYHHNFSVITLVLGVNYFDRFMLSFGFQKEMPWMTHLAAVACLSLASKVEETHVPLLLDFQVEHEQIFEAKVVQRMELLVLQHSNGKMNAVTPLSYFGHLIRKLKLKPHFHCKILTRCENIIVSVILDPRFLCYVPSVLAAASMVQTLKEIGLWSILEHQNDIMNTLKLDKVKVEDCYNFIQEVSSNEKARKRKWYNNISSANRNPNNVLELVVSSESSNNDLPSETLPKKCRTMGPPCFG

SEQ ID NO: 42209 - protein, 417 aa, Prochlorococcus marinus str. MIT 9312
MELVDAPHSKCGTFGYVGSSPTAPTLMNTYSRFDISFKKGKGCWLWDKKGKKYLDAVAGIATCSLGHSDRVLRRRLSTQLKKIQHISNLYNIEEQEQLSKTLTNISCAESVFFCNSGAEANESAIKLIKKYGNTTNKGKESIILSAESSFHGRTLAALSATGQPKYQEGFEPMIKGFKFFKFNNFDSVKKLFEECENKDQKISGVLVEPIQGEGGVIPGSKIFFKSLREICDKYGSLLIFDEVQSGVGRTGKMWGYENLGIEPDGFTLAKGLGGGHAIGALLVKEKANIFSPGDHASTFGGNPFACKAALTVLEEIKRRNLINNVYLRGDQLSAGFEELSKKFPNIIRGKRGLGLIQGLVINNDYADAKEITLKAFDKGLLVVPAGGNVVRIVPPLIISRREINILLDKLNSIFEEL

SEQ ID NO: 42210 - protein, 374 aa, Hippocratea volubilis
ALSIAGAVQSQKLAVRAISQLQSLPGGDIKLLCDTAVESVRDLTGYDRVMVYKFHEDEHGEVVAESKRPDLEPYIGLHYPATDIPQASRFLFKQNRVRIIVDCHASPVNVIQDDGLMQPLCLVGSTLRAPHGCHAQYMENMGSIASLAMAVVINGNDEDGIGGRNPTRLWGLVVCHHTSARCIPFPLRYACEFLMQAFGLQLNMELQLAAQLLEKHVLKTQTLLCDMLLRESPTGIVTQSPSTMDLVKCDGAALYYQANYYPLGVTPTEAQIKDIVEWLLVFHGDSTGLSTDSLADAGYPGATLLGDAVCGMAVAYITNRDFLFWFRSHTAEEIKWGGAKHHPEDKDDGLRMHPRSSFKAFLEVVKSRSLPWEN

SEQ ID NO: 42211 - protein, 396 aa, Fulvimarina pelagi HTCC2506
MAEIDVRNFNINFGPQHPAAHGVLRLVLELDGEIVERVDPHVGLLHRGTEKLIEHKTYLQAIPYFDRLDYVSPMNQEHAFCLAIERLADVDVPKRGQLIRVLYCEIGRILSHLLNVTTQAMDVGALTPPLWGFEEREKLMVFYERASGARLHSSYFRPGGVHQDIDQKLIDDIGEWCDPFLKVCDDLEGLLTDNRIFKQRNVDIGVVNLDDAWAMGFSGVMVRGSGAAWDLRKSQPYECYDEMEFDIPVGKNGDCYDRYLIRMVEMREAVRIMKQCIERLSGEEKTGPVSAPMGKVVPPKRPEMKRSMEALIHHFKLYTEGFHLPEGEVYAAVEAPKGEFGVYLVADGTNKPHRCKIKAPGFAHLQAMDVMCKGHLLADVSAILGTLDIVFGEVDR

SEQ ID NO: 42212 - protein, 180 aa, Pasteurella multocida subsp. multocida str. Pm70
MNDKLALIKSSIKSIPNHPKEGIIFRDITSLLEVPAAFQTVVDLFVTRYKEKGITKVLGTESRGFIFGAPVALALNVPFVLVRKPGKLPRETISQTYQLEYGQDTLEIHTDAIHAQDKVLIIDDLLATGGTVEATVKLVQRLGGDVQDAAFVINLPDLGGEARLNALGIDAYTLVDFAGH

SEQ ID NO: 42213 - protein, 374 aa, Hippocratea volubilis
ALSIAGAVQSQKLAVRAISQLQSLPGGDIKLLCDTAVESVRDLTGCDRVMVYKFHEDEHGEVVAESKRPDLEPYIGLHYPATDIPQASRFLFKQNRVRIIVDCHASPVNVIQDDGLMQPLCLVGSTLRAPHGCHAQYMENMGSIASLAMAVVINGNDEDGIGGRNPTRLWGLVVCHHTSARCIPFPLRYACEFLMQAFGLQLNMELQLAAQLLEKHVLKTQTLLCDMLLRESPTGIVTQSPSTMDLVKCDGAALYYQANYYPLGVTPTEAQIKDIVEWLLVFHGDSTGLSTDSLADAGYPGATLLGNAVCGMAVAYITNRDFLFWFRSHTAKEIKWGGAKHHPEDKDDGLRMHPRSSFKAFLEVVKSRSLPWEN

SEQ ID NO: 42214 - protein, 462 aa, Bacillus subtilis
MMSSLFRKKPLETLSAQSKSKSLARTLSAFDLTLLGIGCVIGTGIFVITGTVAATGAGPALIISFILAGLACALAAFCYAEFSSSIPISGSVYSYSYVTLGELLAFLIGWDLMLEYVIALSAVATGWSSYFQSLLAGFNLHIPAALTGAPGSMAGAVFNLPAAVIILLITAIVSRGVKESTRFNNVIVLMKIAIILLFIIVGIGYVKPDNWSPFMPFGMKGVILSAATVFFAYLGFDAVSNASEEVKNPQKNMPVGIISALAVCTVLYIAVSLVLTGMMPYAKLNVGDPVSFALKFVGQDAVAGIISVGAIIGITTVMLALLYAQVRLTFAMSRDGLLPGLFAKVHPSFKTPFRNTWLTGIVAAGIAGFINLGTLAHLVNMGTLAAFTVISIAVIVLRKKHPEIKASFRVPFVPVVPIISAGICLWFMYSLPGVTWLSFVIWIAVGTLVYFLYSRKHSLLNK

SEQ ID NO: 42215 - protein, 395 aa, Prochlorococcus marinus subsp. marinus str. CCMP1375
MLDTYKRLPLKIVKGNGCWLWDETGKKYLDAVAGIATCSLGHSDKKLSKVLSQQLRKIQHVSNLYRIPEQEDLAQWLVNQSCADSVFFCNSGAEANEAAIKLARKYGQIKRGIKRPIILSAKSSFHGRTLAALSATGQTKYQKGFEPLVEGFEFFSFNDSNSVQDLYENLEKDEPRVAAILIEPIQGEGGLNLGDQKFFYFLRDYCNKNNILLLFDEVQSGMGRTGKLWGYEHFNVEPDAFTLAKGLGGGHSIGALLVKENASIFEPGDHASTFGGNPFACKAGLTVAKEIQNRNLLENTYCRGNQLREGLQKLINNYPHHLEEVRGIGLMLGLAIKKNSNLTSQKIVELAIKEGLLVIGAGEKVIRMLPPLIITKREIETLLTRLNACFRKLNN

SEQ ID NO: 42216 - protein, 281 aa, Mycoplasma pulmonis
MKKTIYITTPIYYPSGDLHLGHIYSTNIAWVLRNYKKIQGYETFFSTGSDEHGQKIFNKAQELKLETQDYVDRQANKFIDFWKKANIDYDFFARTTNKEHKEVVREIFHKLKEKNIIYLDKYVGLYSVSDEEFLTETQALKKDNKFFHPVSNHELIKIEEESYFFNLNLFIDWIKEFLDQDIISSKAIVNELKSNFINKGLENLSVTRIKLDWGMKIDQSSKHVIYVWLDALFQYLTNLGYGSKNQSLYEKFWKNGDERVHVVGKEITRFHCIYWPIFLKS

SEQ ID NO: 42217 - protein, 528 aa, Oryza sativa (japonica cultivar-group)
MVLGAWLMSPASVPWSLLAYGVLGLVLLWQAGRLLHSLWWRPRRLELALRAQGLRGTRYRFLTGDLGEHGRLNREAWARPLPLRCHDIAPRVAPFLHNAVREHGSACFTWFGPTPKVTITDPDLAKGVLSNKFGHFEKPKFPTLTKLFSDSLANHEGEKWVKHRRILNPAFHLEKLKLMLPAFSACCEELVSKWMESLGSDGSYEVDVWPEMQILTGDVISRTAFGSSYLEGRRIFQLQAEQTERLLKCMQKIVIPGYMSLPTKNNRKMHQIKKETDSILRGLVDKRMQAMKEGECTKDDLLGLLLESNMRHTEEDGQSNHGLTIEEVIEECKLFYFAGMETTSVLLTWTILLLSMHPEWQDRAREEILGLFGKNKPEYEGLSRLKIVTMILYEVLRLYPPAVTFTRKTYKQMEIGGVTYPAGVIVELPVLLIHHDPNIWGSDAHEFKPDRFVEGISKASKNPGAFLPFGWGPRICIGQNFALLEAKMALCMILQCFKLELMPSYTHAPYSMVTLRPMHGAQIKLRAI

SEQ ID NO: 42218 - protein, 113 aa, Glycine max
  misc_feature (104)..(104): Xaa can be any naturally occurring amino acid
  unsure (1)..(113): unsure at all Xaa locations
MADETKNVHEHEAPKVATEESSTATGEVTDRGLFDFLGKKKDETKPEETIDSEFEQKVHISEPVPEVKHEEEKEEKKHSLLEKLHRSDSSSSSSSEEEGEDGVXRKKKKDKKK

SEQ ID NO: 42219 - protein, 163 aa, Fulvimarina pelagi HTCC2506
MSALAQTVRSLFLIEFVQAFGLALRYFFAPKATVNYPFEKGPVSPRFRGEHALRRYPNGQERCIACKLCEAICPAQAITIEAGPRQNDGTRRTVRYDIDMVKCIYCGFCQEACPVDAIVEGPNFEFATETREELYYDKEKLLANGDRWEREIARNIALDAPYR

SEQ ID NO: 42220 - protein, 246 aa, Brassica napus
  misc_feature (101)..(101): Xaa can be any naturally occurring amino acid
  unsure (1)..(246): unsure at all Xaa locations
FANDNHAPMLRPNKRGREAESISHNVQRQQKLQMSLNYNHNNISVQEEAPKENLVSTGLRLSYDDDERNSSVTSASGSIVAAAPPILQSLDDTLRIDLHRXKDELEQFLKIQAAQMAKEVRDMKQRQIASFLNTIEKGVSKKLQEKDQEIDIMNKTNKELVERIKQVATEAQNWHYRAKYNESVVNALKTSLQQAMSHNNNNVVAGADHCKEGFGDSEIDDAASSYIDPNNSNNNMGSQRMRCKMC

SEQ ID NO: 42221 - protein, 455 aa, Oryza sativa (indica cultivar-group)
MGGSGKWVKSLIGLKKPDREDCKEKLQVPSVNGGGGGKGRKWKLWRSSSGDHGSLWRGSRGGGGGGGHHRSASSDASDDASSAAGDPFTAAVATVARAPAKDFMAVRQEWAAIRVQTAFRGFLARRALRALKGLVRLQAIVRGRQVRKQAAVTLRCMQALVRVQARIRARRVRMSTEGQAVQKLLEARRTKLDILREAEEGWCDSQGTLEDVRVKLQKRQEGAIKRERAIAYAYSQQIEGATKCNFWTKCVIFLVFAQQQPKPTSYGRLNQSGMLLKHQHFDKSNGNWSWLERWMAARPWENRLMEEHNQTNSSSPDLLSSKNCEDSFGILGDFSEPNSVKVRKNNVSKRVCAKPPVVSHHQRIKAQSISSLSTELHNDESSASSSSCFASTPISFSTFVTTEKTEDSIRARPNYMNMTESIKAKRKACNAQRTTAGKLMEDRKASGVELKVAQV

SEQ ID NO: 42222 - protein, 565 aa, marine gamma proteobacterium HTCC2143
MYTEMQTVWDQLTGQGGPFEVVEAEVGGNLLKTYATAPPSLRELWLSSLAFADRDYLVFQDERKTYAEAHADVAAIANWLLQQGIKPGDRIAIAMRNYPEWLLIYWACMTQGIAIVGMNAWWVEEEMAYGLEDSTPKILFCDQERLDRFNNIRDNFTDIHVVTVRCASANDTDIAYETVTATPGVLPDQTVAPDDDACIFYTSGTTGRPKGAQLTHRGCVSNIMNIAFFGNLGTLTTALVDKVAPPNPEDAVPISGLITTPLFHVTANNCLAQAATASGGKLALMYRWDAEDALKIIEAEKITNLTGVPVMSRELISHPDFEKYDTSSLLSVGGGGAQLQPDLVAKIDKAVATARPSTGYGMTETCGIISSISGDFFVDKPDSCGRAVPTLDAKCFDAEGNEVAQGEVGEMWVKGAPVIKGYLNRPDATAESITDGWLHTGDVARIDKEGFIFVVDRVKDMVLRGGENIYCAEVESVVFHIDGVAECTVFGVEDDRLGEEVGLAVVLAPGSNLDAEAIRTQCAARMAKFKIPRYIWLMTESLPRNASGKFLKRELRESLKISNAA

SEQ ID NO: 42223 - protein, 739 aa, Photobacterium profundum SS9
MDRKKVVLLVTLITLIGLWFAFDLSQYFTLEQAKAQQLALQDTIAEKPFLSSLVYFAVYILVTALSLPGAAIMTLLGAALFGFWWSLLLISFASTIGATLAFLFSRFILRDWVQAKFGNRIAPINAGIEKDGPFYLFTLRLIPVFPFFLVNLLMGLTPISTRMFYLVSQLGMLAGTAVYINAGTQLGEIESLSGIISAPVLMSLALLGLFPLIAKFIMNIITQRRVYANWKRPEKFDQNMVVIGAGAGGLVSSYIAAAVKAEVTLIERHKMGGDCLNTGCVPSKAIIRAAHTMAEISRAHEFGITTDKPQVNFEKVMSRIHNVIDKIEPHDSVERYSSLGVNCISGEAQILSPWEVEVNGQRITTRNIVIATGARPLVPGISGLQDVNYLTSDSIWSLKVQPKKLLVLGGGPIGCELAQSFSRLGSDVTLVEMAEQLLIREDTDASLLVKESMHKDGVDIKLNHKATRFESITAEDGTRIQRAYLEYNGKEVIVEFDAVMLALGRVANVQGFGLEELGITTTQRGTVDVNDYLQTKYPNIYAVGDVAGPFQLTHAAAHQAWYAAVNGLFGQFKKFKADYSVLPAATYTAPEVARVGINEKEAENLNIEFDVTRYGIDDLDRAITDGEDYGFVKVITPKGKDKILGVTIVGNNASELLAEFTLAMRHGLGLNKILGTIHPYPTMSEANKYTAGVWKQANAPQALLAWVKKYHAGMRNDKSQKITQPTAPNTQAKLEEEQR

SEQ ID NO: 42224 - protein, 471 aa, Burkholderia pseudomallei K96243
MSKTVADVMQLAKDEDVKFVDFRFTDTRGKEQHVSVPVSAFGEDKFESGHAFDGSSIAGWKGIEASDMLLMPDPNAAFIDPFYEESTLVLTCDVVEPADGKGYERDPRSLAKRAEAYLKSTGIGDTAYFGPEPEFFIFDSVQWNTDMSGCFVKINSEEAPWSSAKEFEGGNTGHRPGVKGGYFPVAPVDQFQDMRSEMCLLLEQIGIPVEVHHHEVAGQGQNEIGTKFSTLVERADWTQWAKYIIHNVAHSYGKTATFMPKPVVGDNGSGMHVHQSIWKDGQNLFAGNGYAGLSETALFYIGGIIKHARALNAITNPTTNSYKRLVPHFEAPVKLAYSARNRSASIRIPHVSNPKGRRIETRFPDPMANPYLCFSALMMAGLDGIQNKIHPGEAADKNLYDLPPEEDAKIPTVCAGLDQALEALDKDREFLTRGGVFTDAMIDAYLGLKEQELAKFRMTTHPIEFEMYYSL

SEQ ID NO: 42225 - protein, 525 aa, Rhodopseudomonas palustris CGA009
MIAALTHVARLGRAAFVFAREGVFGVVDPALIPPAGQVPVRLARLIERRGAKSGARLSRALTRLGPAYLKLGQFLATRPDVVGVAMARDLESLQDRLPPFSQDEAEQVIAISLERPVRDLFVSLSPPVAAASIAQVHRGEIELGGVRKQVAVKVLRPNVSARFRRDLSDFFYVAEKAELYSAEARRLRLVEVINTMSRSVAMEMDLRLEAAAASEMAENTKDDPDFRVPTVDWDRTSHNVLTMEWIDGIPLNDHARLKEANVDTVELGRKVIQSFLRHALRDGFFHADMHPGNLFLDRDGKLVAVDFGIMGRLLPKERRFLAEILLGFITRNYRRVAEVHFEAGYVPPHHSVENFAQAIRAIGEPIHNRLAEEISMAKLLTLLLEVTGLFDMRTRPELILLQKTMVVVEGVARSFDPKLDIWKVADPVVREWIQRNLGPIGKVEGALAGAGELGHTLTSLPTIVSRAVTVLNQLEVMTKDGLVLAPETIAAIGRTERGRTRGRTVALWVIAATFIGVLIALSRMI

SEQ ID NO: 42226 - protein, 297 aa, Cytophaga hutchinsonii ATCC 33406
MHTFYGTGTALITPFKKDHSVDYDAFKNLIEFNISSGVDYIVVNGTTAESATTSKEEKAKLLEVALDVNNGRVPVMYGIGGNDTAEVIQRIGSADFKGVDALLSVCPYYNKPSQEGVFQHYKAIAEKCPVPVLAYNVPGRTGINISAKTSIRLSEVKNIFGIKEASGDLVQALEIIKNTPNEFLVISGDDLLAVPTISLGAVGAISVLSNTYPAKFSEMIKAAIQSRFQQATQILARFTEMNPLMYEEGNPVGVKSLLELMGICSSEVRLPLVKASGELIHKIEQAHVKITREYANH

SEQ ID NO: 42227 - protein, 674 aa, Synechococcus sp. CC9605
MCGIGGVFNADRQQTVDRQLLVNMAAIQAHRGPDGFGVEVLDQAGVGFCHARLSIIDLNESRARQPFLTDDGEVLMAHNGEFYDFQRIRADLTAQGVRFSSKSDSEILLRLYQRQGLEATLPLLRGEFAFALFDRSEDCLYLVRDRFGIKPQYWAITPEGLVFGSELKVLFAHPAVERRFTSEGLFHQLMQTMVPGTTAFAGVHQVKPGHVLKVQRVNGHLEVSESTYWDVDFPRKDERDPKRTEADYIAAVRAALLEAVELRMVADVPVGCYLSGGIDSCSILGLASAVSQAPVKAFTIGFDDARYDESPIAREMAEATGAEQDLMRLSGQELYGHMERTIWHAERTIYNTLAVAKFLMSRHVNDVDYKVVMTGEGSDELFGGYPAFRRDMFLHGLDDLPQEERASWESLLQQSNALVKGAMLAENQVDDPDLDAVVGFTPSCLQPWLACAPLVPELLAESHAAALEGYSPGKAIAEQLDADQLDGRHALDKAQYVWIKTMLEGQILTWGGDRVDMANSMEARPAFLDHHLAAVAVQVPPELRIKGKTEKYVLREAMAGLLPEVLYRREKFAFMAPPAHTEPEKWGQMKQLADDYLSDEAIDSAGLLSKAGVLALFERHEDPATTDAERVQMDAVINHLLGVQMLHRMFVAEDVPALARREADRLGWRVLMPV

SEQ ID NO: 42228 - protein, 379 aa, Arabidopsis thaliana
MTTICDLPRDLVARILSRVPLTSMRRVRFTCKRWNTISKDPSFAKTHFGKAARQFIMMSQSRVSLMSVKLHGDGKLTSLNNLDQVEISKVFHCNGLLLCLTKDKTRLTSLVVWNPYLGQTRWIKPRHAFHRLDVYALGYDKNLKNHKILRFVDSYEPAVKHSIIEHEIFDLKSNAWRVLDATPDWEIDSYQRGVSLKGNTYFFAKEKIVVEGDDVVVIEDFKDFLICFDFTKTVTLSSVREEQLAVLYQQDTCLMEIWVTNKIEPDVVSWSKVFLAVDMEPLTGSFIPFAFFAGSFFIDEEKKIAVVFDKDQEEINDRAYLIGENGYYKEVDLGYMNGYYQQQVDPRGPDPVFPLVCSYSPSLVTIPQGTRGKRKERDY

SEQ ID NO: 42229 - protein, 374 aa, Loeseneriella africana
ALSIAGAVQSQKLAVRAISQLQSLPGGDIKLLCDTAVENVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDGMGGRNPTRLWGLVVCHHTSARCIPFPLRYACEFLMQAFGLQLNMELQLAAQLLDKHVLKTQTLLCDMLLRESPTGIVTQSPSIMDLVKCDGAALYYQANYYPLGVTPTEAQIKDIVEWLLAFHGDSTGLSTDSLADAGYPGATSLGDAVCGMAVAYITNKDFLFWFRSHTAKEIKWGGAKHHPEDKDDGQRMHPRSSFKAFLEVVKSRSLPWEN

SEQ ID NO: 42230 - protein, 374 aa, Methanosarcina mazei Go1
MFRFADELGPFKIIHIYEPSIDLKAVLVVDNIARGPALGGVRIAPDVSAEECFRLARAMTLKNAAADLPYGGGKIVVYGDPKMPFEKKSQLLRALAGALRYTEEYIFAPDMGTDEICMACIKDEIGRVVGLPCEMGGIPLDEVGATGWGLFNATEVALKYCDFELKGARVVIQGFGAVGKHAARFLVRKGAVLVGVADSRGAVHNPEGLDVDSLIALKNEGKNVFEYPEGKKLASDEIVSVPCDIWIPAARPDVINGNNVHLLDTKLVVEGANIPLTGEAEKILYDKGILYVPDFIANAGGVICAASEHQKTTRSIVFGLIEEKVRSNTEQVLEASKTRGILPREAAFELAIKRVNRAMKYRRWSIFSSAPGFV

SEQ ID NO: 42231 - protein, 345 aa, Chrysanthemum x morifolium
MILINPTSLFYGASLKPRSTSFIYQTRKSQSVSISALLTKEQQSKHTQLESEFDFKSYMVQKANTVNQALDDAVPIREPKKIHESMRYSLLAGGKRVRPILCLASCELVGGDQISAMPAACAVEMIHTMSLMHDDLPCMDNDDFRRGKPTNHIVYGEEIAVLAGDALLSFAFEHVATATKDVSAERIVRAIGELAKCIGSEGLVAGQVVDICSEGADVGLEHLEFIHLHKTAALLEGSVVLGAIMGGGSDVEVERLRKFVRSIGLLFQVVDDILDVTKSSEELGKTAGKDLVADKTTYPKLLGIEKSREFAEKLNKEAQEQLKEFDIRKAAPLIALANYIAYRDN

SEQ ID NO: 42232 - protein, 363 aa, Loeseneriella africana
QSQKLAVRAISQLQSLPGGDIKLLCDTAVENVRNLTGYDRVMVYKFHEDEHGEVVAESRRPDLEPYIGLHYPATDIPQASRFLFKQNRVRIIVDCHASPVIVIQDDGLMQPLCLVGSTLRAPHGCHAQYMENMGSIASLAMAVIINGNDEDGMGGRNPTRLWGLVVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIKDIVEWLLAFHGDSTGLSTDSLADAGYPGATSLGDAVCGMAVAYITNKDFLFWFRSHTAKEIKWGGAKHHPEDKDDGQRMHPRSSFKAFLEVVKSRSLP

SEQ ID NO: 42233 - protein, 738 aa, Saccharomyces cerevisiae
MHKERPLNKASMIRSPVDEIYMEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 42234 - protein, 365 aa, Loeseneriella africana
AVQSQKLAVRAISQLQSLPGGDIKLLCDTAVENVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDGMGGRNPTRLWGLVVCHHTSARCIPFPLRYACEFLMQAFGLQLNMELQLAAQLLEKHVLKTQTLLCGMLLRESPTGIVTQSPSIMDLVKCDGAALYYQANYYPLGVTPTEAQIKDIVEWLLAFHGDSTGLSTDSLADAGYPGATSLGDAVCGMAVAYITNKDFLFWFRSHTAKEIKWGGAKHHPEDKDDGQRMHPRSSFKAFLEVVKSRSLP

SEQ ID NO: 42235 - protein, 443 aa, Rubrobacter xylanophilus DSM 9941
MSEITRENVVREARERNVKFIRLWFTDILGTLKSFAITIDELEDALDGGMGFDGSSITGFNAIEESDMIAMPDISTFKIIPWSPKDAPTARMICDVRTPEGDPYVGDPRYVLRRALERAHEMGFDNFYCGPELEFFYFKDSSAPEPLDYGSYFDLTTLDAATALRRDTVLALQELGIDVEYSHHEVGVSQHEIDLRYDDALSMADAVMTYKTVVKEIATQHGVYATFMPKPIQNQNGSGMHTHQSLFSNGRNAFFDPDDEYFLSETAKQFIAGQLRHAREISIIFAQYVNSYKRLVPGYEAPVYIAWSRRNRSALVRVPLYHPGKEQATRVELRCPDPAANIYLCFAALLHAGLEGIEKGYELPEPMERNLYHLTHEEREKLGIQSLPEDLGEAIKEAENSELLHKTLGDHVYNRLLQLKREEFEEYRVQVTPYELQRYLPVL

SEQ ID NO: 42236 - protein, 549 aa, Oryza sativa (indica cultivar-group)
MAAAAARRGSSLLSRCLLSRPSAAASPAVPSALRRADGTQGLLPGILQRFSTAAVAEEPISPPVQVNYTQLLIDGKFVDSASGKTFPTLDPRTGELIAHVAEGDAEDINRAVHAARKAFDEGPWPKMTAYERSRILLRFADLIEKHNDEIAALETWDNGKPYAQAANIEVPMVARLMRYYAGWADKIHGLVVPADGPHHVQVLHEPIGVAGQIIPWNFPLLMFAWKVGPALACGNTVVLKTAEQTPLSALFASKLLHEAGLPDGVVNVVSGFGPTAGAALASHMDVDKIAFTGSTDTGKVVLELAARSNLKSVTLELGGKSPFIIMDDADVDHAVELAHFALFFNQGQCCCAGSRTFVHERIYDEFVEKAKARALKRVVGDPFKNGVEQGPQIDDEQFNKILRYIKYGVDSGANLVTGGDRLGDKGYYIQPTIFSDVQDNMRIAQEEIFGPVQSILKFNDLNEVIKRANASQYGLAAGVFTNNLNTANTLTRALRVGTVWVNCFDVFDAAIPFGGYKQSGIGREKGIDSLKNYLQVKAVVTPIKNAAWL

SEQ ID NO: 42237 - protein, 336 aa, Xanthomonas axonopodis pv. citri str. 306
MSRPSLTRFLIEEQHAGRIDAELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPEDTAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAEATRYHLDADKA

SEQ ID NO: 42238 - protein, 364 aa, Maytenus fournieri
VQSQKLAVRAISQLQSLPGGDVKLLCETVVESVKDLTGYDRVMVYKFHDDEHGEVVAERKRPDLEPYIGLHYPATDIPQASRFLFKQNRVRMIVDCHALPVRVIQDDGLMQPLCLVGSTLRAPHGCHAQYMENMGSIASLAMAVIINGNDEEVIGGRNPTRLWGLVVCHHTSARCIPFALRYACEFLMPAFGLQLNMELQLAAQLLEKHVLKTQTLLCDMLLRDSPTGIVTQSPSIMDLVKCDGAALYYQGSYYPLGVTPTEAQIKDIVEWLLAFHGDSTGLSTDSLADAGYPGAALLGDAVCGMAVAYITNRDFLFWFRSHTAKEIKWGGAKHHPEDKDDGQRMHPRSSFKAFLEVVKSRSMP

SEQ ID NO: 42239 - protein, 363 aa, Maytenus fournieri
QSQKLAVRAISQLQSLPGGDVKLLCETVVESVKDLTGYDRVMVYKFHDDEHGEVVAERKRPDLEPYIGLHYPATDIPQASRFLFKQNRVRMIVDCHALPVRVIQDDGLMQPLCLVGSTLRAPHGCHAQYMENMGSIASLAMAVIINGNDEEVIGGRNPTRLWGLVVCHHTSARCIPFPLRYACEFLMQAFGLQLNMELQLAAQLLEKHVLKTQTLLCDMLLRDSPTGIVTQSPSIMDLVKCDGAALYYQGSYYPLGVTPTEAQIKDIVEWLLAFHGDSTGLSTDSLADAGYPGAALLGDAVCGMAVAYITNRDFLFWFRSHTAKEIKWGGAKHHPEDKDDGQRMHPRSSFKAFLEVVKSRSMP

SEQ ID NO: 42240 - protein, 383 aa, Porphyromonas gingivalis W83
MAEKRDYYEVLGVSKNATDDELKKAYRKKAIQYHPDKNPGDKEAEEHFKEVAEAYDVLSDPQKRSQYDQFGHAGLGGAAGGGFSGGGMSMEDIFSRFGDLFGGFGGFGGFSDMGGGSRRRVRRGSDLRVRVKLSLADISKGVEKKVKVKKQVVCSKCRGDGTEEANGKTTCQTCHGTGVVTRVSNTFLGAMQTQSTCPTCHGEGEIITKPCSKCKGEGVEIGEEVISFHIPAGVAEGMQMSVNGKGNAAPRGGVNGDLIVVIAEEPDPNLIRNGNDLIYNLLISVPLAIKGGSVEVPTIDGRAKIRIEAGTQPGKMLRLRNKGLPSVNGYGMGDQLVNVNVYIPESIDAKDEQAIAAMENSDSFKPTDAARKDIDKKYREMLD

SEQ ID NO: 42241 - protein, 454 aa, Thalassiosira pseudonana
MNIDDDLEKLLNNLPFFIYHHLNTHANKEKLIEIVLDLGRRPEARFTTGPEYLSQKIISWQDIDYMTKRISKFSGENRAGIERTLHRISCIRNRQFLINGLTCRVGRAIFGTISIIRDLLESGKSILILGRPGVGKTTIIREIARVLSDEMEKRVIIIDTSNEIAGDSDVPHSGIGRARRMQVPKTELQHKIMLEAIENHMPQVIVIDEIGTELEALAARTIAEKGVQLVGTTHGNCLENLIKNPSLSDLIGGIQYVTISDEEAKRRGTQKSILERKSYPAFQLAIEVNSLSSWTIYENVENSVDLILRGNFHIAQIRNLKKNEKLIINYKKFQKDFLIKNSRFLNKEMISIHKNWFLVNEPKRIRSLNLKNTTLIIYPYSLSKNLIREMLIQFGDKIIFTTQINQANLIIGLKKHLRQNFRLKSLANKQNIPIYTINQRSIYQIMRLLQFFIS

SEQ ID NO: 42242 - protein, 446 aa, Glycine max
  misc_feature (387)..(387): Xaa can be any naturally occurring amino acid
  misc_feature (402)..(402): Xaa can be any naturally occurring amino acid
  misc_feature (427)..(427): Xaa can be any naturally occurring amino acid
  misc_feature (429)..(429): Xaa can be any naturally occurring amino acid
  misc_feature (440)..(440): Xaa can be any naturally occurring amino acid
  unsure (1)..(446): unsure at all Xaa locations
HGWAHEIAQLPCDSDGVCMLCKLKPSPSQTLSCGTCATPWHLPCLPSPPLSLSDSHWDCPDCSDTFCHHPVAPTAHLVSAIHAIQADTSLTDQQKAIKRQQLLAGSAHPSKDKTKAKDIFDGSLNCSICMQLPDRPVTTPCGHNFCLRCFEKWIGQGKRTCANCRAQIPTKMASQPRINSQLAMAIRLAKAAKSEGSSGPPKVYHCPRNQDRPDTAFTTERAKKTGKANACSGKIFVTVPPDHFGPIPAENDPTRNRGVLVGDTWEDRMECRQWGAHLPHVAGIAGQSAYGSQSVALSGGYEDDEDHGEWFLYTGSGGRDLSGNKRTNKLQSFDQKFENMNEALRVSCRKGYPVRVVRSHKEKRSSYAPESGVRYDGVYRIEKCWRXNGIQGCKVCRYLFVXRCDNEPAPWTSEEIGDRPRPLPKLXEXGAVDVTERRVXPSWDYD

SEQ ID NO: 42243 - protein, 1099 aa, Candida albicans
MLESLNRRNSIDSNQADNDNDNDNHSNDELSPSELYYSPSGSPPKSQLLLRKSSSPSSYSPIKSDLPNIYSHLRSNDSESPPQPSPKQQSSLSSSSSSSSSSNTKSSTTKNIFKKLLRINKSSDNIDESRSIVSNNGGSPMSDSTTVTSTLSTDTAPKRGKSIQRSQILHHTDSDSLYLENQIELRPEISKSIGNIKIPSIFTNDGMPLLKISHKSKKRILFWIDPSCFKFSWRMANSTTTTTSATTSATTSGLPQGITNTTALSNSAIISTPAIATSAIHRLSITNRTTHEFVLDDIKSIYIQNEGSGYREELNISQKLEKNWITIIYFNHKKNSLKSLHLITDNDHDFKKLISAIYNLKQLRSQLAKEFLIDLNELDENYVKMLLNKELLAGDNGNVDGNEVDIRKSHKHVREFLSFNDILKYSKRLNINVNTNHLQQIFDQVLLLSSATTEKPVSTPLFEKGLNFEQFKQFVSILKDRKDLQEIWDSLAQGKEVLQFDEIKNFIINIQKENFSDDDDNSTINLIFQKYCSNDNGWNKESLNEYLLSSYSTPYREITQTQTNYYDYPLNEYFISSSHNTYLTGRQVAGDSSVEGYIRTLQRGCRCVEIDIWNGDSNTTTTTVIGTKDDDDKNEYEPIVNHGRTFTKPISFANVIRAIKKFAFIVSPWPLILSLEIHCSPECQIKVVNILKDILGENMIIAPIDIDSVILPSPAELKHKFIIKVKKTTSFQNLIETENGSFTTSTTTTTTTTTTTTTATSLSEDNENNKSNSSSTSSFIIRRRKNKSPKIINELSNLGIYTQGIKFRNFSLPESKTFNHCFSLGEKSINRMIKDDDKKISLDKHNRRYLMRVYPSGTRLKSSNFNPLPYWSHGVQMVATNWQTYDLGQQLNEALFENKIFQGYVLKPSVLRKPTLKSSSSNVDTRTSLTTTNSKTIRFNFEIISGHQLPKFPKDDYKDQAINPYISFEIIGAQDVQWDNNDSSPIAPTTSSSPFIRTTKIIRENGFNPNFNTKFSGSIITTTNDLIFIKFVVYASTSLNYPDYGENFPIAILVTKLNYLKQGYRYIYLNDLLGEQLVYSSIFIKIEYDEDLLNEFINK

SEQ ID NO: 42244 - protein, 1176 aa, Cytophaga hutchinsonii ATCC 33406
MSQSTKTYTSTCSYCGVGCGVKIHKAVNGSLQIEGDKSYPANQGMLCSKGMNLHYAAMDQTDRLLYPEMRGNRNMPLQRVSWDTALDRAAAVFKALIEKYGPDSVGYYVSGQCLTEEYYIANKITKGFIGTNNIDTNSRLCMSSAVVGYKLALGEDSVPLSYDDIELADCFFITGANPAWCHPILFRRLENHKAANPHVKIIVADPRKTQSCSLADVHLQLQPGTDIVLCHAIARRLIETGKIDQAFIDAHTSGYEAFKEKVFTLSLQEAADICVLEKELIIQAADMIGDSQAFISMWAMGLNQSVIGVNKNVSLLNLSLITGQIGKPGAGPLSLTGQPNAMGGREVGGLSNMLPAHKNLLNPAHRKEVADFWGVPAINEKPGFTATEMFDQLLSGKMKAVWIICTNPLVSLPDARNAEAALRNARFVVVQDISNKSDTLKYADLVLPAAAYMEKEGVMTNSDRRISYLSKVMEPPGEALPDVDILCRFAHKMGWKESFNYASNAEIFEEYTRITKGTNIDISGLSYADLIQRRSVQWPVPEKGHPGTPRLFTDHTFYTPTGLANIISVDSMNHSEKLDDDFPLILTTGRIRDQWHTMTRTGKVRKLNKHISKPFLEIHPEDAGIRGIKQDDVVTIESRRGDVRVTAILTEDIKKGVVFLPMHWGRMLSTDLTRTNNVTNNLIDPVSKEPDYKFTAVQVTKYVKPREHIVIVGAGAASCQFIKRHRELGAEDTITVFSAENFHFYNRVLLPEYVSKHKSWDNLEKLRKAEWLELGVTLIPRKITRLITESKSIVDDTGEVHCYDRLLVATGSRSTQMKHIAPVKGIFTMRRREDADALIHHLSTGDSVVVVGGGLLGLEMADSLLEIGMKVSVIQRSSRLMDRQLDKTAANLLAKELTERGMDLYFDDEVLYVNGEYAVESLRLKSSRKIDCKAILFAIGTQPNVEFLKEAGIQVNRGVIVDEHLQTSNEFVYAMGEIAERNGALFGITAGAEEQATVLAEYLNGSTTSNYTGTLSMNILKVHGVELCSIGMVEAPPNNPDYEEIIFLDKTRKYYKKCIVYQDRLVGAILMGDKSEFNEFRDWIKSGVELGEKRESLLMSGSISKEPMLGTLVCSCNTVGSGNIENAIKGGCKDVTSICNTTGAGTGCGSCKPEVKAILERMHAVTESSNSQKTYA

SEQ ID NO: 42245 - protein, 396 aa, Bartonella quintana str. Toulouse
MAEVNVRNFNINFGPQHPAAHGVLRMVLELDGEVVERVDPHIGLLHRGTEKLMETKTYLQAVPYLDRLDYVAPMNQEHAFVLAIEKLLGVEVPKRGQLIRVLFSEIGRILNHLLNVTTQAMDVGALTPPLWGFEQRERLMIFYERACGARLHANYFRPGGVHQDLPESLIEDIGHFIDPFLISLSRLDALVTPNRIFKQRNVDIGVISIDEAWVRGFSGVMIRGAGVPWDLRKSQPYECYDEMEFDIPVGKNSDCYDRYLIRMEEMRQSARIMRQCVDRLLGSEKNGPVSSLNRKVVPPKRSEMKSSMEALIHHFKLYTEGFHTPPGEVYVAVEAPKGEFGVYLISDGTNKPYRVKLRAPGFAHLQAMDFLTRGHMLADATAILGSIDIVFGEVDR

SEQ ID NO: 42246 - protein, 385 aa, Candidatus Blochmannia floridanus
MKNNKSTVSVRSGLNNDKQHGCVVSPITLSTTYNFFEFNKPRLYDYSRRKNPTRDIVQKTVADLEQGKNAIITSSGMSAIYLICIALLNSDDCLIAPYDCYGGTYRLLNALNSKKVCRVQFVNQNDTELMLKCLKQKDVKLVFIETPSNPMLRVVDIRYMCSLKERDDIVYVVDNTFMTPIFQNPLNLGADLVVHSCSKYLNGHSDVILGAVISKDIYLHEKLMWWSNALGITGGAFDSYQLLRGIRTLSIRVCQQQCNTKNIVDFLLKQPQIKSIYYPGLYSHVGYKIACQQQTGFGSIFSFELKGTEGVVSKFLKSLKLFTLAESFGGVESLIAHPETMTHAAMSKQSRDTAGINNMLLRVSVGLEDSVDLINDLDQALQSIS

SEQ ID NO: 42247 - protein, 743 aa, Synechococcus sp. CC9605
MTNSPRSVRSQCPYCGVGCGLELLPPAVKGEAVKRDAEGNPMWNARGDREHPSSLGQVCIKGATIGETLAPGRLRQPLFRQTLEDDFAPISWDDALNKITGQIKASVARRGNADGIAMYGSGQFHTEDYYLAQKLLKGALGTNNFDANSRLCMSSAVAGYTRSLGSDGPPCSYEDLDHCSVAFLIGTNTAECHPVLFQRLLKRKRKNPGRVKIVVVDPRRTDTAKAADIHLPIAPGSDLALLHGIAHLVLRENGQDPAFIDDHTENYDSFFDVAARWTPRRVARFCNIPEKRLREAAALFHRREKVLSLWSMGVNQRREGTAVVQGLINLHLLTGQIGKQGAGPFSLTGQPNAMGGREAGGLAHLLPGYRLVANAEHRAEVEQAWQLPAGQINAKPGLAAWQQIEAMEQGALDLWWVAATNPLVSLPDLDRVKSAMQKCPLVVVSEAYADSETSHYAHLILPAAQWSEKAGAMTNSERRVTYCPAYRRRFGESRPDWEVFAEVGRRLGYSEQFNFESAAEVYAEFTALTQGRLCDVSGLSHELLEDEGPQQWPYPSGSTPTTAAKRLYENHQFATPNKRARFSTDQPLGLAEPPCDTYPLVLTVGRYLGQWHTMTRTGKVERLMKQHPEPLLEIHPGDAQDLKLRNGELAAISSRRGHLTATVKVTDRIRRGSVFLPMHWGFTQEKACEANTLMHDEACPVSKQPELKACAVIVAPAVSVVKPIEQQKGRLEALRRLLTPALR

SEQ ID NO: 42248 - protein, 163 aa, Bartonella quintana str. Toulouse
MSGLIQAAKSLLLLEFVSAFFLAMRQFFSPKPTINYPYEKGVVSQRFRGEHALRRYPNGEERCIACKLCEAICPAQAITIEAGPRGNDGTRRTVRYDIDMVKCIYCGFCQEACPVEAIVEGPNFEFATEMREELYYDKEKLLMNGDRWEREIARNILIDAPYR

SEQ ID NO: 42249 - protein, 262 aa, Candidatus Blochmannia floridanus
MKNLSIIANWKLNGNKNTITNSLINLTTQLTNIPQYIKIAIAPPILYIDMVKNHLTSYNNKTIELCSQNVDIHLSGAFTGDISASMLKDLSVKYVLIGHSERRIYHKENNSLIAQKFSIIKQTELIPILCIGENKEERDSGSTQSICIQQIDSIIKLVGIKAFENTIIAYEPVWAIGSGSSASPRNVQSIHQFIRNYIAQYDKTIANQISIQYGGSITTDNVLEFITQKDIDGVLVGSASLDIRNLIKIINLSSNLIKKTYQ

SEQ ID NO: 42250 - protein, 320 aa, Candidatus Blochmannia floridanus
MIKKIGVLTSGGDSPGMNAAIRGVVRAGLSEGIEVYGIYDGYLGLFQNRMMLLSYCSVSDIINKGGTVLGSSRFPELKKDMIRSVVMNNISKSHLDALVIIGGDGSYIGARRLSDLGCPCIGIPGTIDNDVAGTDYTIGYFTALETIIEAIDRLRDTSSSHQRISIVEVMGRYCGDLTISAAIAGGCEFVIIPELKFQMQDLVDKIKLNISKGKKHAIVAITERICNVFDLAQYIENETGKETRATVLGHIQRGGKPVAYDRILASRMGAYSIELLLKGYGRHCIGIENEKLVHHDINDATKYMRRSFRQDLLTTAKKLC

SEQ ID NO: 42251 - protein, 232 aa, Synechococcus sp. CC9605
MGIQRRHFLQRTGGLALAYLMQARPVEAAEEGFCIPNDPLEALMAGNRRFAEAWRRGKQEDGTTLRTADPDLRCFNSPRALATSQHPWATVLTCSDSRVSPSWVFDTTPGELFVIRNAGNTAFTEAIASIEYGVGVLKTPLLVVMGHSGCGAVTAAMDVNPLTPSLDRLIQPIRENINGSSDLEDAVKRNALASASTLIQRSTVLADAKASGALKLVVGCFQLSSGVVRLIE

SEQ ID NO: 42252 - protein, 668 aa, Magnetospirillum magnetotacticum MS-1
MLLVLWGFVAYWSWSQRKSIIASNTVVLEQLTTAAEEQTLRLFRHAETSLMASNFWMADHPQTDPGDSPSFIALVDRLRQMSDGMLDIRMVTSGGGLHYIPRRGPKPLANVADRDYVRAQAQMQTRGFFIGNPVVSRVTGKWGIPVSIPVDKSGGDVSILFAAIELDRIAKTFEAERIKPLGSIAILRADGTFLFRVPIEDHVIGINIADTPSFKENYALSTKGVFISSSQFIDGKERMVSYQRLRDYPLIVIVTAGIDDLLTPWRRETATLVSIAGLVSLAIILLSLILIRAMKAEEKAQKDIEQARREAELILSTAGEGICGTDTGGRITFMNPAARIMLGWEHEDPIGQDLHANNHHTHSDGSPYAAEDCPVGRTLDDGETREALGETFWRTNGPSFPVDFIVTAIRENGKIKGAVLVFRDISERLASEQALTAQATELSRSNADLEQFAYVASHDLREPLRQVASFVSLLERRYAPTLDDDARDYIAYAREGAKRMDRLIIDLLEFSRIGHRSLPVEKVDLAGVIDEAVANLNTVIVESGAQVNRTPDLPVLPVIRDDMVRLFQNLIGNAVKYRHPERTPIVRISAKEGADGWIVSITDNGLGIDPQFSERIFGIFQRLHTRDKFEGTGIGLAIAKKIVERAGGKIWVEPAEGGGSIFQVQLPA

SEQ ID NO: 42253 - protein, 1338 aa, Kluyveromyces lactis
MSFLKKKSSTAGHSRSGSASSILNKHVDPANISEFYPSSLDHKVTSGLKNDYSFDSSSKGSRKSSGGSTNSLTSERLLFNWDVTDPSQWTMPRIIQWFRANDFNDQWITFFKRNSISGNKFLKLLAYDNFAPYEKSLQQSKSSSYERFQYLLKKTLEENVVKGNNRNGNRIINNSRSSSESAKVSQRLSTSFSTHIRSTSESALLNIENITKDSSSSEPTTSKKQEASNYSLPLRQAKTNSASALYRRSLISLRNASSTKDNASKNDIKITIPPRPLSTTENTNKSPTTPSSVSPSHTAYTGIFRRQHKTSSSESSLFTSIFGHGVVEEPEETPKPRPVENRRIPAASTVNASTSKQSINVDDKARLWDKIKRKGQLPAEPSSQPAARIIIEEVKESPKAEPPEIVIPEEIYPKRPSDSRELFIMLTKDNSTFSPFNVQPHLGTDVSELKKAVALALGLTHSNFSIHLTDFGAEFGSQIPDGLLADFQKTSFQNIPNKLYIQDLEKKANLNPRPRTETLASQHSTAASTKSKTSVKSNASAASNGEGSSSDLTSIDDQGSSHRRAYPQTPSHYYDNSTSAETDYWSFKDSVPETISDAPHITLPKSRPSLKLNSSVLNTHASEKSTFRIIRQTSDTDIDFNKRRESPYVRVAELAPKRKAPKPPVNGNPVTSGSLPSAAAKNVSESPLESPPKLDRNGKTIYQKNKPRPPPPLTTERSSRRSVSSLSGQDLNEVKESPVQSFTPASTQVMVPQPYKGALETLKPRKSSADLSIRPRMSLRQFSRSNSSLNRKVLSTSRQTLNRTNSKPLVTSSTAADIFDENDISFADAPELSDSDDYSASSDEIIWSRDRKSISNDVPEFSFNTEDTIDLVGTDTTQVSVGATEGSDTPKKMALRPSPDVVYQNLEKFFPDADLDNPILEGLTPPPSPNADSSPPSPRGFEKSLKTKSEQQPAFLSSRGESSQFLTPVKSLKPPKRTKTIRIIAQEASEARKNEVSQKLQRKNTKMWGTKVVEITDKRTISINKSRNSRGEYKEFAWIKGEIIGKGSFGAVYLALNVTTGEMLAVKQVTVPEFSSQDESAISMVEALKSEVSTLKDLNHVNIVQYLGFEEKNGIYSLFLEYVAGGSVGSLIRMYGRFDDQLIRHLTKQVLEGLAYLHSKGILHRDMKADNLLLDNDGVCKISDFGISRKSNNIYSNSDMTMRGTVFWMAPEMVDTAHGYSAKVDIWSLGCVVLEMFAGKRPWSNFEVVAAMFQIGKSKTAPPIPDDTKDLVSPAGQSFLDQCFEIDPEMRPTADSLVGHPFCKTSSSFDFPKTKLAQFIKSNDKLNSSRLRISSQEL

SEQ ID NO: 42254 - protein, 128 aa, Brassica napus
DLFFCILKVISREAREFKIGGSAFYYTLIMITGIVWQGFFLGAIGVVFCASSLASAVLISVLLPVTEVLAVICFREKFQAEKGVSLFLSIWGFVSYFYGEYKSGKKVLEKHQPPETELPPLQVSDSVA

SEQ ID NO: 42255 - protein, 1082 aa, Ustilago maydis 521
MDPDGLFDFLAPAEAAPSPAASSGSSPSKKQRKRSKAAAASSSSSQDVTSSPSASQNNDAATSNPQNADAASDGGEAEAGPSKRQKRNTTSDKPAPVPTVVTDEFTDEATQAIPIEDGSAAPCNSAGASDADGAAASATGGASASTANTNAAEKNMHITHSVRHQVALPPDYPYVPLSQHVPNDPPAKEYKFTLDPFQRNSVSCIERNESVLVSAHTSAGKTVVAEYAIAQCLKNGQRVVYTSPIKALSNQKFRELTAEFGDVGLMTGDVTINPSASCLVMTTEILRSMLYRGSEIMREVAWVVFDEIHYMRDKERGVVWEETIILLPRKVRYVFLSATIPNAMQFAEWIAHTHAQPCHVVYTDFRPTPLQHYLFPQGGEGIHLVVDERGTFREDNFQKAMGALADSKGEDVADPNAGAGKRRGQVKKGGNAGKKGPSDIYKIVKMIMVKNYNPVIVFAFSKRECEALALQMSKLEFNTEDEKEMVSTVFSNAINALSEEDRGLPQIEHILPLLRRGIGIHHGGLLPILKEVIEILFQEGLIKVLFATETFSIGLNMPAKTVVFTAVNKWDGKEFRNLTSGEFIQMSGRAGRRGLDDRGIVIMMFDEKLEPSAAKTMVKGEADRLNSAFHLGYNMILNLMRVEGISPEYMLERCFFQFQNAASVPALEAEQKAAEEQRDLIEVEREEEVAEYYDVKHQLETLRKDVQTVITHPSYVLPFLQPGRLVNVCHDDLDFGWGAVVSYEKRLPNTPGKRGPAIDPNAPPQNHYVVDVLLHCASGSGSSDKNAKNDGTSNFRPCPAGSKGEMVVVPVLLSTIQSISGIRVFLAKDLRPSEPRETVRKNLVEVKRRFPKGVPLLDPIKDMKIKDESFAHLVEKIKILDDKLGSSRLRNDPDLPRLYAAYSKKQAAQQVVSAIAKKIAAAHSVLQLDELKCRKRVLRRLGFTTSDDVVEKKGRVACEISTGDELLLTEMMFNGVFNDLTPPQCAALLSCFVFGEKSTTQTRLNETLAAPLRIMQETARRIAKVSIESKLALVEEEYVSSFKVELMDLVMQWCNGAKFAEICKLTDVFEGSIIRCCQGYWQ

SEQ ID NO: 42256 - protein, 379 aa, Arabidopsis thaliana
MLPSRKTKRVFSCDFTPGRKRRRCVVVPSSVSPVPENTTGADLLDSIPDDLVISILCKLGSTSRCPADFINVLLTCKRLKGLAMNPIVLSRLSPKAIAVKAHNWSEYSHRFLKRCVDAGSLEACYTLGMIRFYCLQNRGNGASLMAKAAISSHAPALYSLAVIQFNGSGGSKNDKDLRAGVALCARAAFLGHVDALRELGHCLQDGYGVPQNVSEGRRFLVQANARELAAVLSSGIQARSTWLSLSQPPPPVVPNHGQQTCPLLSDFGCNVPAPETHPANRFLADWFAVRGGDCPGDGLRLCSHAGCGRPETRKHEFRRCSVCGVVNYCSRACQALDWKLRHKMDCAPVQRWLEEGDGGEGNVQIDGNGNGDNVLLPMS

SEQ ID NO: 42257 - protein, 429 aa, Zea mays
  misc_feature (128)..(128): Xaa can be any naturally occurring amino acid
  unsure (1)..(429): unsure at all Xaa locations
MSSSAPAPAAMAVDDAEDDQLASMSTEEIIRASRLLDNEIRVHKDELQRSNLELESIKEKTKENQEKIKLNKQLPYLVGNIVEILEMNPEDEAEEDGANIDLDSQRKGKCVVLKTSTRQTIFLPVIGXLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 42258 - protein, 475 aa, Burkholderia pseudomallei K96243
MTYRTEDIADVAPLYASAAPAHRTSAEYRALDAAHHLHPFSDMGSLNRAGSRVIVKAEGVHLWDSDGNRIIDGMAGLWCVNVGYGRDELIEAGSRQLRELPFYNTFFKTTHPPVIELSALLAQIAPPAFNRFFYCNSGSEGNDTVLRIAHQYWRAQNRPQKKFVISRRNGYHGSTIAGATLGGMSYMHEQMPSKVEHIVHIDQPYYFGEAREGQTPEAFGLERARQLEAKILELGAQNVAAFIGEPFQGAGGVIFPPSTYWPEIERICRQYDVLLVADEVIGGFGRTGEWFAHQHFGFAPDLMTLAKGLTSGYVPMGAVALSDRIADALIAHGEFNHGMTYSGHPVAAAVAVANLKVLRDERIVERVKTDTGPYFQQRLRETFANHSIVGDIAGAGLVAGIQLAREPRTRKRFENGGEVGTICRDYCFNGNLIMRATGDRMLLSPPLVISKPQIDEIVEKAKRAIDATAKQLGFA

SEQ ID NO: 42259 - protein, 522 aa, Methanococcoides burtonii DSM 6242
MESFKKLGIEDAILRSIEDKKFEEPTEIQKMAIPLILEGKDIIGGAATGSGKTLAFGCGIIQKIEKGNGIRALVLTPTRELAEQVQNSLKEFSRHKQLRVAPIYGGVAINPQIRQLERADVVVATPGRLLDHIERGTIDLGDVEILVLDEADRMLDMGFIDDVEEIIDECPSDRQTMMFSATVSKDIQYLSSKYMNNPSKVFAKAYVDSDKLKQVYIDVPKKMKFSLLVHLLKSEKSGLVMVFCNTRSNVDFVQKNLRKNDIDAIAIHGGHTQAKRKSTLSKFHSSNAHALVCTDVAARGLDIPHVSHVYNFDIPDDPSEYVHRIGRTARAGREGKVINVVADVDKGGFTRLSKMHRNFKIEREDLPEFERVLIKSEDSGGRPTRGRREDRKGGRREDRKSAYGGRSSGGSSGGRSSDRSSGGSSGGRSSDRSSGGSSGGRSSDRSSGGSSGGRSSDRSSGGSSGGRSSDRSSGGSSGGRSSDRSSGGSSGGRSSDRSSGGSSGDKARTGFKKRTGVQRKRE

SEQ ID NO: 42260 - protein, 495 aa, Polaromonas sp. JS666
MTLITESKELLPINIGGEMRLGGGDESATLYPATGEVVARLRAPSLADVDEAIARADHAFRTSGWAQRKPHERAAVLYRVASLIRERAEPLAQRQRLDNGKPINETRALVASAAGTFQFFASACETLEETITPSRGDFMTMSVYEPMGVVAAITPWNSPIASEAQKVAPALAAGNAVVIKPAEATPLMALELAAICEEAGIPRGLISVLPGRGSVIGDAITQHPLVKRVSFTGGTSTGKHIAHIAADKMMPVSLELGGKSATMVLDDADLDHAVNGVLYGIFSSSGEACIAGSRLFVARRLYGEFMERLATRAAALRVGDPADERTQMGPLITARHRESIERHVALGLSEGASVRTGGARPQGGLYERGYYYQPTILEGVKNTDQICQQEIFGPVLVAMPFDTEDDLLAQANDSLYALAAGIWTRDYKRAWRIGRAVQAGTVWINTYKQFSISTPFGGWRDSGLGREKGRLGILQYMEQKSLYWGLNEQPLAWAE

SEQ ID NO: 42261 - protein, 252 aa, Arabidopsis thaliana
MTMYDLTDSGKDMCSSLCLLAEVAVMVAEEEQFRRLLKTVSKEEDSDKSFFYRFPRKIRSSLVKRRYTQQNPNGASTSSAVLDLNLITTDYDLKTQQNPSFDEPMSIETPEWVFQVMRYMNADAETPRLIFERTLFNSDVKSGLSRLLIPFQQLIRNDFLTPAECRAIQKDEDNEDDKNIGVGTILVNQRSKMWGLRFKIWAMEKDSGHGTLNYILNWGWNDVVKGNGLKAGDNISLWTFRCRGVLCFPLET

SEQ ID NO: 42262 - protein, 309 aa, Vibrio sp. Ex25
MNPISRVAIIGECMVELKKHDGVLQQGFGGDTLNTAVYLSRLTKQHGVETSYVTGLGHDPFSREMLTAWREEGINTDMVYLSEGKLPGIYAIETAEDGERSFFYWRNDAAAKYWLRERALLSLVKDLCQHQMIYLSGISLAIISDDCRQMLIELLTMCRKEGVKIAFDNNFRPKLWPNIEQARDFYSKILSVTDMAFLTFDDEVMLWGDKHEDEAISRTKNFGVKEIIVKRGADDCFVVTQDQQHTVAALKVDAVVDTTAAGDSFSAGYLAKRILGGDVAESALAGHKVAGTVIQHRGAIIPSQAMPTI

SEQ ID NO: 42263 - protein, 837 aa, Cytophaga hutchinsonii ATCC 33406
MKNETHILVVGNGMVGYKFCEKLKKKDSSGNFTITVLGEEPRPAYDRVHLSEYFSTRSADHLTMAPKEWYAANNINLVLGNPVVSIDREQKSVTTFSGAVYTYDKLILATGSAAFVPPIKGVEKDGIFVYRTIEDLEMMIKQAEKSKVGAVIGGGLLGLEAAKALLDLGLKPHVIEFAPRLMPRQLDEAGSKILQQKLESLGLSIHLNKTTSYFDGDAAVTAMQFADDTRLELDMVVISAGIKPRDEIAKKAGLTVGPRGGIEVNDALQTSDPNIYAIGECALHWGMIYGLVAPGYEMAEVVAENLIHEHSKAFRSFDMSTKLKLIGVDVASFGDAFGTEEGSVTITYENKDKGIYKRLNLSADKKRVIGGILVGDAESYNMLLQMVTNKMALPPDPEDLILGSRGEGRSEGGNAGVMSLPDEALICSCEGVTKGMICCAVTDQHVTDLPGMKKCTKAGTGCGGCVPMVNDLISETLKSQGKVIKKVLCEHFDYSRQELLDLIKINEYKSYDVILNEAGKGDGCEICKPAIGSILASVWNEVILKQATIQDSNDRFLANLQKGGTYSVVPRVAGGEITADKLIVLGEVAKKYDLYCKITGGQRIDLFGAPVHQLPDIWEELIHAGFESGHAYGKSLRTVKSCVGSTWCRFGVQDAVSYAIRIEDRYKGIRSPHKVKMAVSGCVRECAEAQSKDFGIIATDKGWNLYVCGNGGAKPQHALLFASDLDDETCIRYIDRIMIFYIRTAEPLMRTATWLNKLEGGMDYLRDVIINDSLGMCSQFEKELQLLVDTYHCEWKEVVENPELRKRFNTFINSEEADETMAFVEMRTQKKPANWKA

SEQ ID NO: 42264 - protein, 262 aa, Rhodopseudomonas palustris CGA009
MRFNGKVAVVTAAASGIGAATAARLAREGAYVYLSDIDQDALGRQAESLVDVAERISTVVADVTVPEQVSALIDGAARERGRLDILINNAGMGAFGRITEVTPEAWHRVFGICVDSIFHASRAAIPHLIKARGTIVNTASISGLFGDYGFAAYNAAKGAVINLTRNMALDYSRDGLRVNAVCPGLIATPLSLKLRDNAAVMAEYDRLIPLGRAGSPEEVAGAIAFLASDDASYITGVAFAVDGGLTARTGQPNFLGHLAPKP

SEQ ID NO: 42265 - protein, 401 aa, Campylobacter coli RM2228
MFDEIRFNTIERLPNYVFAEVNAIKMAARRAGKDIIDFSMGNPDGKTPQHIIDKLCESANKDKTSGYSTSMGIYKLRLAICNWYKRKYGVNLDPESEVVATMGSKEGFVNLARAIINPGDVAIVPAPAYPIHTQAFIIAGGNVAKMPLKYNEKFELDENKFFEDLDKTLHESIPRPKYVVVNFPHNPTTVTCEKSFYERLVATAKKERFYIISDIAYADLTYDDYKTPSILEVEGAKDVAVETYTLSKSYNMAGWRVGFTVGNKRLVAALKKIKSWFDYGMYTPIQVAATIALDGDQSCVDEIRATYDKRMHILLEAFENAGWKLHKPRASMFVWAKLPESKMYLKSLEFSKQLLQHAEVAVSPGIGFGEAGDEYVRIALIENENRIRQAARNIKKYLKEE

SEQ ID NO: 42266 - protein, 513 aa, Synechococcus sp. CC9605
MTISSVSRPYLDGKKLNKIEQNKAAKDGLLVGSEIEKFAELGWEQVDETDLQLRLKWYGMFWRPKTPGKFMLRLRVPNGALTADQLRVIGSIVERYGENGSCDITTRQNLQLRGVLLDDLPEILKRLKEAGLSTIQSGFDNPRNVTGNPIAGIDPYEIIDTRPYTQELQNHLTNNSEGNPEYSNLPRKWNTAVAGAKDNFLLHNDIVFHPVERDGVMGFGVWIGGVLSSQINAYAIPLNAWVKPEEICKMTDAVIRLWRDNGERDKRPKGRFRFYLDQVGLDEFRKKVEGLFGPLVSDPGSVFDSSPRSHYGIHPQKQEGFSYAGLHVPVGRLKASDLQDLATASLNYGNGEVRLTEEQNAIIVGISNDKIESFKSDPLLKRFPIEPKNVSAGTVSCTGNTYCGFALTNTKDTAQMVAEKLDAELNLPKHVKIQWTGCPNNCGQADMGSIGLTGTKAKNSEGVMGEGYTMTLGGSQGQNPKLGEIHQKAIPADEIEDALKAVLIEKFGATPKA

SEQ ID NO: 42267 - protein, 107 aa, Gibberella zeae PH-1
MPVCRFSRRIVRLLEDHRILYGSFNVLSDEDIRQGLKLFGDWPTFPQLWVNGELVGGLDIVREEFNTKPGYLTEYTVEDNVAFKHAKAGIHLNISLQDLLLTEVHAQ

SEQ ID NO: 42268 - protein, 342 aa, Synechocystis sp. PCC 6803
MVSERILPELNTAEISLDRETALVLYEDMVLGRFFEDKCAEMYYRGKMFGFVHLYNGQEAVSSGIIKAMRQDEDYVCSTYRDHVHALSAGVPAREVMAELFGKETGCSRGRGGSMHLFSSAHNLLGGFAFIGEGIPVALGAAFQTKYRREVLKDDGYDQVTACFFGDGTSNNGQFFECLNMAALWKLPILFVVENNKWAIGMAHERATSQPEIYKKASVFNMVGVEVDGMDVVAMHKVATEAVARARAGEGPTLIEALTYRFRGHSLADPDELRSAEEKQFWAARDPIKKFAAFMTEHELASNEELKAIDKRIQEVIDDALAFAESSPEPNPEDLRKYIFAD

SEQ ID NO: 42269 - protein, 254 aa, Triticum aestivum
  misc_feature (97)..(97): Xaa can be any naturally occurring amino acid
  misc_feature (150)..(150): Xaa can be any naturally occurring amino acid
  misc_feature (215)..(215): Xaa can be any naturally occurring amino acid
  unsure (1)..(254): unsure at all Xaa locations
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHXSERRSLMGESSEFVGEKVAYALAQGLKVIACVGETLEQREAGSTMAVVAEQTXAIADKIKDWTNVVVAYEPVWAIGTGKVASPAQAQEVHANLRDWLKTNVSPEVAESTRIIYGGSVXGASCKELAAQPDVDGFLVGGASLKPEFIDIINAAAVKSA

SEQ ID NO: 42270 - protein, 374 aa, Mortonia greggii
ALSIAGAVQSQKLAVRAISQLQSLPGGDIKLLCDAVVENVRNLTGYDRVMVYKFHEDEHGEVVAESKRPDLEPYIGLHYPATDIPQASRFLFKQNRVRMIVDCHSTPVSVIQDDGLMQPLCLVGSTLRAPHGCHAQYMANMGSIASLAMAVIINGNDEDGIGGRNTTRLWGLVVCHHTSARCIPFPLRYACEFLMQAFGLQLNMELQLASQLLEKHVLKTQTLLCDMLLRDSPTGIVTQSPSIMDLVKCDGAALYHQGKYYPLGVTPTEAQIKDIVEWLLAFHGESTGLSTDSLADAGYPGAALLGDAVCGMAVAYITDRDFLFWFRSNTAKEIKWGGAKHHPEDKDDGQRMHPRSSFKAFLEVVKSRSLPWEN

SEQ ID NO: 42271 - protein, 701 aa, Prochlorococcus marinus subsp. marinus str. CCMP1375
MYLMLTVEGKNSVGKINLGTAWPLGSSITKRGVNFSVAAPNASYVELLLFNNANDSTPKEIVKLNSENKSGDYWHIEVEGITIGCNYAYRVYGKGDLGDANKHCGKILLDPCAREISGWDEFQRISSKEEIPNLSNCLKGIVSERDEFNFNAHPRPRHPWHKTIIYELHVGGFTRSVSSGLKSGNKGTFLGLIEKIPYLKDLGITTIELLPVFAFDPSDAPYGVENFWGYSPVNWFTPHQSFISKVDNLSPRDQFRKLVATCHDNGIEIILDVVYNHTTEGNENGPVISWKGFGESIYYHKNEQDEFLDVTGCGNTIAANQPIVRQLILESIKCWSQELGVDGFRFDLGVALSRGKDLAPLDSPPIFEEIESDPLFSELKLISEPWDCGGLYRLSDFPAKRVSTWNGHFRDDLRRFWKGDKDSTWALKDRLLGSPSIYKNNKNSVEKSINFITSHDGFTLIDLVSFDKKHNLSNGESNRDGENHNNSWNHGVEGPTTNQKLNMIRQRQQRNLLSSLLLSPGVPMLLMGDEVGRSQGGNNNAWCQNTSIGWMIWNTGSCDNELKDFVKNLISIRKNLSEFFSPETTPISHPSISQNNKNHWVQWHGVKTNTPDWGSWSHTISYSINKGDQGSLMWLGLNAYDQSMKFQLPHPISAWMKLIDTTSNMNDGLNSKEISNQNEIHLESRSLVLLASNEYRKSLSV

SEQ ID NO: 42272 - protein, 338 aa, Arabidopsis thaliana
MADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYDEIKKAIKEESEGKLKGILGYTEDDVVSTDFVGDNRSSIFDAKAGIALSDKFVKLVSWYDNEWGYSSRVVDLIVHMSKA

SEQ ID NO: 42273 - protein, 220 aa, Xylella fastidiosa Ann-1
MHSLEHLLQNNRNWCQRINQEDPEFFARLSKQQSPEYLWIGCSDSRVPANQIIDMAPGEVFVHRNVANVVVHTDLNCLSVIQFAIDVLKVKHILVVGHYGCGGVLASLTRARLGLVDNWIRHVTDVAEKHNPYLETLGALADQHARLCELNVLEQVMNVCSTSIVRDAWSRTQPLSVHGWVYSLSNGLVHDLGIDVDRFEMLPSCYADALARIQADRVVR

SEQ ID NO: 42274 - protein, 376 aa, Crocosphaera watsonii WH 8501
MPGDYYDILGVDRNANKEDLKKAYRRLARQYHPDVNKEAGAEERFKEINRAYEVLSEPETRSRYDQFGEAGVSGSGGFNYGDMGDMGGFADIFETIFSGFGGGMGTGGTRRRTGPTKGDDLRLDLKLDFREAVFGGEKEIRIPHLETCQVCKGDGAKPGTGAKTCPTCNGQGQVRRATRTPFGSFAQVTTCPTCNGQGQIIEEKCEVCNGAGRRQVTEKVKITIPGGVDDGTRLRVSRKGDAGLRGGTPGDLYVYLYVEADKVFTRDKMNILSEITISYLQAILGCTVAVDTVDGEQELSIPAGTQPNTILTLENLGVPKLGNDAIRGDHLITVKVDIPTRINAEERDLLEKLAHIKGQSHGKGGLEGFLGSLFHK

SEQ ID NO: 42275 - protein, 397 aa, Rickettsiella grylli
MVELLYGVLNLSFWGYVLALLLLTHITIVSVTVYLHRAQAHRALELHPAVCHFFRFWIWLTTGMETKKWVSIHRKHHAKCETEEDPHSPQTRGIKKVFLEGAELYREEANNPDTMERYGQGTPDDWLERHIYTKDSAAGIALMFVIDLVLFGVPGVTIWALQMAWIPFFAAGVVNGIGHYWGYRNFECPDAARNIIPLGAFIGGEELHNNHHTFPTSAKFSVKWWEFDLGWVYIRLLQFLGLSKVKRVSPKLSNVPGKSQVDLDTLTALITNRFQVLARYSREVLLPVLHEETEKANTTTGKALLKRSKIALIRTESLLNEEGKQQIATVINNHHVLALVYQYRLKLQAIWGRTTATQRELLEALQDWCKQAEATGVYALRRFAVRLAGFSTQRKLN

SEQ ID NO: 42276 - protein, 347 aa, Arabidopsis thaliana
MVRLDLPWDLVDEILSRLPATSLGRLRFTCKRWNALFKDPEFITKQFHKAAKQDLVLMLSNFGVYSMSTNLKEIPNNIEIAQVFHCNGLLLCSTEEGNKTKLVVVNPCTGQTRWIEPRTDYNYNHDIALGYGNNSTKKSYDSYKILRITYGCKLVEIFELKSNSWRVLSKVHPNVEKHYYGGVSFKGNTYWLSYTKFNILSFDFTTETFRSVPLPFLYQDGFVTLALSVVREEQLLLLRSRFDMGQVGIWMCNKIDTETVLSWSKSFTLEFDSLRDLPVMSILRIFIEEDKKVIVVDCDDRWKENMIYIVGKNGFKKLSYEKDRSNLWRLPFFFSYVPSLVGLYPPM

SEQ ID NO: 42277 - protein, 157 aa, Brassica napus
  misc_feature (2)..(2): Xaa can be any naturally occurring amino acid
  misc_feature (8)..(8): Xaa can be any naturally occurring amino acid
  misc_feature (10)..(11): Xaa can be any naturally occurring amino acid
  misc_feature (18)..(18): Xaa can be any naturally occurring amino acid
  misc_feature (26)..(26): Xaa can be any naturally occurring amino acid
  misc_feature (29)..(30): Xaa can be any naturally occurring amino acid
  misc_feature (36)..(36): Xaa can be any naturally occurring amino acid
  misc_feature (44)..(44): Xaa can be any naturally occurring amino acid
  misc_feature (48)..(48): Xaa can be any naturally occurring amino acid
  misc_feature (50)..(50): Xaa can be any naturally occurring amino acid
  misc_feature (52)..(52): Xaa can be any naturally occurring amino acid
  misc_feature (55)..(55): Xaa can be any naturally occurring amino acid
  misc_feature (57)..(57): Xaa can be any naturally occurring amino acid
  misc_feature (64)..(64): Xaa can be any naturally occurring amino acid
  misc_feature (67)..(67): Xaa can be any naturally occurring amino acid
  misc_feature (70)..(70): Xaa can be any naturally occurring amino acid
  misc_feature (73)..(74): Xaa can be any naturally occurring amino acid
  misc_feature (92)..(92): Xaa can be any naturally occurring amino acid
  misc_feature (104)..(104): Xaa can be any naturally occurring amino acid
  misc_feature (106)..(106): Xaa can be any naturally occurring amino acid
  misc_feature (112)..(112): Xaa can be any naturally occurring amino acid
  misc_feature (114)..(114): Xaa can be any naturally occurring amino acid
  misc_feature (119)..(119): Xaa can be any naturally occurring amino acid
  misc_feature (124)..(125): Xaa can be any naturally occurring amino acid
  misc_feature (129)..(130): Xaa can be any naturally occurring amino acid
  misc_feature (132)..(134): Xaa can be any naturally occurring amino acid
  misc_feature (136)..(141): Xaa can be any naturally occurring amino acid
  misc_feature (143)..(156): Xaa can be any naturally occurring amino acid
  unsure (1)..(157): unsure at all Xaa locations
MXSSMLSXAXXVTSPAQXTMVAPFTXLKXXAAFPVXRKGNNEIXSIAXNXGXVSXMXVCPPVRXKKXETXSYXXDLTEVELAKEVDYLLRNXWIPCVEFEWEHXFXVYRGHXSXPGYYXGRYWXXRKPXXFXXXDXXXXXXGXXXXXXXXXXXXXXK

SEQ ID NO: 42278 - protein, 503 aa, Rhodopseudomonas palustris CGA009
MINIATRINPAIAPAVSEVISQLQARHLIGNTLVPSVGGATLDVIDPATGQVIGKAPAASGDDVARAVEAASAAFPGWAATPARQRGKLIAAAASAIAERSDVIATVLALETGKAIRTECRGEVATAIDITTMYAGLASELKGETLPFDPQILTYTSREPLGVVAAILPWNVPLVLMMLKIAPALVAGNTVVVKASEEAPYATIEMARLMARLLPDGVLNVICGTGRDCGAALVEHPAVAKVTFTGSQAVGELIYQMAAKKIIPVSLELGGKSPMIVYPDADMARVVAGAIAGMRFTRQGQSCTAASRIYVHTTLIDAFVAALREAVSKLKIGDPLDEATDIGTVISPRQKAKVESYIDLGARTAGAKVDRCGELPGAAHLKDGLFLQPTIITGVPEDSPLMREEIFGPVVCVQPWDDEDDVIARANDSDFGLAATVWTNDLRSALRTVQRLDAGYVQVNQNLTIQPNLSYGGFRKSGLGKEASLEAMLEHFTKKKTVVIDMR

SEQ ID NO: 42279 - protein, 165 aa, Rickettsiella grylli
MNILRKIIQWIKTFTLWELFKGLGVTGRYFFKKKVTLQFPEEETPRSVRFRGLHALRRYPNGEERCIACKLCEAVCPALAITIEAEPREDGSRRTTLYEIDLFKCIYCGFCEESCPVDAIVETNIPHYHFENRGEQIMTKQKLLAIGDRYEKQIAKERAEDAPYR

SEQ ID NO: 42280 - protein, 473 aa, Candidatus Blochmannia floridanus
MNVDYFISFINKNKVKFIDLRFTDIMGKEQHFTIPQSQIDNHFFENGKVFDGSSMVGWKNVHESDMILIPDLTNDHIIVDPFYQDTTVILRCDVLDPHSMQNYDKDPRYISKKSEKFLQDSGIADFAMFGPELEFFVFDDVRFKTSMSGCHVMIDDPEASWNSDKVYFYGNKGHRPKIKGGYSPVPPIDSSQNLRSMMSIMMEKMGLIVETHHHEVATAGQNEIITRFNSLTRKADEVQIYKYIVHNVSNKFGKTATFMPKPIIKDNGSGMHCHISLYKNKVNLFSGDQYGNLSEIALFYIGGILKHTKALNAITNPTTNSYKRLIPGYEAPTFLTYSLSNRSSAIRIPAIINNNPNLCRIEVRFPDPSANPYLAFPALLMAGIDGIINEIHPGNPVNKNLYTLSDLEKEHTLYTSQSLNESLQYLSEDYEFLIRNNVFSKNFIDSYILIHKKMDSLVRSVPHPMEFELYYSI

SEQ ID NO: 42281 - protein, 213 aa, Triticum aestivum
QRPVIVNIRATGICGSDVHYWTHGRIGHFVCEKPMVLGHESSGVVVSVADDVTSLKVGDRVALEPGVPCRVCEMCKLGMYNLCPDMAFAATPPYDGTLCNYYKHAADFCYKLPDHISLEEGALIEPLSVGIHASRRGGVKLSDRVFVFGAGPVGLLTAAAAKAAGASHVTIADRDPARLAFAKEYCADETIHLTGARRLDQDSNDFAKEEAEK

SEQ ID NO: 42282 - protein, 545 aa, Candidatus Blochmannia floridanus
MIFKNINRFCYIIRIILLYGLSDCIPTNRLIFPLNIGNQFLLKFFNKHSHLSLGERFRLALQELGPIWIKFGQMLSTRRDILSNSITNQLVMLQDQVKPFDGALAKLYIEQSIGNPLEKWFEDFQEIPLASASISQVHSAKLKKNGQNIIIKIIRPGIIPIIKTDINLMYKLSKWAYKLFPKRQQFKFSKIVLEYKKILFNELNLLKETANTIKLKRNFKSSNILYIPEVYVDFCRENIMVMERIYGIPIYETEKLKKQGIDMKLLAERGVEIFFTQVFRDSFFHGDMHPGNIFINYKNPQNPQYISIDCGIMGSLNKKDKYYLASNFIAFFNRDYRKIAELHLDSGWIPIDTNIEDFEYEIRTVFEPIFEKPLIDIPFSSVLLHLFNIARYFQMEIQPQLILLQKTLLYIEGIVRQLYPHLNLWQSAKPFLENWMQEQLQFSKIIHILKDKIPCWINKFPELPLLLSNELKYSFEIKKNINILTQELRIQRTRNAQALFLFGIGLILIISSIFCFMQFKKIETLPIYLCIFGIFIWIIGWKRIS

SEQ ID NO: 42283 - protein, 179 aa, Capsicum annuum
GVEGSIWQLAKAYAAVNDSGYHQLISHWLNTHAVIEPFVIATNRQLSVLHPIFKLLQPHFRDTMYINALARQILINAGGILERTVFPAKYAMEMSSIVYRNWVFTEQGLPADLLKRGVAVPDSSQPYGLKLLIEDYPYAVDGLEIWEAIEAWVDDYCSFYYSTDDMIRGDSELQAWWKE

SEQ ID NO: 42284 - protein, 759 aa, Rhodopseudomonas palustris CGA009
MDEADSGGIVTARNVDLSSCDRELVQYPEAIQPHGAMLTVDEQSDRVLHASANCAAFIGKPPEAVIGAPIAAVLGAGWHELLGSLHRMPLDSGPVNIARESFLGSDQGWHLFAHRCGGLIILEFEKAEPEAAGTTSNLYSEVRADLAALQATEGVQAFFDLAVERIRAFTGYDRVMAYRFAEDGSGQVIAEARRDDLEPYLGLHYPATDIPAPARRLFALSWVRHLPDVGYTPVPLLAAKSPLVTGPVDMSFASLRSVSVMYTGYLKNMGVQSTLVMPLVKEGRLWGLISAMHHAAPRHISHQMRMAAEFLAHTLSLLMSAKEDAEQFERSSARKAAAEALTRLLDSEADIGAALHAAGALDLLSALIDAGGVVVQTGDEVATRGEAPAAAPLHELTSWLRERARPVFATDRLPNLDPAAQAVASQASGVLALRPLPDQPMLIAWLRPEQIEDVQWAGDPRKPVEISDADGMQRLRPRNSFALWKESVQGRAVPWRDDEKDAATRLAAAIAEIAAARKGRIERINRALDASHSELSRYTDVASAELKEHLRGIHHLTTSLRRRQGEVLDEEGRQQVATILKLTQRMDALVDALLDRSRGGSEAASETVDLEAVVDDALAPFARRIAEDRIEVRRPMRLGTAQGHREWIGEVFTNLIGNAIRYNDKPERWIEIGVEAGSPPRYYVRDNGIGIADTDQQLVFQMFHRVDQSEQKAEGAGVGLAMTRRIVAHHGGRIWVQSRLGEGATFYFTLAPDEERHDA

SEQ ID NO: 42285 - protein, 374 aa, Mortonia greggii
ALSIAGAVQSQKLAVRAISQLQSLPGGDIKLLCDAVVENVRNLTGYDRVMVYKFHEDGHGEAVAESKRPDLEPYIGLHYPATDIPQASRFLFKQNRVRMIVDCHSTPVSVIQDDGLMQPLCLVGSTLRAPHGCHAQYMANMGSIASLAMAVIINGNDEDGIGGRNTTRLWGLVVCHHTSARSIPFPLRYACEFLMQAFGLPLNMELQLASQLLEKHVLKTQTLLCDMLLRDSPTGIVTQSPSIMDLVKCDGAALYHQGKYYPLGVTPTEAQIKDIVEWLLAFHGESTGLSTDSLADAGYPGAALLGDAVCGMAVAYITDRDFLFWFRSNTAKEIKWGGAKHHPEDKDDGQRMHPRSSFKAFLEVVKSRSLPWEN

SEQ ID NO: 42286 - protein, 149 aa, Synechocystis sp. PCC 6803
MERTFIMIKPDGVQRQLIGEIVGRFEKKGFKLVAMKVMTVSQELAEKHYEALNDKPFFSGLVNFICSSPVVAMVWEGNSIVSTSRQMIGATDPHAAAPGTIRGDYGVSVGRNIIHGSDAIETAKREISLWFKDEEVNEWDATLNPWLYE

SEQ ID NO: 42287 - protein, 374 aa, Plagiopteron suaveolens
ALSIAGAVQSQKLAVRAISQLQSLPGGDIKLLCDTVVQSVRDLTGYDRVMVYKFHEDEHGEVIAESKRPDLEPYIGLHYPATDIPQASRFLFKQNRVRIIVDCHASPVSVIQDDGLMQPLCLVGSTLRAPHGCHAQYMDNMGSIASLAMAVIINGNDEDGTGGRNPTRLWGLVVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIKDIVEWLLAFHGDSTGLSTDSLADAGYPGATLLGDAVCGMTVAYITNRDFLFWFRSHTAKEIKWGGAKHHPEDKDDGQRMHPRSSFKAFLEVVKSRSLPWEN

SEQ ID NO: 42288 - protein, 534 aa, Arabidopsis thaliana
MASRRVSSLLSRSFMSSSRSIFSLRGMNRGAQRYSNLAAAVENTITPPVKVEHTQLLIGGRFVDAVSGKTFPTLDPRNGEVIAQVSEGDAEDVNRAVAAARKAFDEGPWPKMTAYERSKILFRFADLIEKHNDEIAALETWDNGKPYEQSAQIEVPMLARVFRYYAGWADKIHGMTMPGDGPHHVQTLHEPIGVAGQIIPWNFPLLMLSWKLGPALACGNTVVLKTAEQTPLSALLVGKLLHEAGLPDGVVNIVSGFGATAGAAIASHMDVDKVAFTGSTDVGKIILELASKSNLKAVTLELGGKSPFIVCEDADVDQAVELAHFALFFNQGQCCCAGSRTFVHERVYDEFVEKAKARALKRNVGDPFKSGIEQGPQVDSEQFNKILKYIKHGVEAGATLQAGGDRLGSKGYYIQPTVFSDVKDDMLIATDEIFGPVQTILKFKDLDEVIARANNSRYGLAAGVFTQNLDTAHRLMRALRVGTVWINCFDVLDASIPFGGYKMSGIGREKGIYSLNNYLQVKAVVTSLKNPAWL

SEQ ID NO: 42289 - protein, 706 aa, Magnetospirillum magnetotacticum MS-1
MTSMTCGMVYGAYGMARHHGRRWIAFGLSALCYGLGLSLIVNLGSFPPLFTVVGGNLLLALAAVALHACCAQLSERALPPVFYLAYVAAYLGGVSYFLYLDDSIGGRIVWASLIRVPLFLHAALMIHRHRQTERSIGLVVLETVLVGWACLLVGRPLAVSVVYPIREFLSLEGFLAFYYVMAGSAYVAMLIALMLIDVDRLAALLGREVSRQAEALETQISRQTQAQTELRSILDNMPDIFYRTDAQGRLLMLSRSVESLLGYKPEEVLGQDSAFFHGSDDSRPMLVAALEAAGGSILDYELRLRHKDGHTLWASTSSRFYYDAEGNRAGTEGVVRLIEERKQAEFHIRENQALIQAMLDASSDAIMLFRPDGTLLAVNGVMAARFGRKASELTGSCLWDMFPPSVAKAREVAVTRVVETGEAIHYLDRRGELYLDNSIYPVPGVDGVPDKVAVYSRDITAQTLAEQRLAIQMTELERSNAELEQFAYVASHDLREPLRMISSYLSLLERRYGPKLEGDGLEFLAFARDGAKRMDRLVLDLLDFSRIERKGSPIIAMEAEPVLRQALRHLAPSMDECGAQVEMAEDGGAVRVMGDPEQVIRLFQNLVGNAVKYRAPGRVPRVSVSWRRDGGEWECTIADNGIGIDPQYFERIFGIFQRLHTPDRYTGTGIGLAICKKIVERHSGRIWVDSTPGQGTAFHFTLPAAD

SEQ ID NO: 42290 - protein, 374 aa, Plagiopteron suaveolens
ALSIAGAVQSQKLAVRAISQLQSLPGGDIKLLCDTVVQSVRDLTGYDRVMVYKFHEDEHGEVIAESKRPDLEPYIGLHYPATDIPQASRFLFKQNRVRIIVDCHASPVSVIQDDGLMQPLCLVGSTLRAPHGCHAQYMDNMGSIASLAMAVIINGNDEDGTGGRNPTRLWGLVGWHHPSARCIPFPLRYACEFLMQAFGLQLNMELQLAAQLLEKHVLKTQTLLCDMLLRESPTGIVTQSPSIMDLVKCDGAALYYQANYYPLGVTPTEAQIKDIVEWLLAFHGDSTGLSTDSLADAGYPGATLLGDAVCGMAVAYITNRDFLFWFRSHTAKEIKWGGAKHHPEDKDDGQRMHPRSSFKAFLEEVKSRSLPWEN

SEQ ID NO: 42291 - protein, 365 aa, Pleurostylia opposita
VQSQKLAVRAISQLQSLPGGDIKLLCDTVVESVRDLTGYDRVMVYKFHEDEHGEVVAESKRPDLEPYIGLHYPATDIPQASRFLFKQNRVRIIVDCHASPVRVLQDDGLMQPLCLVGSTLRAPHGCHAQYMENMGSIASLAMAVIINGNDEEAIDGKNPTRLWGLVVCHHTSARCIPFPLRYACEFLMQAFGLQLNMELQLAAQVLEKHVLKTQTLLCDMLLRDSPIGIVTQSPSIMDLVKCDGAALYYRGNYYPLGVTPTEAQIKDIEEWLLAFHGDSSGLSTDSLADAGYPGAALLGDAVCGMAVAYITNRDFLFWFRSHTAKEIKWGGAKHHPEDKDDGQRMHPRSSFKAFLEVVKSRSLPW

SEQ ID NO: 42292 - protein, 136 aa, Solanum lycopersicum
DKEDTGGEDAHFICSDEQAIGVADGVGGWADLGIDAGKYARELMSNSVAAIQDEPKGSVDPARVLDKAYTCTKAKGSSTACIIALTDQGLHAINLGDSGFIVVRDGSTVFRSPVQQHDFNFTYQLESGNAGDLPSS

SEQ ID NO: 42293 - protein, 447 aa, Oryza sativa (indica cultivar-group)
MGGGVTERLPEGSSEPLLPTKREGGGGGEFAGAVFNLSTTIVGAGIMALPATMKVLGLAPGLVAILLAALLTDASIELLVRSSRAAGAPSYGAVMGDAFGWWGRRLLQVCVVVNNIGVMIVYMIIIGDVLSGTSSGGEHHYGVLEGWFGPQWWNGRFFVLLVTTLVVFTPLACLKRVDSLSYTSAISVALAVVFVIITAGIAIVKLIKGQIPMPKLFPDVPDLASIWELFTAVPVLVTAYVCHYNVHPIHNELKDPSQIKPIVHTSLVLCSTVYITTSFFGYLLFGESTLSDVLANFDSNLGIPYSQMLNDAVRVSYAVHLMLVFPMIFHALRLNLDGLLFSSSSPLSSDNRRFSVMTAVLLLVIFLSANFIPSIWDAFQFTGATAAVCIAFIFPAAITLRDPHSIAKKWDKILSIFMIVLAIVSNVVAVYSDAYSMFHRKSSPSIA

SEQ ID NO: 42294 - protein, 374 aa, Pristimera andina
ALSIAGAVQSQKLAVRAISQLQSLPGGDIKLLCDTAVESVRDLTGYDRVMVYKFHEDEHGEVVAESKRPDLEPYIGLHYPATDIPQASRFLFKQNRVRIIVDCHASPVNVIQDGGLMQPLCLVGSTLRAPHGCHAQYMENMGSIASLAMAVVINGNDEDGIGGRNPTRLWGLVVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIKDIVEWLLVFHGDSTGLSTDSLADAGYPGATLLGDAVCGMAVAYITNRDFLFWFRSHTAKEIKWGGAKHHPEDKDDGLRMHPRSSFKAFLEVVKSRSLPWEN

SEQ ID NO: 42295 - protein, 135 aa, Solanum melongena
KEDTGGEDAHFICSDEQAVGVADGVGGWADLGIDAGKYARELMSNSVTAIQDEPKGSVDPARVLNKAYACTKAKGSSTACIIALTDQGLHAINLGDSGFIVVRDGCTVFRSPVQQHDFNFTYQLESDNAGDLPSS

SEQ ID NO: 42296 - protein, 434 aa, Mycobacterium smegmatis str. MC2 155
MTSDLATLAEQSGTKFILALFVDLRGKPCAKLVPVEAIDMLATEGVGFAGYAVGAMGQEPKDPDLMALPDPASFTPIPFIKEGLALVHCDPYVEGKPWPYAPRVILKNLIQQAADAGFEPWVGAEVEYFLLRRNADGSLVTADAADTAAQPCYDARGLTRMYDHLTAISTAMNSLGWSNYANDHEDGNGQFEQNFEFADALTTADRVITLRYLLSMIAAERGMVATFMPKPFADRTGSGLHFHLSLTSGGNPVFPSETDERGLGLSDTAYAFLAGILDHACALQSVVAPTVNSYKRTGATSTASGASWAPRLPSYGGNDRTHYIRVPDNQRIEMRGGDGSANPYLAVAAALGAGLDGIKRSIDPGPVGSGGTTALPPTLLHAVDALEADPVVTGVLDAAGEGVATYFANLKREEFFTYHGTVTPWEVDTYLTAF

SEQ ID NO: 42297 - protein, 408 aa, Pseudomonas sp. B4
MIDTIAIIGAGLAGSTAARALRAQGYEGRIHLLGDESHQAYDRTTLSKTVLAGEQPEPPAILDSAWYASAHVDVQLGRRVSCLDLANRQIQFESGAPLAYDRLLLATGARARRMAIRGGDLAGIHTLRDLADSQALRQALQPGQSLVIVGGGLIGCEVATTARKLSVHVTILEAGDELLVRVLGHRTGAWCRAELERMGVRVERNAQAARFEGQGQVRAVICADGRRGPADVVLVSIGAEPADELARAAGIACARGVLVDATGATSCPEVFAAGDVAAWPLRQGGQRSLETYLNSQMEAEIAASAMLSQPVPAPQVPTSWTEIAGHRIQMIGDAEGPGEIVVRGDAQSGQPIVLLRLLDGCVEAATAINATREFSVATRLVGTRVSVSAEQLQDVGSNLRDLLKAKPN

SEQ ID NO: 42298 - protein, 402 aa, delta proteobacterium MLMS-1
MAGPIELAARVKEIKASPTLAVDAKAKALKAQGADVLNFSVGEPDFDTPPHVCEAGKAAIDEGFTRYTPVPGILPLRQAVCDRQAADHGRHYQPDEIQICCGGKHGLYNMAQAMFGPGDEVLIPAPYWVSYPPIVQLAGATPVIVPLDEKSAFDLDPAILADYTSPRTRGIILNSPSNPTGSVLSARALTAIAAMALEQGWVVISDDIYDTIVYGTEKLPHILDLEPKLRDQTLILNGVSKSFAMTGWRIGYTAGPQHVIAAMNKIQSQSTSNPSSIAQKAALAALTGPQDFPTTMRDAFVPRLDFMVGALNAMAGISCVRSRGAFYVFPNMSAYYGRKTPAGTSIDGSLALADYLLEDALLATVPGVAFGADDFIRFSFATSLAVLEEGMERLAAALAKLN

SEQ ID NO: 42299 - protein, 375 aa, Nicotiana tabacum
MEVISTNTNGSTIFKNGAIPMNGHQNGTSEHLNGYQNGTSKHQNGHQNGTFEHRNGHQNGTSEQQNGTISHDNGNELLGSSDSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPSIEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTAPTYPTGVIGYMLCSTEGPEVDFKNPVNPIDKETTQVKSKLGPLKFYNSDIHKAAFILPSFARSMIES

SEQ ID NO: 42300 - protein, 169 aa, Triticum aestivum
LLPTLMDEWQEDRESLVDLFGCVRDDWLENDLSGWIGANRFYPGTADALKLSSSELYIVTTKQSRFTGALLKELAGVDFPSERIYGLGSGPKVKVLQQLQEMPQHQGLTLHFVEDRLATLKNVIKEPALDKWNLYLVKWGYNTQKEREEAGALPRIQLIDLPDFSKQLK

SEQ ID NO: 42301 - protein, 637 aa, Hyphomonas neptunium ATCC 15444
MTDLRRTLDVITIGRAGVDLYGQQVGGNLEDVHSFAKYLGGCPANIAVGASRLGLRSGIITRVGSDHMGRFLQTEFQREGVNTDGIVTDKERLTALVILGIQDEDTFPLIFYRENCADMALCEADIDTSFIAQSRSILITGTHLSTEQTRATSRAAITAAKASNCSIILDIDYRPVLWGLTSRELGEERFVSDAKVTATLQEFIPACDLIVGTEEELHILGGTTDTIAAMHAIRALSDAVIVCKRGALGCSVFPETIPQTLDQGISGQSFKVEVFNVLGAGDAFMSGFLSGWLHDKPLEECCRLGNACGAIVVSRHGCAPAIPTAEELAWFLENGSPHLALRKDAALEHIHWTTTRSPRERDLAVFAIDHRSQLEAISREAAAPLEKISEFKSLALSALQMMDVSDVDLGILLDGRYGSRALATASGLPIWVGRAVELPGSRPLDFDSQSTVTGEMLEWPRSQVAKCLCFYHPDDPSEIKNIQERRIQEAFKASRETQREFLLEIICSQNGALADTTVSSAMRRIYELGVFPDWWKLEATASAQSWVETSRVIDEMDPRCRGILLLGLAAPAEDVVACFKVAAAFPLIKGFAVGRTIFQEPARQWFKGEIDDGEAVFALRRNFSQLIDGWRQSRQAP

SEQ ID NO: 42302 - protein, 347 aa, Pisum sativum
MLLKNLIFQKCFFGQLVLVASWHIHNIVNSLKEGLTPLKDSSYMTNGYLETTIDWIPGIKEIRLKDIPSFIRTTQPNDLMVHFLLGECERAQKASAIILNTFDDLEHNVLEAFSSLNFPPVYSIGPLHLLLKEVTDKELNSFGSNLWKEEPECLEWLNSKEPNSVVYVNLGSITVMTNEQMIEFAWGLANSKIPFLWVIRPDLVAGENSVLPQEFLEETKNRGMLSSWCPQEEVLDHSAIGGFLTHSGWNSTLESVCGGVPMICWPFFAEQQTNCRFCCHEWGIGLEIEDAKRDKIESLVKEMVEGEKGKEMKEKALEWKKLAPNAASGPNGSSFMNLEKMFRDVLL

SEQ ID NO: 42303 - protein, 558 aa, Candidatus Blochmannia floridanus
MKNINPTKTKSWKSLKKHFLNINTTHILDLFKQNKYRFLSFSTIFNNEILLDYSKNLITEETINKLIDLAKECDLPGAIKSMFQGAKINRSENRAVLHTALRNRKNIPILVDGHDIMPNINTVLEKMKIFCQNIIQGYWKGYTNKNITDIVNIGIGGSNLGPHMVTEALTPYKNHLNIHFVSNIDGTHLFEVLKKINPETTLFLITSKTFTTQETMTNAFSARNWFVQKITKSSSFNHYEQHISKHFIALSANPVEVKKFGINPSTNMFEFWEWVGGRYSLWSSVGLSIMLSLGSNHFESLLDGAYAMDMHFKNTPLNKNIPVILALIGIWYNNFFLSETEAIFPYDQYMHRFAAYIQQSNMESNGKCVDRNGYPINYQTGPIVWGESGTNGQHSFFQLIHQGTKMIPCDFIAPVLSHHPIFDHHDKLIANFLAQTKALAFGKKLEEITQEYITKKQSYIYDLNILPFKVFKGNNPSNSILIKKITPYTLGALIALYEHKIFTQGVIFNIYTFDQWGVELGKQLADDIYSILKQTNINPQYDSSTNGLINYYKYWSQA

SEQ ID NO: 42304 - protein, 277 aa, Polaromonas sp. JS666
MKQQPASVQPVSRELRAWLLAQSAQGHSRAALFQAMLDAGWQHATACRALRLTPQEQAAFTALAQPAEGASMSMDAGDRWVDVLQRLQLPDLVVFGNLLSDSECEALMEVAQPRLARSLTVNIKTGGEERNRDRTSQGMFFARGENPLVQRVEARIARLVGWPVDRGEGLQVLRYRQGAQYKPHYDYFDPAEPGTPAILQRGGQRVATLIMYLNEPEQGGATVFPDIGLQVTPRRGTAVFFSYPAANPASLTRHGGEPVKAGEKWIATKWLREREFV

SEQ ID NO: 42305 - protein, 289 aa, Synechococcus sp. CC9605
MINGGTSLVGLLGNPVRHSLSPVMQNAALESMGLNWRYLALPCDSESLDQVMKGLRAVGCQGLNVTIPHKKDIAALCEERSPLAQRLGAVNTLIPGEGGGWFGTNTDVEGFLAPLGANDTWAERHAVVIGCGGSARAVVAGLQTLDLSSITVVGRRSEALQAFITDLQQDKAPLTPCLNNAVQLNDAIARAALVVNTTPVGMAQHGDPEAMPLGADIWCRLSSEAVLYDLIYTPRPTSWLAAGQQRGHRCIDGLEMLVQQGAASLRLWSGRDDVPVEAMRSAAATALAT

SEQ ID NO: 42306 - protein, 116 aa, Haemophilus somnus 2336
MSNIIKQIEQEQLKQNVPSFRPGDTLEVKVWVVEGSKRRLQAFEGVVIAIRHRGLHSAFTLRKISNGVGVERVFQTHSPIIDSITVKRKGAVRKAKLYYLRERSGKSARIKERLGN

SEQ ID NO: 42307 - protein, 457 aa, Alcaligenes faecalis
MSRFEQIQSREAGLHKRLNARQMSMIAIGGAIGTGLFLGSKFAIGFAGPGVVLSYVIGGFIALVLMGCLAEMTVEHPTSGSFGAYAEFYIHPLAGFLVRYSYWACIVLAVGTEVTAVADYMKFWFPEVSPWIWIVFFSAVLIAVNAYSVKAFGSVEYWFALIKVFAIIAFIVLAIGMLTGYYQPAQVQENLLGQGGFMPNGWYGVWVGVIISIFSYLSIEMIAVAAGEAENPEQAVRQAFKATIWRLIIFYLLSLSLIVMLVPWQVLIADGTSSPFITVMQSVGIPYADSILNFIVIIAALSAMNSMLYISTRMMFSLSRAGDAPLVLGKVARNGVPLNALALSASGVGVAAVVYAYNPETAFPVMIALSMFGALFTWGMIFLTHLFFRRRVAQEGVQLRFRMPAYPIGTLLGLIGIVAILITTWFINIFHYTLLFGVPFLLTLIVIYFVRSKSRVA

SEQ ID NO: 42308 - protein, 374 aa, Pristimera andina
ALSIAGAVQSQKLAVRAISRLQSLPGGDIKLLCDTAVESVRDLTGYDRVMVYKFHEDEHGEVVAGSKRPDLEPYIGLHYPATDIPQASRFLFKQNRVRIIVDCHASPVNVIQDDGLMQPLCLVGSTLRAPHGCHAQYMENMGSIASLAMAVVINGNDEDGIGGRNPTRLWGLVVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIKDIVEWLLVFHGDSTGLSTDSLADAGYPGATLLGDAVCGMAVAYITNRDFLFWFRSHTAKEIKWGGAKHHPEDKDDGLRMHPRSSFKAFLEVVKSRSLPWEN

SEQ ID NO: 42309 - protein, 289 aa, Glycine max
CFATLETVLFFGGGRGGRGRAHSGRGPSGALNGGRMAGAVSSRRMAGASNADARAGAVRRGPLMVNTRPSSYAIAKSIRRARPFPWQHDLFEDSLRAAGIQGVEVGTKLYVSNLDHGVTNEDIRELFSELGELKRFAVHYDKNGHPSGSAEVVYTRRSDAFAALKRYNNVLLDGKPMKIEIVGSNSELPISARVNVTGVNGRRKRTVVMTPRGGQAGGGPAMPTRGAGWGRRGGPRSGSGRGGAGGRGRGRGRGGAGGRGRGRKDAVEKSAEELDKELETYHAEAMNIS

SEQ ID NO: 42310 - protein, 139 aa, Petunia axillaris subsp. parodii
HPDKEDTGGEDAHFICSDEQAIGVADGVGGWADLGIDAGKYARELMSNSVAAIQDEPKGSVDPARVLDKAYTCTKAKGSSTACIIALTDQGLHAINLGDSGFIVVRDGSTVFRSPVQQHDFNFTYQLESGNAGDLPSSG

SEQ ID NO: 42311 - protein, 809 aa, Pasteurella multocida subsp. multocida str. Pm70
MTNHWVDIKNADLVIVMGGNAAEAHPVGFRWAIEAKKQNGAKLMVVDPRFNRTAAVADIYMPLRPGTDIAFLSGVIRYLLKNDKIQHEYVKHYTNATFLVNENFKFEDGLFSGYDEATRKYDRSTWAYQFDENGQPKRDMDMQDPRCVINMLREHVERYTPEMVERITGTPQKDFQIFCEEIAKTSAPDKAATFLYALGWTQHTVGSQNIRTMAMIQLLLGNIGVSGGGVNALRGHSNVQGITDLGLFPNRLPAYIPLPTEADKSLQSFLDRITPKTMMNDQVNYWKNTPKFMVSMLKSFYGDKGTQDNEFGYHYLPKLPKGGTDQFRYIEDMYNGKVNGFFCQGMNPVASYANSQKIIKALSKLKYLVIFDPLITDTSEFWKNYGEFNDVKTEEIQTEVFRLPTTCFVEEDGSIANSGRWLQWHWKGAEPPGEAKTDGEILSELRAELIHLYKTEGGKAPLEPLEAMSWDYANPLEPKAEEVAKENNGYALEDIKDADGNIILKKGQLLSSFAQMRDDGTTSGACWIYTGQWTEKGNQMANRDNADPSNLGNTLGWAFAWPLNRRILYNRAGADLAGNPFNPKRQLIKWNGKNWNYVDVADYGTAPPNSPVMPFIMQPEGVSGLFVRERMADGPFPEHYEPMETPIGTNPLHPNVVSSPVARILASDKEDLGTSADFPYVGTTYRLTEHFHYWTKNVLLNVIAQPEQFVEIGEALAAEKGIKHGDIVKVSSKRGYIKAVAVVTKRIRALVSDGKPIHTVGIPIHWGFAATTGAKKGFFANNLTVRTGDANTQTPESKCMLVNIEKVGA

SEQ ID NO: 42312 - protein, 937 aa, Arabidopsis thaliana
MAPVPDPNSVGGGAKRDEATTKIPSKDSKKKDDKKEEDLSEEDLQLKQNLELYVERVQDPNPELQKIALESMRKEIRDSTSSMTSVPKPLKFLRPHYGVLKEFHAKMAESDLKKMLADILSVLALTMSAEGERESLNYRLNGSESDIGSWGHEYVRNLAGEIAKEYTIRQGEESSIEDLMDLVQQIVSFHMKHNAETEAVDLLMDVEDLDLLLEHVDNTNFRRTCNYLTSAAKYLPGPDDMLVLDIAYMIYIKFAEYPNALQIALFLDNMQYVKQVFTSCTDLVKKKQFCYMIARHGMTFELDQEMVANDEDKEALQDIVNNSKLSEGYLTLARDIEVMEAKTPEDIYKAHLLDGRASSGPSVDSARQNLSATFVNAFVNAGFGQDKLMTVPSDSTSGSAGNWLFKNKEHGKTSAVASLVYLILLDKLISYVFILEGMIQLWDVETGLGHLDKYFHSNDNPVVAGALLGVGIVNCGIKNDCDPAFALLSGYIDNEDSSVRIGAIMGLGIAYAGSQNDQIKIRLSPILNDANAPLDVIAFAALSLGMIYVGSCNEEVAQSIIFALMDRSEAELGEALTRFLPLGLGLLYLGKQVGSQSYLIIFLVRESVEATAEVSKTFNEKIRKYCDMTLLSCAYAGTGNVLKVSDQFSLTLQTIQTIQVQDLLAQCGEHLVKGDIHQGPAVIGLAMVAMSEELGLDMEIRSLERVLQYGEQNIRRAVPLALGLLCISNPKVTVMDTLSRLSHDTDSEVAMAAIISLGLIGAGTNNARIAGMLRNLSSYYYKDASLLFCVRIAQGFVHMGKGLLTLNPFHSERLLLSPTALAGIVTLLHACLDMKSIILGKYHYVLYFLVLAMQPRMMLTVDQSLKPISVPVRVGQAVDVVGQAGRPKTITGFQTHSTPVLLAAGERAELATEKYIPLSPILEGFVILKENPDYREE

SEQ ID NO: 42313 - protein, 195 aa, Pasteurella multocida subsp. multocida str. Pm70
MQVSRRKFFKICAGGMAGTSAAMLGFAPTEALAAPRNYKLLRAKETRNTCTYCAVGCGMLLYSLGDGSKNSKGKLFHIEGDPDHPVSRGALCPKGAGALDYVNSDRRVKYPEVREAGSKEWKRISWHEAIERIARHIKDDRDANFVEKNDAGEPVNRWMTAGFLAGSACSNETGILTQKFVRSLGIIFTDNQASI

SEQ ID NO: 42314 - protein, 170 aa, Triticum aestivum
  misc_feature (9)..(9): Xaa can be any naturally occurring amino acid
  misc_feature (50)..(50): Xaa can be any naturally occurring amino acid
  unsure (1)..(170): unsure at all Xaa locations
MAPTVMASXATSVVPFQGLMSTAGLPVSRRSNGASLGSVSNGGRIRCMQXVWPIKGIKKCETLSYLPPVRTEALLKQVDYLIRSMWVPCLEFSKVGFIFREHNASPGYYDGRYWTMWKLSMFGCTDATQVINEVEEVKKEYPDAYVRIIGFDNMRQVQCVSFIAFKPPGC

SEQ ID NO: 42315 - protein, 374 aa, Psammomoya choretroides
ALSIAGAVQSQKLAVRAISQLQSLPGGDIKLLCDTVVESVADLTGYDRVMVYRFHEDEHGEVVAESKRPDLEPYIGLHYPATDIPQASRFLFKQNRVRMIVDCHASPVHVIQDDGLMQPLCLVGSTLRAPHGCHAQYMENMGSIASLAMAVIINGNDEEVIGGRNPTRLWGLVVCHHTSARCVPFPLRYACEFLMQAFGLQLNMELQLAAQLLEKHVLKTQTLLCDMLLRDSPTGIVTQSPSIMDLVKCDGAALYYRGNYYPLGVTPTEAQIKDIVEWLLAFHGDSTGLSTDSLADAGYPGAALLGDAVCGMAVAYITNRDFLFWFRSHTAKETKWGGAKHHPEDKDDGQRMHPRSSFKAFLEVVKSRSLPWEN

SEQ ID NO: 42316 - protein, 429 aa, uncultured bacterium pCosHE2
MTTDDLAFDQRHIWHPYTSMTSPLPVYPVVSAEGCELILSDGRRLVDGMSSWWAAIHGYNHPQLNAAMKSQIDAMSHVMFGGITHAPAIELCRKLVAMTPQPLKCVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 42317 - protein, 517 aa, Lactobacillus rhamnosus
MANDQNKDYDKIIVLDYGSQYNQLITRRIREFGIYSELKPHTITAAEVKKIAPKGIIFSGGPNSVYDEGALGVDEDIFKLGIPILGVCYGMQLMAQRLGGDVEPADNREYGKADIEVTDASAKLFHDLPKDQTVWMSHGDLVTRVPDGFRTTATSVNCPISAMDDDDRKFYGIQFHAEVQNTQYGHEILHHFAFDVCHAEANWSMDDFITKQIAKIRAEVGDKRVLLGLSGGVDSSVVGVLLHKAIGTQLTSIFVDHGLLRKGEAEQVMDSLKGKFGLNIIKVNAKDRFLNDLRGVTDPEKKRKIIGRDFIEVFNEEAAKLNGIEFLAQGTLYTDVVESGTDTAQTIKSHHNVGGLPEDLKFKLIEPLNKLFKDEVRELGEKLGMPHSLVWRQPFPGPGLGIRVIGEVTEDKLEIVRDSDYILREEIAKHGLDKDIWQYFTVLPGIRSVGVMGDGRTYDYTIGIRAITSIDGMTADFARIDWDVLQEISSRIVNEVKHVNRVVYDITSKPPATIEWE

SEQ ID NO: 42318 - protein, 198 aa, delta proteobacterium MLMS-1
MTTASRRAELKRQTRETEISLALNLDGQGQTTIKTGVGFMDHMLTLLAVHGFFDLTINASGDTEVDDHHTVEDLGIVLGQGCKQALTATAGIRRYGAAAVPMDETLVRVTLDISNRPYLHYGVELPDAKVGNFDTALAKEFLRAFAQHGGITLHIELAHGDNSHHIIEATFKALGRALDQATTLDQRLTGPLSSKGSL

SEQ ID NO: 42319 - protein, 511 aa, Solibacter usitatus Ellin6076
MIPTALLNSLYTVGSLKNGAGGVEFAIKNRLADAELVGISAIAIDGHAVAMEQVWLDLEDGREVLPLEVSAAQPIAFPLRCTVKVHAGGDPLRAAKHRLEIAFDTRPFGKLDLKVEDAVAENGQPAVSIPRGEDDYSPVNVARRRAFLESQTGMSPRHIFHHSLDPRDAKGNCENFVGVAQVPIGIAGPLHVRGEHAQGNFLIPLATSEGTLVASYNRGMKVLNLCGGVKVTVVGDAMQRAPAFIFEDARAGRDFSIWVQDNLATIRAQAEATSSVAKLQYIDTYLASKFVYLRFNFSTGDAAGQNMVGRATLAACEWILEHYHGIVSFYLESNFATDKKASDINRLRTRGKRVTAEAVIQRDVLIGHMRVEPEQLTHHYGVANVGALLSGANNNGGHSANGIAAMFIATGQDAANVAESSAAVLYTELTPQRDLYISLTIPSLIVATHGGGTGLATQRECLEILRCYGRDRVNRLAEIIGGVALAGEISLGAAISASDWVSSHEKHGRNR

SEQ ID NO: 42320 - protein, 374 aa, Pterocelastrus tricuspidatus
ALSIAGAVQSQKLAVRAISQLQSLPGGDIKLLCDTVVESVRDLTGYDRVMVYKFHEDEHGEVMAESRRPDLEPYIGLHYPASDIPQASRFLFKQNRVRMIVDCHASPVLVIQDDGLMQPLCLVGSTLRAPHGCHAQYMENMSSIASLAMAVIINGSDEEGVGGRNPTRLWGLVVCHHTSARCIPFPLRYACEFLMQAFGLQLNMELQLAAQLLEKHVLKTQTLLCDMLLRDSPTGIVTQSPSIMDLVKCDGAALYYQGNYYPLGVTPTEAQIKDIVEWLLAFHGDSTGLSTDSLADAGYPGAALLGDAVCGMSVAYITNRDFLFWFRSHTAKEIKWGGAKHHPEDKDDGQRMHPRSSFKAFLEVVKSRSLPWEN

SEQ ID NO: 42321 - protein, 138 aa, Solanum tuberosum
PDKEDTGGEDAHFICSDEQAIGVADGVGGWADLGIDAGKYARELMSNSVAAIQDEPKGSVDPARVLDKAYTCTKAKGSSTACIIALTDQGLHAVNLGDSGFIVVRDGSTVFRSPVQQHDFNFTYQLESGNAGDLPSSG

SEQ ID NO: 42322 - protein, 138 aa, Coffea canephora
HPDKEDTGGEDAHFICSDEQAIGVADGVGGWADLGIDAGKYARELMSNSVAAIQDEPKGSVDPARVLDKAYTCTKAKGSSTACIIALTDQGLHAINLGDSGFIVVRDGSTVFRSPVQQHDFNFTYQLESGNAGDLPSS

SEQ ID NO: 42323 - protein, 662 aa, Oryza sativa (japonica cultivar-group)
MSNKLHNSSRHSFLLAWHSSNLAILHEAIRIIPRYIVAIVVEILRGLLVILLLGFVLHLAGGDRHPPPGPIACARGGTSGGCTVTNIYGSFPDRAACRAAGVAYPRTEEELVAAVAAAAAAGRKAKAATRYSNSFPRLACPGGVEGEGGVAISTRWLNRTVRVDAARRLMTVEGGMVLRDLIREAAAAGLALPHSPYWSGVTVGGALATGAHGSSLWGKGSAVHEYVVGMRIVTPAAASEGFAVVRELAADDPDLDAAKVSLGVLGIISQVTLALEPQFKRSVKFVKRDDADIAEKVAVWGRLHEFGDMVWLPGQRQVIYREDNRVNISTPGDGLNDYFGFRAQPTLSMVGARVIDECLEENPMYTDTARCLASRAVTKMFDLLAYGFTNDGATFTGYPVVGYQHRIQSSGSCMGSLEEKDDGLLLTTTCPWDRRTRGVFAYNVAFTVPLSRAPAFVADVSRLRDLDPAAFCQIDAKMGVLVRYVAASSAYLGKAEDSVDFDVTYYRSRARGAPRAHADVFDEVEQMALRGHGGVPHWGKNRNAAFDGAIARYPNAGEFLRVKDRFDPEGVFSSEWSDRVLGVGGASPAIVGDGCAMEGLCVCSDDSHCAPELGYFCRPGKVFTEARVCSLLRDAADGYLRDRHGNVRVNATSTGKHSLLHE

SEQ ID NO: 42324 - protein, 589 aa, Oryza sativa (japonica cultivar-group)
MVRRLLVILLQALTGLLVILALWIVSHLAGDRPPPGPVVCAANGTSGCTLTNIYGSFSDRAICRAANVTYPRTEEELVAAVAAAVAAGRKVKVATRYSNSFPRLACPGGEDGTVISTRWLDRAVRVDAARRLMTVESGMVMRDLIREAAAAGLALPHSPYWSGLTIGGVLATGAHGSSLWGKGSAVHEYVVGMRIVTPAPASEGFAAVRELAAGDPDLDAAKVSLGVLGAISQVTLELQPLFKRSVAFVTRNDSDVADTVAAWGRLHEFGDVAWLPRRRVAVYREDDRVDVATPGDGRSDYPAFRPTPTLPLVASRLAEEWLEERSGSDAARCAASRVMPATLEHLNYGLTNDGEAFTGTTGTSPPTTASGTALRGHLFYNSGFSIALSRAPAFVADVARIRDLNPAAFCQIDSKMGLLMRYVAASSAYLGKAEDSVDFDVTYYRSYARGAPRAHADVFDEVEQMALRKHGGVPHWGKNRNYAFDGAIARYPNAGKFMRVKDRFDPDGVFSSEWSDQVLGVGGASPVIVGDGCAMEGLCVCSDDSHCAPEKGYFCRPGKVFTAARVCSPSPRGAANGGDDDDEISDVGD

SEQ ID NO: 42325 - protein, 399 aa, Oryza sativa (japonica cultivar-group)
MATSSLLPLHLPTRPSAVKASAAATAAAAPKPQSLEESFGRKGLRFAADPATGAPTAELSVRNGSSLQLRLADGLVTSYRPKVYWKDDGCREVLHTVAGAGAGGEVKGGVGLALSEVSSSGAAESLLVGSEWSVVDADSDSYDAVQLVNDNWVLDLHPVLSRQAQTELDSLMTILASQQLQHTEQDVELGCTKGSGTLEVTYVVTLYPLSMATAVMVKNNGKKPVSLTSAMLSHIKFDKRRGTAVEGLRGCPYCSHPPPAAGFALLTPAEAMKREDGGWFGGGGGEEPRQGVWTVEDNLYTILKKKVSRVYAAPPEERKKRIYSTAPSKFTTIDQNSGLGFRVVRMGYEDMYLCSPGEMYRKFGKDYFLCTGTASMLVPVVVNPGEEWRAAQVIEHDNL

SEQ ID NO: 42326 - protein, 337 aa, Crocosphaera watsonii WH 8501
MIRVAINGFGRIGRNFLRCWLGRENTGLEVVGINDTSDPRTNAHLLRYDSMLGILDADIEADENSITVNGKTIKCVSDRNPLNLPWTEWNVDLVIESTGVFVTEEGASKHIVAGAKKVLITAPGKGGNVGTYVVGVNAQDYEHDKHNVISNASCTTNCLAPVVKVLNDNFGIIKGTMTTTHSYTGDQRILDASHRDLRRARAAAVNIVPTSTGAAKAVALVIPEMKGKLNGIAMRVPTPNVSVVDLVAQVEKSTIAEQVNDIFKTASEGSMKGVLGYNDLPLVSCDYRGTDVSSIVDASLTMVMGGDMVKIVAWYDNEWGYSQRVVDLAEVVANKWK

SEQ ID NO: 42327 - protein, 156 aa, Cicer arietinum
PNKANSYSVHGAALGAKEVDATRQNLGWPYEPFHVPEDVKKHWSRHTPEGAALEAEWNAKFAEYEKKYAEEAAELKAIITRELPAGWEKALPTYTPETPADATRNLSQQNLNALAKVLPGLLGGSADLASSNMTLLKSFGDFQKGTPEERNVRFGV

SEQ ID NO: 42328 - protein, 184 aa, Arabidopsis thaliana
MQSSNVTDCTMRKRGTKRKIEIEKRMTKQQRSVACSKRRPTLFSKAADLCLLSGANIAVFVTSPDENSDVVYSFSGYSHASEIVDCYLNNKSPPKTTINPESAKFWWEEPDLYRDCDDLSELRIIEDRLMRTKKHLMDYLEKKEKSHSVSKSDQNPNNDSGSSSSSSQIASDFASHHLINLVTW

SEQ ID NO: 42329 - protein, 164 aa, Cicer arietinum
LVAGEAGTGIAELIALEMSKQTKTPIEETRKKIWLVDSKGLIVSSRANSLQHFKKPWAHEHEPVGTLIDAVKVIKPTVLIGSSGVGKTFTKEVIEAMTSNNEKPLILALSNPTSQSECTAEEAYTWSEGRAIFASGSPFDPVEYNGKVYYSGQSNNAYIFPGFG

SEQ ID NO: 42330 - protein, 583 aa, Hyphomonas neptunium ATCC 15444
MSTDLLPPNWPAMSVAQANAALAGPGSPLELEDAVIRGVPMKVYKNAPPNIPVILDLAAEQFPDRTYLVYQNERVTFSALQLAVRKLAAEMRDTYGIKKGDRVAIVMRNYPQWPLGFYAALSLGAIATPMNSWWTAEELEYGLSFAGVKLAIMDLQIYERFRDHLDKLPELKNVLIARDTTEEIADPRVSSLDAIVGHPNDWEDLPDAGPTGVEIGPDDDATIMYTSGTTGKPKGALATHRAVITNMFNSSACQARMFLRKGEPVPAPDPDAMRATLISIPFFHATGSFAILIPSALRGDKVVAMYKWDAGEALPIIEGEKISAVGGVPAIAWQILEHPDRDKYNLSSIQAISYGGAPSAPELVSTIKKRFPEAAPGNGWGMTETCATATLNIGEDYVNRPSSAGAPPAAVELKICDPDGNDMPAGEVGELWCKSAANCRQYWNRPDATAETFRNGWVVTGDLARIDEEGFLYLVDRAKDMLIRGGENVYCIEVESALYDHPAVMDAAVVGIAHKILGEEVGAVVQLKPGKAASEAELRAHVAGQLAAFKVPVEIQFQDEPLPRNANGKILKAELRQRFKARA

SEQ ID NO: 42331 - protein, 427 aa, Escherichia coli
MADTKAKLTLNGDTAVELDVLKGTLGQDVIDIRTLGSKGVFTFDPGFTSTASCESKITFIDGDEGILLHRGFPIDQLATDSNYLEVCYILLNGEKPTQEQYDEFKTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFFRRAKDKNDSFRLMGFGHRVYKNYDPRATVMRETCHEVLKELGTKDDLLEVAMELENIALNDPYFIEKKLYPNVDFYSGIILKAMGIPSSMFTVIAAMARTVGWIAHWSEMHSDGMKIARPRQLYTGYEKRDFKSDIKR

SEQ ID NO: 42332 - protein, 137 aa, Oryza sativa
  misc_feature (8)..(8): Xaa can be any naturally occurring amino acid
  unsure (1)..(137): unsure at all Xaa locations
RGHSDVLXLDPVHKKFVEELSSCNIFMVKDNIISTPLLTGTVLPGITRRSIIEYARSLGFQVEECLITIDELLDADEVFCTGTSVVLSSVGCIVYQGRRVEYGNQKFRTVSQQLYSALTAIQKGLVEDSMGWTVQLN

SEQ ID NO: 42333 - protein, 549 aa, Pasteurella multocida subsp. multocida str. Pm70
MKNINPTTTNAWKALQQHHKTQSAVTIQQLFAQEKDRFTDYSLSFNNEVLVDFSKNNVTKETLGLLRQLAQECALSEAVDAMFSGAKINKTEDRAVLHTALRNRSNSPVLVDGKDVMPEVNAVLAKMKDFCHRVISGEWKGYTGKAITDVVNIGIGGSDLGPYMVTEALRPYKNHLNLHFVSNVDGTHIAETLKKVNPETTLFLVASKTFTTQETMTNAHSARNWFLATAKDESHVAKHFAALSTNSKAVAEFGIDTNNMFEFWDWVGGRYSLWSAIGLSIALSIGFEHFEALLAGAHEMDKHFRTAPIEQNIPTTLALIGLWNTNFLGAQTEAILPYDQYLHRFAAYFQQGNMESNGKYVDRNGEVIDNYQTGPIIWGEPGTNGQHAFYQLIHQGTTLIPCDFIAPAQTHNPLADHHEKLLSNFFAQTEALAFGKTKEEVEAEFVKAGKSLDEVKEVVPFKVFTGNKPTNSILVQKITPFTLGALIAMYEHKIFVQGVMFNIYSFDQWGVELGKQLANRILPELANRETITTHDSSTNGLINQYKQWR

SEQ ID NO: 42334 - protein, 374 aa, Quetzalia occidentalis
ALSIAGAVQSQKLAVRAISQLQSLPGGDIKLLCDTVVESVRDPTGYDRVMVYKFHEDEHGEVVAESKRPDLEPYIGLHYPAADIPQASRFLFKQNRVRMIVDCHATPVSVIQDDGLMQPLCLVGSTLRAPHGCHAQYMANMGSMASLAMAVVINGNDEEGIGGRNTTRLWGLVVCHHPSARGIPFPLRYACEFLLQALGLQLNMELQLAAQLSEKHVLRTQTLLCDMLLRDSPTGIVTQNPSIMDLVKCDGAALYYQGKYYPLRVTPTEAQIKGIVEWMLAFHGDSTGLSTDSLADAGYPGAASLGDAVCGMAVAYITNRDFLFWFRSNTAKEIKWGGAKHHPKDKDDGQRMHPRSSFKAFLEVVKSRSLPWEN

SEQ ID NO: 42335 - protein, 206 aa, Colwellia psychrerythraea 34H
MLVTNDNINDLAWQKMDNLIPAIIQHAATGAILMQGYMNQASLQATLTTGKATFFSRSKQALWVKGETSGNFLEVKQVLTDCDNDSLLIACEPIGPSCHLGTESCFPEQKLTQQNFLSQLEQVIQQRKDDDPKESYTAHLFSRGTTKMAQKVGEEGVEVALAAVAETKEDLLGECADLFYHTLVLLADQKIELSEVMEVLQTRHNK

SEQ ID NO: 42336 - protein, 279 aa, Triticum aestivum
DKGDLSTANEGSPSEDGDRKRGGGHRRGSKGTRKRMAMEAELSCKLVDFGNACWTYKQFTSDIQTRQYRCPEVLLGSKYSTSADLWSFACICFELASGDVLFDPHSGDNFDRDEDHLALMMELLGMMPRKIALGGRYSRDYFNRYGDLRHIRRLRFWPLSKVLVEKYEFSDIDAIAMSDFLVPILDFVPEKRPTAAQLLQHPWFDAGPLRRQPRVLADTAENPVDGAPENKGKEKDDERDAMAAELGNIAIDGASSSKIVKDPQASSKQKIANGTPSKK

SEQ ID NO: 42337 - protein, 374 aa, Quetzalia occidentalis
ALSIAGAVQSQKLAVCSISQLQSLPGGDIKLLCDTVVESVRDLTGYDRVMVYKFHEDEHGEVVAESKRPDLEPYIGLHYPATDIPQASRFLFKQNRVRMIVDCHATPVRVIQDDGLLQPLCLVGSTLRAPHGCHAHYMANMGSMASLAMAVIINVNDEEGIGGRNATRLWGLVVCHHTSTRCIPFPLRYACEFLMQAFGLQLNMELQLALQLSEKHVLRTQTLLCDMLLRDSPTGIVTQSPSTMDLVKCDGAALYHQGKYYPLGVTPTEAQIKDIVEWLLAFHGDSTGLSTDSLADAGYPGAVSLGDAVCGMAVAYITNRDFLFWFRSHTGKEMKWGGAKHHPEDKDDGQRMQPRSSFKAFLEVVKSRSLPWEN

SEQ ID NO: 42338 - protein, 469 aa, Azoarcus sp. BH72
MNAQDVMKMIQENEVRFVDLRFTDTRGKEQHVGLPVSAFEEDHFEHGHPFDGSSIAGWKGIQASDMILMPDAASAYIDPFFDETTLVLACDVIEPSDGKGYDRDPRSIAKRAEAYLKSTGIGDTAFFGPEPEFFIFDAVEWSVDMSGVYSKIISEEAAWSTADKFEGGNTGHRPKVKGGYFPVPPVDSLNDIRAAMVLALEAAGIPVEVHHHEVANAGQCEIGTKFSTLTKRADWTQTLKYIVHNVAHQYGKTATFMPKPIVGDNGSGMHVHQSIWKDGQNLFAGNGYAGLSETALYYIGGIIKHARALNAITNPATNSYKRLVPHYEAPTKLAYSARNRSASIRIPYVANPKGRRIESRFPDPAANPYLCFAALLMAGLDGIQNKIHPGDPADKNLYDLPPEEDALIPTVCTSLDQALEYLDKDREFLTRGGVFSNDFIDAYIELKMEEVNRLRVTTHPVEFDLYYSL

SEQ ID NO: 42339 - protein, 374 aa, Reissantia sp. Chase 2095
ALSIAGAVQSQKLAVRAISQLQSLPGGDIKLLCDTAVESVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDGMGGRNPTRLWGLVVCHHTSARCIPFPLRYACEFLMQAFGLQLNMELQLAAQLLEKHVLKTQTLLCDMLLRESPTGIVTQSPSIMDLVKCDGAALYYQANYYPVGVTPTEAQIKDIVEWLLAFHGDSTGLSTDSLADAGYPGATSLGDAACGMAVAYITNRDFLFWFRSHTAKEIKWGGAKHHPEDKDDGQRMHPRSSFKAFLEVVKSRSLPWEN

SEQ ID NO: 42340 - protein, 374 aa, Reissantia indica
ALSIAGAVQSQKLAVRAISQLQSLPGGDIKLLCDTAVESVRNLTGYDRVMVYKFHEDEHGEVVAESRRPDLEPYIGLHYPATDIPQASRFLFKQNRVRIIVDCHASPVSVIQDDGLMQPLCLVGSTLRAPHGCHAQYMENMGSIASLAMAVIINGNDEDRMGGRNPTRLWGLAVCHHTSARCIPFPLRYACEFLMQAFGLQLNMELQLAAQLLEKHVLKTQTLLCDMLLRESPTGIVTQSPSIMDLVKCDGAALYYQANYYPLGVTPTEAQIKDIVEWLLAFHGDSTGLSTDSLADAGYPGATSLGDAVCAMAVAYITNRDFLFWFRSHTAKEIKWGGAKHHPEDKDDGQRMHPRSSFKAFLEVVKSRSLPWEN

SEQ ID NO: 42341 - protein, 595 aa, Prochlorococcus marinus str. AS9601
MIKVEKVKKKKDSAKEETVCLANGLEVSKFENFKKSSQFLKEPLATELVNESDHFTNDAVQLLKFHGSYQQDNRENRRPGKSKDWQMMLRLRNPGGEVPGKLFLALDELSDKLGNGTLRATTRQAFQMHGIRKENLKEVIKTIVNSMGSTLAACGDINRNVMAPAAPFDSPDYNIARALAKKVADLLTPMAGQGTFLELWADGDLEYTIKPDKDIEAIRKLQFKDNVFSGIKDEPLYGSTYLPRKFKCAVTVPGDNSVDLLTNDIGIVAFTSKNGNLEGCNFYVGGGMGRTHNNEETFARIADPLGYVEEPDVYELIQSIVAIQRDYGDRKSRKNSRMKYLLHRKGIKWFKKILSDKYFKKEIKKIRKEPDNVLIDYLGWHKQNKTSYFVGLPLLSGRLSGEKKNTITTIVKKYNLDLRLTPNQDILLCNIANENKGEIQKSLSKIGYENLENINEIQRHALACPALPLCGLAMTEAERILPDVLKRIENLLLDLKIQKTILFRMTGCPNGCTRPYMAELALVGSGQNKYQLWLGGSKNLQRLAKPFLQRMELNDLEKTLQPLFNNWKSNLDLDFGDFINTQDENYIFNLLNKNQ

SEQ ID NO: 42342 - protein, 117 aa, Triticum aestivum
  misc_feature (31)..(31): Xaa can be any naturally occurring amino acid
  unsure (1)..(117): unsure at all Xaa locations
QSRPEFFFLFGTNDLTQMTFGYSRDDVGKFXRVRYLAQGILQHDPFEVLDQRGVGELVKIATERGRKARPNLKVGICGEHGGEPSSVAFFAKAGLDYVSCSPFRVPIARLAAAQVLV

SEQ ID NO: 42343 - protein, 449 aa, Bacillus cereus ATCC 10987
MFFTQFFKPAPHVERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIVFGSFSFITTSIILMFVLQFLNGWVQGMGWPPCGRTMVHWFSISERGTKMSIWNVAHNVGGALMPSLVTLGLYFFANDWKSIFYFPGILSILVGIYVLITMRDTPQSCGLPSIEEHTGEYPPDEKVQDRERELSVKEILFTYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLKTGSPKQKQA

SEQ ID NO: 42344 - protein, 540 aa, Triticum aestivum
  misc_feature (282)..(282): Xaa can be any naturally occurring amino acid
  misc_feature (435)..(435): Xaa can be any naturally occurring amino acid
  unsure (1)..(540): unsure at all Xaa locations
MEAAAELAQRLRAAANDRLAGQEPLLLVAAPLLALLAARAVHAAAADVADRGLRTVLITLAMAAVKLVPGVSGYIAAEKSKVVEQLQSGSASSKKNLRTELPAVGDPDGVIDELQALKDKDVRWQGKCSGTVYIAGSESEGHFSLINKAYSMFSHTNPLHQDVFKSVAQLEAEVVAMTAALLGSKEKASGGQICGNMTSGGTESILLAVKTSRDYMQSKKGITKPEIIIAESAHSAYDKAAQYFNIKVRRVPVNKEFLADVKGFKRCINGNTIMMVGSAPGXPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYISPTMAGSRPGGLVAGAWAAMMSLGLNGYLESTGKIMEVSRKIQKGIDDISGLFVIXGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 42345 - protein, 138 aa, Glycine max
  misc_feature (122)..(122): Xaa can be any naturally occurring amino acid
  unsure (1)..(138): unsure at all Xaa locations
ALSMISSPADTTINRAGAGLDAPFTGLKYMAGFPTRKTNNDLTSIASNGGRVQCMHVWPPVGKKKYETLSYLPDLDDAHIGKRQSNTLLRNGWIPCLEYALDHGFMYREHNMSPGYYDGRYXTMRKLPMLDCTVASKE

SEQ ID NO: 42346 - protein, 492 aa, Gibberella zeae PH-1
MALTVELSTPVTGTYQQPIGLFIDGKWVEGVDKGKFEVINPSTEEVITSVCEGTEKDIDLAVAAARKAFDGEWKNTAPQTRGNLLLKLADLAEKNLDLLAAVESLDNGKSITNARGDVGAVVGCLRYYGGWADKIEGKTIDIAPDMFHYTRSEPIGVCGQIIPWNFPLLMLAWKIGPALATGNTVVMKTAEQTPLSALVFTQFIEQAGFPAGVFNLVSGYGKTAGAALSSHMDVDKIAFTGSTVIGRQIMKAAASSNLKKVTLELGGKSPNIVFEDADIEEAINWVNFGIYYNHGQCCCAGTRIFVQESIYDKFLAAFKKRAEENKVGDPFNEETFQGPQVSQLQYDRIMGYIKAGKDEGATVEIGGERLGDKGYFIKPTIFSNVRPDMKIMQEEIFGPVCAISKFKDEAEVIDLAHDTAYGLAAAVHTKNLNTALRVSNALKAGTVWVNCYNMLHHQLPFGGYKESGIGRELGEAALANYTQNKSVAIKLY

SEQ ID NO: 42347 - protein, 175 aa, Cytophaga hutchinsonii ATCC 33406
MQLTNRSKVVVDKKMTFMERIYIPSIVSGMMITLSHLFKKKATIQYPEVQREFAFVYRGKHILKRDEQGRENCTACGLCAVSCPAEAITIIADERKKGEEHLYKEEKYASLYEINMLRCIFCGLCEEACPKDAVYLTEELVPAQYNRKDFIYGKDKLVQPLGTSAHPKTYKPYKK

SEQ ID NO: 42348 - protein, 500 aa, Bacillus anthracis str. A2012
MAEQTVRVTVDGKEFSASGEKTILQLFNESNLEHPQICHVPEVDPIQTCDTCIVEVDGKLMRACSTQIENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDHGVSINDSSCVSCGQCVTVCPCNALMEKSMLGEAGFMTGLKPDVLDPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEASWEEALEVVASNMQHIKSAYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHEQKLIVADLRKHEMAERADLFIHPRQGTDYVWLAGITKYIIDQDWHDKTDS

SEQ ID NO: 42349 - protein, 483 aa, Bacillus anthracis str. A2012
MIKLIAENVKNFDEYSKMVEKYTLDYTEKITGISKENLKEMARMVYEADGTCVLWGMGVTQNTGGSTTSAAISNLLLVTGNYRRPGAGAYPLRGHNNVQGACDMATLPNWLPGYQAVSDDTLRAKFEKAYGTTIPKAPGLNNIAMLLAAEEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYESPSEIMDEIASLAPLYSQATYDRLEGWNSLCWGSHDGSDTPLLYVDGFNFPDKLARLSLDEWIPPVVAPDEYDLLLNNGRMLEHFHEGNMTNKSAGILSKVSEVFVEISPELAIERNVKDGGLVELASPFGKIKVQALITDRVTGKELYLPMHATINEEAINILTGTATDLYTCTPAYKQTMVKMRVLREKGNRPLPPSNPRDKNRNPQNGVEIEQKWQRKQYVSLVD

SEQ ID NO: 42350 - protein, 807 aa, Colwellia psychrerythraea 34H
MKFSESWLREWVNPALSSDDLAHQITMAGLEVDGVDPVAGEFSGVVIGEVVECGPHPDADKLQVTKISLGDYSSTTVEKGELVTIVCGAKNCRLGLKVAVATVGAVLPGDFKIKKAKLRGVPSFGMLCSESEIGLADDSDGIMELASDAPLGQCVREYLDLNDVTIDVDLTANRGDCLGLKGLAREVGVLNSLEVSEPTITAVAPTIDDVITINIEANEACPRYLGRVIKGINPNATTPLWMVEKLRRCGTRSIDPVVDVTNYILLELGHPMHAFDLAKLDGGINVRFANKDEKLTLLDENEVTLKEGTLVIADENKALAMAGIFGGLESGVTNNTTDLFLESAFFAPLAILGKARQYGLHTDSSHRYERGIDPTLQHDAIERATELLLSIVGGQAGPVVEAKSDADIPQTKDVNLRRKMLDSRIGHHIEDAQVSEILTRLGFTVTTTGEGEAKVWQVIVPAYRFDIKIEVDLIEEVARIFGYNNIPNIAPKATLKMCEQKEANLSLSNLKQTLVNRDYQEAITYSFVDPKVQALLHPGQEVMTLPHPISSEMSVMRLSLWTGLLQSMVYNQNRQQGRIRLFETGLRFVPDESAENGVRQQNMIAGVISGLRVDEHWSMEKAATDFYDIKGDVEALLALTCDAQGYEFSKAEVDALHPGQTAQITKNGVFVGCVGTLHPELERKLGLNGRTLIFELLLSEVLVQKIPEATDISRFPANRRDLAIVVKEDVDAKNVLQLIEKVGGNYLIDLNLFDVYKGQGIDDGFKSLAIALVLQDTSKTLEEKDITDVIDRVVATLKTELNASLRD

SEQ ID NO: 42351 - protein, 576 aa, Thermus thermophilus HB27
MPISRYYDVKRDEKGERYLEPYVTGFLLLRLPLLNKGTAFTEEERRLLGLEGLLPPHVHTLEEQKERVYRRYRLIQSPLEKHIYLRHLQDRNEVLFYALVVDHLEEMLPILYTPTVGEAVREFSHIYRYPRGFTASTKNIDRIDEALQNVPLEDVRLIVATDSSAILGIGDQGYGGMAISIGKLTLYTAAGGVGPDKTLPVELDVGTDREDLLKDPLYLGVRHRRLRGEEYFRFLDRFVEAVRRRYPKALIQWEDFAKETAFQVLERYRKVIPSFNDDIQGTGAVALAGVLSACRLKGERLSDQVVVVYGAGAGGIGVAWALVEGMKREGLSEEEAKARVLVLDSKGLLVEGRSMEDYKRPYAQRPERLWGWRFAGEYPNLLETITNARATVLLGLSGQAGSFTEPVVRAMLANTPRPVIFPLSNPTSATEALPDDLVYWTEGRALVAAGSPFPPVGFKGRTVPIGQGNNAFVFPGLGLGAVLSRAREVTDGMVLEAAYALYDYTREHFPERIYPPVGRLREVSPYVAARVMQRALEEGVAEEARVQGLTLEALLDFVKSRFWEPRYLPYRPAPVI

SEQ ID NO: 42352 - protein, 426 aa, Azoarcus sp. BH72
MISVRRFGFIAIAALTAWAALPGFNPAPAPRFVAPPAAAMAASPGASPLFASAIVNLPDPPRVHAASVAVLPDGRLFATWFGGEREGGTEVKVYAATRNPGEAGWGRQHAIATPEQTSADVGRLVRKMGNPVAFVTPRGELWVVYVSVTLGGWATSHLNLLRSPDLGTTWLPARRLAATPFFNLSTLVKGFPVFFDNGDVGLPVYHEMAGKFAELLVLSDEGEVRHKVRMDHGRRSLQPVVLVEDEQRAVALMRYGGEHGPFRAWRSETADGGRSWSAVEPTTLANPNSALAALRLDDGRLLAVANDTEDERLRLSLLVSEDGGRNWRSIHRFEDKQDFAGHEAGGEVFRARLEADVADLGPGPAAADLVRVAERNLCRNQGACGWQYDYPYLVRAADGDFHLVYTWNRSFVRHIQFNRAWLEGKL

SEQ ID NO: 42353 - protein, 459 aa, Triticum aestivum
  misc_feature (13)..(13): Xaa can be any naturally occurring amino acid
  misc_feature (48)..(48): Xaa can be any naturally occurring amino acid
  misc_feature (67)..(67): Xaa can be any naturally occurring amino acid
  misc_feature (83)..(83): Xaa can be any naturally occurring amino acid
  misc_feature (104)..(104): Xaa can be any naturally occurring amino acid
  misc_feature (111)..(111): Xaa can be any naturally occurring amino acid
  misc_feature (123)..(123): Xaa can be any naturally occurring amino acid
  misc_feature (159)..(159): Xaa can be any naturally occurring amino acid
  misc_feature (211)..(211): Xaa can be any naturally occurring amino acid
  misc_feature (229)..(229): Xaa can be any naturally occurring amino acid
  misc_feature (287)..(287): Xaa can be any naturally occurring amino acid
  misc_feature (318)..(318): Xaa can be any naturally occurring amino acid
  misc_feature (324)..(324): Xaa can be any naturally occurring amino acid
  unsure (1)..(459): unsure at all Xaa locations
MAATIQSVKARQXIFDSRGNPTVEVDVCCSDGTFARAAVPSGASTGCXYKLWELRDGGSDYLGQGCXSKAVNNVNSIIAPALXGKDPTAQTELDNFMVQQLDGXTRNEWGXWARQKLGANAIXLAVSLACFAKAGASVKKIPLYQHIGNLAGNKALVLXPFPAFNVINGGSHAGNKLAMQEFMILPTGATSFKEAMKMGVEVYHNLKSVIXKKKYGQDATNVGDKGGFXAPNIQENKEGLELLKTAIEKAGYTGKVVIGMDVAASEFYNDKDKTYDLNFKEENNDGXSQKISGDSLKNVYKSFVSEYPIVSIEDPFDXQDDWVXHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 42354 - protein, 431 aa, Prochlorococcus marinus str. AS9601
MKRVLAIILGGGKGSRLYPLTKMRAKPAVPLAGKYRLIDIPISNCINSGIEKMYVLTQFNSASLNRHIGRTYNLNGPFGQGFVEVLAAQQTPDSPKWFEGTADAVRKYQWLFQEWDVDEYLILSGDQLYRMDYSLFVQHHRDNGSDLTVAALPVDEAQAEGFGLMRTDDVGNIKEFSEKPSGEKLKAMAVDTSKFGLSKESAAEKPYLASMGIYVFSRNTLFDLLNKFPNYTDFGKDIIPEALNRGDTLKSYVFDDYWEDIGTIGAFFESNLALTEQPKPPFSFYDEKFPIYTRPRFLPPSKLVDAQITDSIVCEGTILKSCSILHCVLGVRSRIESDSVLEDTLVMGADFFESPEERIELRKGGGTPLGVGEGTTVKRAILDKNTRIGDNVVIINKDRVEEADKPELGFYIRNGIVVVVKNATIANGTVI

SEQ ID NO: 42355 - protein, 298 aa, Bacillus cereus ATCC 10987
MPNIAVVGSISMDLVAVSKKRPKAGETVIGEAFHTIPGGKGANQAVAAARLGANVAMVGAVGDDNYGTVVRKNLENERVFIDYVVPVTDTATGIAHIVLAEEDNSIVVVQGANALVNESVVNRSKDLLTKADMVVLQLEIPLETVKYVLAICEEHKIPVMLNPAPAQVLSEDILEKATYITPNEHECRIVLDDFTSPIEELLAKYPNKLLMTEGSNGVRFHNGTEIVHVPSIAVDVVDTTGAGDTFNGALAVALSEGETLQKAIRFANIAGGLSVTKLGAQGGMPTRDKVREVQVIVG

SEQ ID NO: 42356 - protein, 172 aa, Prochlorococcus marinus subsp. marinus str. CCMP1375
MIGSKLKEAIRSYSDFPKKGILFHDISPIFCKPDLYQELIEEMAKSEILNSSDAIISIDARGFLFGSCISLKLSKPLILARKAGKLPGPILSSTYNLEYGENSLSIQKESLNEFKNFAIIDDVLATGGTINCVKSLLTSHNKNISGACVVIELLALKAREKLDFPIYSTLTL

SEQ ID NO: 42357 - protein, 509 aa, Zea mays
  misc_feature (421)..(421): Xaa can be any naturally occurring amino acid
  misc_feature (424)..(424): Xaa can be any naturally occurring amino acid
  misc_feature (426)..(427): Xaa can be any naturally occurring amino acid
  misc_feature (430)..(430): Xaa can be any naturally occurring amino acid
  misc_feature (438)..(438): Xaa can be any naturally occurring amino acid
  misc_feature (443)..(443): Xaa can be any naturally occurring amino acid
  misc_feature (445)..(446): Xaa can be any naturally occurring amino acid
  misc_feature (448)..(449): Xaa can be any naturally occurring amino acid
  misc_feature (451)..(451): Xaa can be any naturally occurring amino acid
  misc_feature (453)..(453): Xaa can be any naturally occurring amino acid
  misc_feature (459)..(459): Xaa can be any naturally occurring amino acid
  misc_feature (461)..(461): Xaa can be any naturally occurring amino acid
  misc_feature (475)..(475): Xaa can be any naturally occurring amino acid
  misc_feature (478)..(478): Xaa can be any naturally occurring amino acid
  misc_feature (489)..(489): Xaa can be any naturally occurring amino acid
  misc_feature (493)..(493): Xaa can be any naturally occurring amino acid
  misc_feature (499)..(499): Xaa can be any naturally occurring amino acid
  unsure (1)..(509): unsure at all Xaa locations
MIKQILGRLPRKPGKAGDSREAAAAGNGTEPSNSYSVARSMDPGNKRAGNGDYPVPSGVIPNPVMNGAVVYHSNEPLPAFKDVPMSEKQNLFVKKVNLCCAVYDFVDPTKNLKEKEVKRQTLMELVDYVTSANGKFSEVVMLEITKMVSINLFRSSSPTPRENKAIEGVDLEEDEPLMDPAWSHLQIVYEVFLRFVASQETDAKLAKRYIDHSFILRLLDLFDSEDPRERDYLKTILHRIYGKFMVHRPFIRKAINNIFYRFIFETEKHNGVAELLEILGSIINGFALPLKEEHKLFLVRALIPLHKPKCVSMYHQQLSYCITQFVEKDCKLADTVIRGLLKYWPVTNSSKEVMFLGELEEVLEATQLAEFQRCMVPLFRQISRSMNSSHFQVAERALFLWNNDHIETLIKQNYKVLLPIXYPXLXXNSXDPWNQAVXSLTLXVXXIXXDXDXAFFGEXVXRFSDEELKQEEFDXKRXALWMRLEEMAXLKPXENSPLXAPNGKPSQAA

SEQ ID NO: 42358 - protein, 215 aa, Crocosphaera watsonii WH 8501
MSMLGVSWLSDKREENMNDAMILASWLAGEFSSFKQTLDNPRIHPHIRIFFRPLPFEFFEGVGFYSEQVYDYDPWHPHHQNVHRIFAQGDNVFVENYALKDKDLYTGSGSDLEILKTITPESIELRNGCAIIFQREGDKFVGQVEPGNKCLIPRKDGRMTYLKSEVEVTENIWISRDTGFDVDTDEKVWGSTTGLLKFEKVQNFAHELPKNCQIK

SEQ ID NO: 42359 - protein, 333 aa, Ascophyllum nodosum
MVNVAINGFGRIGRLVLRAAKHNKHINVVAVNDPFVPPDYMNYMFKYDTVHGVYDGTVENDDSSIIVDGKKIKVFGEMDAANVKFGDVGADYVVESTGLFTTTESAAVHLKGGAKKVVISAPSQDAPMFVMGVNQDKYTPDMDVVSNASCTTNCLAPIAKVINDSFGLKEGLMTTVHAVTATQKTVDGPSKKDWRGGRAAGFNIIPSSTGAAKAVGKVIPELNGKLTGMSFRIPTANVSVVDLTCRLEKPASYEEIKAAMKAASEGPMHGILGYTEDSVVSSDFIGDSRSSILDANAGIALSDTFVKLVSWYDNEWGYSCRVLDLITHMDKSS

SEQ ID NO: 42360 - protein, 102 aa, Triticum aestivum
  misc_feature (63)..(63): Xaa can be any naturally occurring amino acid
  misc_feature (69)..(69): Xaa can be any naturally occurring amino acid
  misc_feature (84)..(84): Xaa can be any naturally occurring amino acid
  misc_feature (92)..(92): Xaa can be any naturally occurring amino acid
  misc_feature (95)..(95): Xaa can be any naturally occurring amino acid
  unsure (1)..(102): unsure at all Xaa locations
MAAHHQQQQQPQPQQQSQQQAVGFEDYLPVMAERLGEEGLMEELAAGFRLLMDPASGLITFHXLRRNAXPLLGLGGMSDDDLRXMLAEGDFXGDXALSQMEF

SEQ ID NO: 42361 - protein, 410 aa, Burkholderia pseudomallei K96243
MKSPNVSRQTFDEVMVPVFSPAPFIPDRGEGSRVWDTEGRDYVDFAGGIAVTALGHGHPELLKVLDEQSRKLWHIGNGYTNEPVLRLAKRLESLTFADRAFFANSGAEANEAALKLARRVAFERHGADKYEIVSFLQSFHGRTFFTVSVGGQSKYSEGFGPVPEGIKHLPFNDIAAAQAAIGPKTCAVIVEPIQGEGGVIPADPAFLKALREACDAHGALLIFDEVQTGVGRTGHFYAYMDTGVTPDILTTAKALGNGLPIGAMLTTEALAAHFKVGVHGTTYGGNPLASAIAEKVVELVGDPALLEGVKQRSARLTATLEKINARFKLFKEIRGKGLLIGAELVGALDGRAKDFVSAAAEHGVIMLIAGPNVLRFAPSLVIPLDVLDEGLARFEKAVEQVLAQAEAAPR

SEQ ID NO: 42362 - protein, 149 aa, Aspergillus fumigatus
VAGVPGMVGGMLRHLRSLRRMKRDNGWIETLLEEAYNERMHLLTFLKLAEPGWFMRLMVLGAQGVFFNGFFLSYLISPRTCHRFVGYLEEEAVITYTRAIKDIETGKLPDWEKLDAPEIAVQYWNMPEGQRKMRDLLLYVRADEAKHRE

SEQ ID NO: 42363 - protein, 393 aa, Cytophaga hutchinsonii ATCC 33406
MDNDHLTTLNLGPTHPATHGVFQNILKMDGERIVDAVPTVGYIHRAFEKIAERRAFYQITTLTDRMNYCSAPLNNMGWHMTVEKLAGIELPKRVEYMRVVIMELSRIADHLICNSILGVDAGAFTGFLYIMQSREQIYEIFEEICGARLTTNMGRIGGFERDFNDIAMRKIDKFLADYPAVLTEFENLFNRNRIFMDRTIGTGGITAERALNYGFTGPNLRAAGVDYDVRVTSPYSSYQDFDFTIPIGINGDTYDRFMVRNKEMWESLSIIRQAMEKIKALPKGVFHAEVPDFYLPPKEDVYSQMEALIYHFKIVMGETEIPKGEVYHSIEGANGELGYYLVSDGGRTPYRLHFRRPCFIYYQAYPEMIKGQLISDAVVTMSSLNLIAGEMDA

SEQ ID NO: 42364 - protein, 565 aa, Pseudomonas putida
MIENFWKDKYPAGITAEINPDEFPNIQAVLKQSCQRFADKPAFSNLGKTITYGELYALSGAFAAWLQQHTDLKPGDRIAVQLPNVMQYPVAVFGAMRAGLIVVNTNPLYTAREMEHQFNDSGAKALVCLANMAHLAEKVVPKTQVRHVIVTEVADLLPPLKRLLINSVIKYVKKMVPAYSLPQAVRFNDALALGKGQPVTEANPQANDVAVLQYTGGTTGVAKGAMLTHRNLVANMLQCRALMGSNLHEGCEILITPLPLYHIYAFTFHCMAMMLIGNHNVLISNPRDLPAMVKELGKWKFSGFVGLNTLFVALCNNEAFRALDFSSLKITLSGGMALQLSVAERWKAVTGCAICEGYGMTETSPVAAVNPAEANQVGTIGIPVPSTLCKIIDDAGNELPLGEVGELCVKGPQVMKGYWQREDATAEILDSEGWLKTGDIALIQADGYMRIVDRKKDMILVSGFNVYPNELEDVLAALPGVLQCAAIGVPDEKSGEVIKVFIVVKPGMTVTKEQVMEHMRANVTGYKVPRLIEFRDSLPTTNVGKILRRELRDEELKKQGLKKIA

SEQ ID NO: 42365 - protein, 297 aa, Bacteroides fragilis NCTC 9343
MIQTRLKGMGVALITPFKEDESVDYDALMRLVDYLLQNNADFLCVLGTTAETPTLSEEEKKKIKKMVIDRVNGRIPILLGVGSNNTRAVVETLKNDDFTGVDAILSVVPYYNKPSQEGIYQHYKAIASATELPIVLYNVPGRTGVNMTAETTLRIAKDFQNVIAIKEASGNITQMDDIIKNKPANFDVISGDDGITFPLITLGAVGVISVIGNAFPREFSRMTRLALQGDFANALTIHHKFTELFNLLFVDGNPAGVKSMLNAMGMIENKLRLPLVPTRITTFEAIRKVLNELNIKC

SEQ ID NO: 42366 - protein, 364 aa, Salacia nitida
VQSQKLAVRAISQIQSLPGGDIKLLCDTVVESVRDLTGYDRVMVYKFHEDEHGEVVAECKRPDLEPYIGLHYPATDIPQASRFLFKQNRVRMIVDCHASPVRVIQDDGLMRPLRLVGSTLRAPHGCHAQYMENMGSIASLAMAVIINGNDEEVIGGRNPTRLWGLVVCHHTSARCIPFPLRYACEFLMQAFGLQLKMELQLAAQLLEKHVLKTQTLLCDMLLRDSPTGIVTQSPSIMDLVKCDGAALYFQGNYYPLGVTPTEAQIKDIVEWLLAFHGDSTGLSTDSSADAGYPGAALLGDAVCGMAVAYITNRDFLFWFRSHTAKEIKWGGAKHHPEDKDDGQRMHPRSSFKAFLEVVKRRSLP

SEQ ID NO: 42367 - protein, 622 aa, Burkholderia pseudomallei K96243
MCGITGWIDFARDLRNEAPIVDTMTDTLARRGPDARGVWLDTHAALGHRRLSIIDPERGAQPMLTPERGPRGLPRAVISYAGETYNFRELRAELGALGHRFDTHCDTEVVLRAYLEWGAAFVDRLNGMYSIAIWDTARDELLLVRDRLGVKPLFYYPTADGVIFGSEPKAILAHPDVRARTSSEGLCDALLFLRTPGQVPFSGMREVKPGHVLRVRRGGLAEQRYWALEARPHTDDLPTTIATIRALLDDIVSRQMISDVPLCALLSGGVDSSTIAALAQKRRRASGGGALSTFCVDFTGHTRNFRADPIRPTADAPFALEVARHIGSDHHTIELDQAGLLDPQVREAVLRAWDLPFNFADLDVSLHRLFAEVRKHATVALSGEAADEIFGGYLWFSDPAARRAHTFPWLKLGAHRGLDPRALFHRSFIDALRLGEYEAQLYRAALAEVPRLDGENAEDRRTRELHYLTLTRWLPVLLDKKDRMGMASGLEGRVPFCDHRLVEYVFNIPWAMKTFSGQEKALLRAAAADLLPESVLNRKKAAYPSIQAPGYDRGLIERLNRAIAAGRAPLEPFIDAGALRGLTEKTAAGSLSEFERILLESSSRLNDWLDLYRVELDGVPAG

SEQ ID NO: 42368 - protein, 374 aa, Salaciopsis glomerata
ALSIAGAVQSQKLAVRAISQLQSLPGGDIKLLCDAVVESVRDLTGYDRVMVYKFHEDEHGEVVAESKRSDLEPYIGLHYPATDIPQASRFLFKQNRVRMIADCHASPVRVIQDDGLMQPLCLVGSTLRAPHGCHAQYMENMGSVASLAMAVIVNGNDEEVIGGRNATRLWGLVVCHHASVRCIPFPLRYACEFLMQAFGLQLNMELQLAAQLSEKPVLKTQSLLCDMLLRDSPTGIVTQSPSIMDLVKCDGAALYYQGNYYPLGVTPAEPQIKDIVGWLLAFHGDSKGLSTDSLADAGYPGAALLGDAVCGMAVAYITNRDFLFWFRSHTAKEIKWGGAKHHPEEKDDGQRMHPRSSFKAFLEVVKSRSFPWEN

SEQ ID NO: 42369 - protein, 312 aa, Mesorhizobium loti MAFF303099
MTDYTKLIDAETWAFIERTNSYYPPDTIDYTITQQREIYDRMCREFFAGYPQGVTVETSAIATPTHDIPIRIYRSAPQPAATVLCIHGGGFMLGGLDSHDDVCAELCARTGYEVVSVDYRLAPEHLHPAAFDDAMTAFAWVASTRDRPILLCGDSAGGNLCAAVSHATRGHVKRPVGQVLIYPGLGGDRSKDSYVTHAEAPMLTMRDLEFYKHIRTGGQDRSGDATLAPLADTDFANLPPTVLVTAQCDPLSSDGETYRDRIIAAGGRATWFEEPGLVHGYLRARHTVGRARESFTRIVGAAAALGQGAWLW

SEQ ID NO: 42370 - protein, 369 aa, Schaefferia frutescens
ALSIAGAVQSQKLAIRSISQLQSLPGGDIKLLCDTVVESVRELTGYDRVMVYKFHEDEHGEVVAESKRPDLEPYIGLHYPATDIPQASRFLFKQNRVRMIVDCHASPVLVIQDDGLMQPLCLVGSTLRAPHGCHAQYMENMGSKASLAMAVIINGNDEEVTGGRNATRLWGLVVCHHTSARCIPFPLRYACEFLMQAFGLQLNMELQLAAQLSEKHVLKTQTLLCDMLLRDSPTGIVTQSPSIMDLVKCDGAALYYQGKYYPIGVTPAEAQIKDIVEWLLAFHGDSTGLSTDSLADAGYPGATLLGDAVCGMAVAYITNRDFLFWFRSHTTKEIKWGGAKHHPEDKDDGPRMHPRSSFKAFLEVVKSRS

SEQ ID NO: 42371 - protein, 363 aa, Simicratea welwitschii
QSQKLAVRAISQLQSLPGGDIKLLCDTAVESVRDLTGYDRVMVYRFHEDEHGEVVAESKRPDLEPYIGLHYPATDIPQASRFLFKQNRVRIIVDCHASPVSVIQDDGLMQPLCLVGSTLRAPHGCHAQYMENMGSIASLAMAVIINGNDEEGMGGRNPTRLWGLVVCHHTSSRCIPFPLRYACEFLMQAFGLQLNMELQLAAQLLEKHVLKTQTLLCDMLLRESPTGIVTQSPSIMDLVKCDGAALYYQANYYPLGVTPTEAQIRDIVEWLLACHGDSTGLSTDSLADAGYPGATLLGDAVCGMAVAYITNRDFLFWFRSHTAKEIKWGGAKHHPEDKDDGQRMHPRSSFKAFLEVVKSRSLP

SEQ ID NO: 42372 - protein, 350 aa, Bacillus cereus ATCC 10987
MKALLWHNQRDVRVEEVPEPTVKPGAVKIKVKWCGICGTDLHEYLAGPIFIPKEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 42373 - protein, 355 aa, Prochlorococcus marinus str. AS9601
MALNYYKNELKENAQLLASKGKGILAVDESTKTVGKRLAGIGVENTEDNRKAYRGMLFTTQGLGKYISGAILFEETLYQNHQDGESMVKKLNDLGIIPGIKVDKGLNPLPGGGDVETFCSGLDGLVERAAKYYEQGARFAKWRAVLQITNDGCPSKLSIQENAWGLARYARSVQESGLVPIIEPEILMDGDHTIEKTAEVQEEVIKQVYIACQANGVFLEGTLLKPSMTVNGADCPTKADPMKVAEMTIRTMERCVPASVPGIVFLSGGLSEEAASVYLNNMNTLYRKALWNVSFSYGRALQHSCLKAWKGSDVEGGQKALIARAQANSEASKGAYVAGSQPSSDEQLFVAGYTY

SEQ ID NO: 42374 - protein, 435 aa, Ustilago maydis 521
MLSSGAGSSIRKKRNFKGLQLAESPLASPVDASATTPSHKPGEGSAASNASTIGKSSAVTPGGSLALPVKNGLDTEPNSGANYHNKLTQQLANLELGVEYKLDLKNEDLKTLSELGAGNGGTVTKVLHEKSGTVMAKKVVFIDAKPSVRKQILRELQILHECNSPYIVSFYGAYLNEPHICMCMEFMQKDSLDGIYKKYGPISPEICGKIAVAVSHGLTYLYDVHRIIHRDVKPSNILVNGAGQIKICDFGVSGELINSIADTFVGTSTYMSPERIQGDQYSVKSDVWSLGVSIIELALGRFPFAENEEDDDSDADNNYTNEDLAGTLSPTKPAPMISLGQNEKQRRRKSKPAGVSLEGSSHQMSILDLLQHIVNEPPPKLPEGRFPKHMEEFVNLCLLKDPAKRPTPKDLTKHQYVIDADAAKVDLQAWADGMK

SEQ ID NO: 42375 - protein, 393 aa, Candida albicans SC5314
MILKTSSLLRSAVQPRQWLRYTSTVAPLEASKLIVEKTSNPKPKLPKDKLVFGKTFTDHMLEIEWTKEKGWHTPKISPYHNLSLDPSTIVFHYAFELFEGMKAYKDTNGNIRTFRGDKNMIRMNKSAERIALPTFEGEELQKLIDKLLLLDQDFVPEGKGYSLYLRPTLIGTTASLGVGTPDRALLFVIASPVGPYYSSGFKPVSLEATDYAVRAWPGGVGDKKLGANYAPCVKPQLEAAQRGFHQNLWLFGDEGYVTEVGTMNCFVAFENDDGTKELVTAPLDGTILEGVTRDSILELARERLPSDEWTVSERKYTIYEIEEKANKGQLIEAFGAGTAAVVSPINNIGFRGKNIKVPVALGNSGELTATVAEWIRKIQYGEEEFKNWSRVAK

SEQ ID NO: 42376 - protein, 628 aa, Rumex palustris
MNTCDCVDTQWFADDLLIKSQYISDLFIVLAYFSIPLELIYFVQKSALFPYRWVLIQFGAFIVLCGTTHLINLFTFSMHSKTLAVVMAIAKMSTAAVSCITALMLVHIIPDLLSVKMRESILRRRADELDREMGLILSQEETGRHVRMLTHEIRSTLDRHTILKTTLVELGRTLGLEECSLWMPSQTGMTLKLSHALQNLTPVGSCVSLNLPVITEIFNNPGVVRISHTCPLVSTRPISGRYLAPEVAAIRVPLLNLSNFQINDWPDVSGRTYAVMVLVLPCDGLRKFRKHELELIEVVADQVAVALSHAAILEESMRAHDQLLEKNVALDLARQEAELAIRARNDFLAVMNHEMRSAMHAIITLSSFLLETELTPEQRVMIEIILRSSNILATLINDVLDLSRLEDGSLELDSLTFNLHAVFKKVINLLKPITCVKKLSLTLAVAPEAICVVGDEKRLVQTILNVVGNAVKFTKVGKISIIVSVAKPDSLSSWQPADVIYAAVSKGQFYLRVQVKDTGCGINPQEIPHIFDKFYQSQNCRRNSTDSGLGLAICKRFVNLMGGQIWVESEGLDKGSLVTFVVKMGICRNPDERSINQAASTGHMNQSSTDLLGDSSMSFSLKRFEKSC

SEQ ID NO: 42377 - protein, 249 aa, Xylella fastidiosa 9a5c
MRPKIVAGNWKLHGSHAFAQALVAQVAAGLPLLGVSVIILPPLLYLSDLAQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 42378 - protein, 207 aa, Zea mays
MAATAATTSSSHLLLSSSRHLASSSQPRILFQRSLFSGGKRAGKNHHAAGGVRCMAVAADASAEAKPAARKKSGYELQTLTGWLLRQEQKGEIDTEMTIVMSSIAMACKQIASLVQRAGISNLTGVQGAVNIQGEDQKKLDVVSNEVFSNCLRSSGRTGIIASEDEDVPVEVEKSYSGHYIVVFIPPEGNPKSKAAPRESHLRNGMP

SEQ ID NO: 42379 - protein, 746 aa, Oryza sativa (japonica cultivar-group)
MSGAALVAIAASIGNLLQGWDNATIAGAVLYIKKEFKLESEPTVEGLIVAMSLIGATIITTFSGPVSDWIGRRPMLILSSILYFLSSLIMLWSPNVYVLLLARLIDGFGIGLAVTLVPLYISETAPSEIRGLLNTLPQFSGSGGMFLSYCMVFGMSLLPSPDWRIMLGVLAIPSLFFFGLTIFYLPESPRWLVSKGRMAEAKKVLQKLRGREDVSGEMALLVEGLEVGADTSIEEYIIGPAIEPADEHVVDGDKDQITLYGPEEGQSWIARPSKGPSILGSVLSLTSRHGSMVNQSVPLMDPIVTLFGSVHENMPHAGGSMRSTLFPNFGSMFSVTDQHPKVDQWDEENLHRDDEEYASDGAGGDYEDNVHSPLLSRQTTSAEGKDIAHHAHRGSALSMRRRSLLEEGGEAVSSTGIGGGWQLAWKWSEREGEDGKKEGGFKRIYLHQEEVPGSRRGSVISLPGGGDAPEGSEFIHAAALVSQPALYSKDIIEQRMSGPAMIHPSEAAAKGSSWKDLFEPGVRRALLVGVGIQILQQFAGINGVLYYTPQILEQAGVAVLLSNLGLSSASASILISSLTTLLMLPSIGLAMRLMDISGRRFLLLGTIPVLIASLVVLVVSNVIDLGTVAHAALSTISVIIYFCCFVMGFGPIPNILCAEIFPTRVRGICIAICALTFWIGDIIVTYSLPVMLNAIGLAGVFGIYAVVCSIAFVFVFLKVPETKGMPLEVITEFFAVGAKQMQATKA

SEQ ID NO: 42380 - protein, 287 aa, Zea mays
MRAKVIEFEKFTLVVLVGCITWRRCGVSTCGEAMPRPSVAPSLQLQARPCPRWPRRKHCPPSSVASRRVACSASAADADVVDLFDAAKLTVDKFVTSGMVVGLGSGPASALAIQYLGTRLRRGSLAGITAVTSSVLSASEADKAGIRANSYQEGTQIDFAFTDAEAIEEGTLAAVIGRRKTESGEPSFMAEKAMAKSAHKLAFITGNDKYVTTGVEGSIPVLIKSVWRRPSFGTAGPLGGDHPLVTKEGHHVLDVIFTTPIQDLGQVAEKLDKVDGVVDHGIICSNQ

SEQ ID NO: 42381 - protein, 431 aa, Bacillus cereus ATCC 10987
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPKFQGVDSILLAAGILGATVMPHAIYLHSALTQRRVVGTNDEQKKKIFRFEFIDIIIAMVIAGAINASMLIVAAALFFKNGLHVEDLDVAFNQFSTLVGPVSAALFGIGLLSAGLSSSSVGTMSGDIIMQGFIRMHIPLYLRRFITMIPPLVIIALGVNPTYALVMSQVVLSFGIAFALVPLIMFTSNKKIMGALVNHRITTLIAWIIAILVIILNIFLLYQTFVG

SEQ ID NO: 42382 - protein, 444 aa, Deinococcus radiodurans R1
MPNPNALPGAAHLSGAGAAQTGSPMKTRIAGKTILAIVLAGGRGSRLSPLTDERAKPAVPFLGTYRLIDFTLSNLVHSGINDVWVIEQYLPHGLNDHLSGGRPWDLDRTRGGLVVMPPFASAENEEGEFAQGNAHALAQHAHLIREFGADLVLVLSADHVYRLDYSDVIRQHVERGASVTMVTTELADEQQATRFGNVRAAKNGKVSEFAYKPDEPLGKTVTAEVFVYDAHIMLSTLEALSKEGELGDYGEELLPALVARGDAHAFPMHGYWMDVGTLDAYLQTHRDFLDGKGFALDDPQWPFITSSISRPPTRIEKTARLDEALVCGGAVIAGEVVRSLIAPNAVVEAGAVVRDSVVQPGAVIRAGAQVSRAVVDQDAEVGPGSRVGGQTGNSRPTVVGAHAHLGPGVQVGPGQVVAPRTRVKAGEEGQKVQELDADDKAGKK

SEQ ID NO: 42383 - protein, 363 aa, Simicratea welwitschii
QSQKLAVRAISQLQSLPGGDIKLLCDTAVESVRDLTGYDRVMVYRFHEDEHGEVVAESKRPDLEPYIGLHYPATDIPQASRFLFKQNRVRIIVDCHASPVSVIQDDGLMQPLCLVGSTLRAPHGCHAQYMENMGSIASLAMAVIINGNDEEGMGGRNPTRLWGLVVCHHTSSRCIPFPLRYACEFLMQAFGLQLNMELQLAAQLLEKHVLKTQTLLCDMLLRESPTGIVTQRPSIMDLVKCDGAALYYQANYYPLGVTPTEAQIRDIVEWVLACHGDSTGLSTDSLADAGYPGATLLGDAVCGMAVAYITNRDFLFWFRSHTAKEIKWGGAKHHPEDKDDGQRMHPRSSFKAFLEVVKSRSLP

SEQ ID NO: 42384 - protein, 802 aa, Mesorhizobium loti MAFF303099
MKFTLSWLKDHLETDASLDEIVERLTSIGLEVEHVDDKSSLKPFVIAKVLTAVQHPDADRLRVLTVDTGDGKSPVQVVCGAPNARAGLIGAFAAPGTYVPGIDVTLTVGKIRGVESHGMMCSERELELSDEHNGIIDLPADAPVGTSFASYAHLDDPVIEINLTPNRPDATSVYGIARDLAASGLGTLKSAAVEKIPGKGETPVKVVIEAPELCPGFALRLVRGVKNGPSPKWLQQRLIAIGLRPISALVDITNYVTFDRGRPLHVFDARKVAGNLVVRRAHDGEKVMALDGREYTLTPDMCAIADDNGVESIAGVMGGEHSGCDENTTDVLIESALWDPITTARTGRTLGIITDARYRFERGVDPEFMVPGVELATRLVLDLCGGEPAETEVVGYAGHKPKIVSFPISEVTRLTGIEVPKEESLDILSRLGFKPQGSSEVVDVALPSWRPDVDGKADLVEEVMRIHGVDNIAPQPLGAHDAVNSKILTTLQVRTRTAKRALAVRGMMEAVTWSFIPAKHAELFGGGQTALKLANPIAADMSDMRPSLLPGLIAAAQRNADKGIGDVALFEVSGTYEGDGADQQRRVAAGVRRGTAKLDGSGRSWAGNSGPVGVFDAKADAIAALEACGAPVERLQIEAGGPAWYHPGRSGTIKLGPKTVLGTFGEFHPKTMEGLDVSGPLCGFEVFVDAVPEPKAKPTKTKPKLELSAFQAVKRDFAFVVDKAVEAGTLVRAALAADKKLITAVSVFDIFEGASLGADKKSIAIEVSIQPVEKTLTDEDFEALAKRVVENVGKQTGGVLRG

SEQ ID NO: 42385 - protein, 294 aa, Shewanella sp. MR-7
MINGSIVALITPMNSDGSVDFASLERLVEFHIDQGTDAIVAVGTTGESATLPMNEHVTVVAQTVKFAAGRIPVIGGNGANATSEAIELTKSLSKVGVAAMLGVTPYYNKPTPKGLVAHYKAVAASTDIPQILYNVPGRTAVDMKPETVAELVGVSNIIGVKEATGDVSRVKRLRELCGNDFMLYSGDDATAREFLLLGGNGVISVANNIVPKAFKAMCDAALAGNAELAASIDEPLRGLYSTLFCEANPIPVKWAAHRMGLIECGHIRLPLTELSEQCHGLLLDAMTRAQIEVK

SEQ ID NO: 42386 - protein, 483 aa, Brucella suis 1330
MLALKDPSLLKSQCLVNGRWIDAADGTTIKVTNPADGSVIGTVPSLSVATIKEAIDASAKALSGWAAKTAKERAGILRKWFDLIIANADDIALIMTSEQGKPLAEARGEVLYAASFIEWFAEEAKRVYGDTIPAPQNGQRLTVIRQPVGVTAAITPWNFPAAMITRKAAPALAAGCTMIVRPADLTPLTALALGVLAEKAGIPAGVLQIVTGKAREIGAELTSNDTVRKLSFTGSTEVGRLLMAQCAPTIKRISLELGGNAPFIVFDDADLDAAVDGAMVSKYRNAGQTCVCANRIYVQRGVYDKFAEKLAAKVKELKVGNGTEPGVVIGPMIEEKAITKVKAHIEDAVSKGAKLITGGKELGGLFFEPGILTGVTSDMLVAKEETFGPLAPLFAFDTEEEVIAQANDTIFGLAAYFYTENFSRAIRVSEALEYGMVGHNTGLISNEVAPFGGVKQSGLGREGSKYGIEEYLETKYICSAYKR

SEQ ID NO: 42387 - protein, 377 aa, Ricinus communis
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYMFTTTAEREIVRDMKEKLAYAALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 42388 - protein, 415 aa, Mycobacterium bovis
LSHLCSRGSKVGELAQDTRTSLKTSWYLLGPAFVAAIAYVDPGNVAANVSSGAQFGYLLLWVIVAANVMAALVQYLSAKLGLVTGRSLPEAIGKRMGRPARLAYWAQAEIVAMATDVAEVIGGAIALRIMFNLPLPIGGIITGVVSLLLLTIQDRRGQRLFERVITALLLVIAIGFTASFFVVTPPPNAVLGGLAPRFQGTESVLLAAAIMGATVMPHAVYLHSGLARDRHGHPDPGPQRRRLLRVTRWDVGLAMLIAGGVNAAMLLVAALNMRGRGDTASIEGAYHAVHDTLGATIAVLFAVGLLASGLASSSVGAYAGAMIMQGLLHWSVPMLVRRLITLGPALAILTLGFDPTRTLVLSQVVLSFGIPFAVLPLVKLTGSPAVMGGDTNHRATTWVGWVVAVMVSLLNVMLI

SEQ ID NO: 42389 - protein, 374 aa, Siphonodon celastrineus
ALSIAGAVQSQKLAVRAISQLQSLAGGDIKLLCDTVVESVRDLTGHDRVMVYKFHEDEHGEVLAESKRPDMEPYIGLHYPATDIPQASRFLFKQNRVRMIVDCHASPVRVIQDDGLMRPLCLVGSTLRAPHGCHAQYMENMGSTTSLVMAAYINGNDEKATGGRNATKLWGLAVCHHTSARCIPFPLRYACEFLMQAFGLQLNMELQLAAQLSEKHVLKTQTLLCDMLLRDSPTGIVTQSPSIMDLVRCDGAALYYQGNYYPLGVTPTEAQIKDIVEWLLAVHGDSMGLSTDCLADAGYPGSALLGDAVCGMAVAHITNRDFLLWFRSHTAEEIKWGGAKHRPKDKDDGQRMHPRSSFKAFLEVVKSRSLPWEN

SEQ ID NO: 42390 - protein, 487 aa, Nocardia farcinica IFM 10152
MSGRHGYFTADEVRAAEAELFTRVPAGVPMQRAAHGLARVVAEELRERTGGIAGRAVTLLVGSGDNGGDALWAGAKLRARGVAVTAVLLDPDRAHRAGLAALRRAGGRVRTDLGEPDLVVDGIVGISGRGPLRPAAARLVAEVDAPIVAADLPSGVDPDTGAVTGPAVRAEVTVTFGAYKPVHVLAAPWCGRIELVDIGLRLPEPRLAALAPALIGAAWPVPGPADDKYTQGVTGICAGSATYPGAAVLCTGGAVAATSGMVRYAGTGAEQVLARFPEVIAAPDVRASGRVQAWVVGPGAGTDAAARERLAEILATDLPVVVDADGLTLLARDPDLVRGRAAATVLTPHAGEFARLTGRPVGDDRVGAVRELAESWGATVLLKGRATLVAQPGRRVLVNEAGGSWAATAGAGDVLSGVIGALLAAGRDPAWSAAAAARAHALAAALAAHDRGPVGAPVSASPLLHQLPAAIRTLRALGEVGAEPHPA

SEQ ID NO: 42391 - protein, 357 aa, Prochlorococcus marinus str. AS9601
MKNYKIVLLSGDGIGPEISEVSKKVLKKLSKNHNFDIEIIEKLFGGIAYEKYGTPAPDETLDQCKKSDAVLLACVGDIKYDSLARELRPESGLLKLRSALNLFANIRPVKIRKSLLEASTLKKEIVENVDLIVVRELIGGIYFGKPRGHITNTKIPKAFNTMVYDLTEIERITEIAIKIANQRNKKICSVDKSNVLEVSQLWRDTVLNITSKDKNISLSNMYVDNAAMQLVRDPGQFDVILTSNLFGDILSDLAAMLTGSIGMLPSASLNNNGPGVFEPVHGSAPDIAGKNIANPIAMLLSASMMLKIGLNEEEAAENLETAIDKVLSKGFRTADLADGSTEVLSCSEIGDKIMYEI

SEQ ID NO: 42392 - protein, 374 aa, Siphonodon celastrineus
ALSIAGAVQSQKLAVRAISQLQSLAGGDIKLLCDTVVESVRDLTGHDRVMVYKFHEDEHGEVLAESKRPDMEPYIGLHYPATDIPQASRFLFKQNRVRMIVDCHASPVRVIQDDGLMRPLCLVGSTLRAPHGCHAQYMENMGSTASLVMAAYINGNDKKATGGRNATKLWGLAVCHHTSARCIPFPFRYACEFLMQAFGLQLNMELQLAAQLSEKHVLKTQTLLCDMLLRDSPTGIVTQSPSIMDLVRCDGAALYYQGNYYPLGVTPTEAQIKDIVEWLLAVHGDSMGLSTDCLADAGYPGSALLGDAVCGMAVAHITNRDFLLWFRSHTAEEIKWGGAKHRPKDKDDGQRMHPRSSFKAFLEVVKSRSLPWEN

SEQ ID NO: 42393 - protein, 435 aa, Xylella fastidiosa 9a5c
MNQIRQAPATSASNATESKQEIRNYTMNFGPQHPAAHGVLRLILEMDGETVVRADPHIGLLHRGTEKLAESKPFNQSIGYMDRLDYVSMMCNEHAYVRAIETLIGIQAPERAQYIRTMFDEITRILNHLMWLGSNALDLGAMAVMLYAFREREELMDVYEAISGARMHAAYYRPGGVYRDLPDTMPKYKQSRWHKGKALKRLNAAREGSMLDFLEHFADTFPQRIDEYETLLTDNRIWKQRTVGVGVIEPDVAKAWGMTGVMLRGSGVAWDLRKKQPYAKYDAVDFDIPLGTCGDCYDRYLCRVAEMRESNRIIKQCVQWLKVNPGQVMVENFKVAPPKRESMKDDMEALIHHFKLFSEGYCVPAGETYSAVEAPKGEFGCYLISDGANKPFRVHLRAPGFAHLSSMDAVVRGYMLADVVAMIGTYDLVFGEVDR

SEQ ID NO: 42394 - protein, 367 aa, Brassica napus
  misc_feature (185)..(185): Xaa can be any naturally occurring amino acid
  misc_feature (199)..(199): Xaa can be any naturally occurring amino acid
  unsure (1)..(367): unsure at all Xaa locations
MQALSIFVVSLLLTLSYRGEATGSVFFIDGSNNQYLRPPSDQALPMSLSQVSAAVSALLGFSPPATLTPDGSSKLNKILRPNPFERPRAAFVLEIAGADDALVKETLPSHSFLGNAVRGSISSDSDNAAIELPESGVAVMSANGPSSDVTDKDMNEFASWLGGSYVAGSAEPLTGLLSIPLSGGXNVDFHLEKEAARKXFASNLLALYKNIRGVVNLREDLSHGIERPAELTVGRFGGIDALAHEYGQGMAKQGMDVLLATLSKLFNLLETSHKGQIVGVIVLDERVNQESANLLSVESSSRSSARSMAEVEGVPSGAIIAQVILVRLTLAWLTGIILLIATILGVYFLMYMPLTKDTLLYSNVKLD

SEQ ID NO: 42395 - protein, 163 aa, Xylella fastidiosa 9a5c
MMNRVMHYFKSLLLLELLAGLWLTLKYTFRPKYTVLYPMEKFPQSPRFRGLHALRRYPNGEERCIACKLCEAVCPALAITIDSAKREDGTRRTTRYDIDLFKCIFCGFCEESCPVDSIVETHILEYHFEKRGENIVTKPQLLAIGDRFEAEIAERRAADAAFR

SEQ ID NO: 42396 - protein, 168 aa, Gossypium barbadense
MAFPAKKFITSSLFGFTLLVALVAFLLKFNSSQKLFTVEELALYNGTGDSLPILLGILGSVFDVTKGKSHYGAGGGYNHFAGRDASRAFVSGNFTGDGLTDSLRGLSSTEVHSVVGWRDFYFRSYKFVGRLVGRYYDSQGNPTKYLKGAEAKAARGAQLLEKQKEMEG

SEQ ID NO: 42397 - protein, 385 aa, Zea mays
MEIVATRSPACCAAVSFSQSYRPKASRPPTTFYGESVRVNTARPLSARRQSKAASRAALSARCEIGDSLEEFLTKATPDKNLIRLLICMGEAMRTIAFKVRTASCGGTACVNSFGDEQLAVDMLANKLLFEALEYSHVCKYACSEEVPELQDMGGPVEGGFSVAFDPLDGSSIVDTNFTVGTIFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLMEKAGGYSSDGKQSVLDRVINELDERTQVAYGSKNEIIRFEETLYGSSRLAASATATARALI

SEQ ID NO: 42398 - protein, 344 aa, Nocardia farcinica IFM 10152
MGIESSCDETGVGIVRWHPDGTCELLADEVASSVDQHARFGGVVPEIASRAHLEAIVPAMRRALSAAGIAKPDALAVTIGPGLAGALLVGVAAAKAYAAAWDVPFYALNHLGGHVAVDTLEHGPMPPCVALLVSGGHTHLLHVTDLAAPIVELGSTVDDAAGEAFDKVARLLGLGFPGGPALDAAARDGDPHAIAFPRGMTGPRDPRYDFSFSGLKTAVARHVEAAQRAGVAIADLPIPDIAASFQEAVADVLTMKAVRAAQDMGVDTLVLGGGATANSRIRSLAEERCAAAGLTLRVPKPRLCTDNGVMIAALGAHVIAGGARPSPLTVASDPGLPVSVSQIA

SEQ ID NO: 42399 - protein, 463 aa, Bacillus cereus ATCC 10987
  misc_feature (244)..(244): Xaa can be any naturally occurring amino acid
  misc_feature (260)..(260): Xaa can be any naturally occurring amino acid
  misc_feature (276)..(276): Xaa can be any naturally occurring amino acid
  unsure (1)..(463): unsure at all Xaa locations
MQHTNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFXRILLFYVGALFVMMAXYPWNELGEKGSPFVLXFQQIGIAKAAGIINFVVLTAALSSCNGGLFSTGRMLYTLAQQKKAPERFGRLNKNGIPSQGIVATAIVLLVGVILNYLVPAKVFTWLTSISTFGAIWTWGIILVAQIKFRKSLPTQNKQKLSYKMPLYPLSSYFSLAFLALVLCIMAYSEDTRIALIVGPIWLIGLAVVYYMKGFHKIDETPNSKIS

SEQ ID NO: 42400 - protein, 71 aa, Glycine max
  misc_feature (12)..(12): Xaa can be any naturally occurring amino acid
  misc_feature (29)..(29): Xaa can be any naturally occurring amino acid
  misc_feature (36)..(36): Xaa can be any naturally occurring amino acid
  misc_feature (56)..(56): Xaa can be any naturally occurring amino acid
  unsure (1)..(71): unsure at all Xaa locations
GDAYVSVGRDRXFEALGKTYTQDVICHLXFSFGIEXYDVTREKAIVRKEKHLEEEXVDEDEEVIYKIEVPA

SEQ ID NO: 42401 - protein, 518 aa, delta proteobacterium MLMS-1
MDIHSEKILILDFGSQYTQLIARRVREAHVYCEIHPYDMDFAEVQAFAPQGIILSGGPWSVYDDGAPALDERLLELGVPVLGICYGMQVMARHFGGEVVDAGKREYGQAEITAQEGAGELFDGFFIEAKSPVWMSHGDHIARLPEGFTVAAATANAPVAAIQDDKRRLYGVQFHPEVNHTPRGEILLDTFIRKICRCHGHWTPGRIIDDAVARIKEQVGDDRVVLGLSGGVDSSVAAALIHRAIGEQLVCVFVDTGLLRLGEGDQVMATFAENMGVKVIRVDAEERFMGALAGVEDPEAKRRVIGNMFITIFEEAAGELANTHWLAQGTIYPDVIESAGGKTGKAQNIKSHHNVGGLPEQMQLKLLEPLRELFKDEVRAIGDELGLPRQMVWRHPFPGPGLGVRILGEVKKEYADILRQADAIYIDELFENGWYDKISQAFAVFLPVRSVGVMGDGRTYENVVALRAVETKDFMTATWSRLPYELLGKIAGRIINEVRGVNRVVYDISSKPPSTIEWE

SEQ ID NO: 42402 - protein, 481 aa, Bradyrhizobium sp. BTAi1
MEMFIDGRWVGALGGATFDVLDPATGETIDSVPEAGPADVDAAIRSAEMAFQAWKATPVAERARLQKAAARLMRENAEQLGRLLTRELGRPLAGAITEIQRSAELLDVYAEEGLRLHAEMPLTGVAGEKIIITREPAGVVIAITPFNYPVTLLCFKLGAALMAGCTVVAKPAEDTPLSTLRLAELFRKAGYPTGCFNVVTGRGPDVGMQMIAHPTPRKIAFTGGTQAGKAIAAAAAGTMKRVTLELGGQCPAIVCADADIGAASAAIARHAFANSGQFCYRVNRVYVERPVYTRFLDALADRVLQLDVGNGLTSTCALGPLVNEKIYRNSDRQIADARASGATILTGGARLTGGLYDKGWFLPPTVIADAGPSSLIMTEETFGPVLGVAPFDHHSEALRLANATIYGLAAFVFSRNLATGLTLAERLEAGSVWINDIQRSNQRAPFGGMKQSGIGREKGRYGVEDYLEYKTIYLTYDAELR

SEQ ID NO: 42403 - protein, 441 aa, Photobacterium profundum SS9
MIGFLTSEQPTKIITDKQQIDATYKYWRLHLMFSMYIGYGMFYFTRKSLNFAMPAMLADLGLEHSDIGFLGTLFYITYGVSKFVSGMVSDQSKPSYFMGLGLIATGIINIAFGLSSSLAMFAILWTLNAFFQGWGWPPCAKLLTTWYSRTERGFWWSIWNTCHNLGGALVPLGIGFTAMTLGWRYGFIIPGILAILVGIVLCFRMRDKPTTMGLPTVGQWRNDELELLQEQEGRGLSFRQILKTYVIGNKYIWLLCSSYFLVYVVRIAINDWGNLYLIERHGFDLFSANAAVSMFEVGGFLGSLFGGWGSDRFFHGNRAPMNLIFALGIFISVAALWLTPMNNFSVLACCFFSIGFFIFGPQMMIGMAAAECSHKGVAGTATGFVGLFGYLGAALASYPISLVIEQFSWDGFFSIITFSAASIGLLILPFVKAQQPSITAT

SEQ ID NO: 42404 - protein, 134 aa, Saccharomyces cerevisiae
MARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLAAIHAKRVTIQKKDIKLARRLRGE

SEQ ID NO: 42405 - protein, 492 aa, Campylobacter lari RM2100
MSQKCILIITDGIGHNENKEFNAFFHAKKPTYDELFKNTPNVLIKTSGLAVGLPEGQMGNSEVGHMCIGSGRIIYQNLVKINKAIENNTLKDNKALKELLQKCNRVHIIGLYSDGGVHSMHTHFNALLKICKEENKEVFAHAISDGRDCSPISGLNFIKSLQEFCEKEKINLASLSGRFYAMDRDKRYDRIKLYYDALFAKAPKSDDFITYIQKSYDENITDEFLTPVINPSFDGIKAEDGVVFINFRNDRMRQLVASLTQENFDEFPRELLVKNAITMSLYDEKFNLSIMFEKEELNNTLASVIANANLSQLHTAETEKYAHVTFFFNGGKEELEVNETRVLIPSSKVKTYDEKPCMSAKEVANEVIKGIKGGIDFIVVNFANGDMVGHTGDFEAAIRAVESVDECLGEVIKVARENDYAFIITSDHGNCEAMKDENNNSLTNHTTFDVFAFVEAKGVEKLKEGMGLSNIAPSVLKILNLPIPKEMDEALF

SEQ ID NO: 42406 - protein, 247 aa, Campylobacter lari RM2100
MKFSGKNVLITGASKGIGAAIAKELASNGLKVWINYRSKPELADALKEEIEKNGGSAAVIKFDASVEEEFVNAIATIVESDGELSYLVNNAGITNDKLALRMSMDDFSSVINANLNSSFLGCREALKTMSKKRFGAVVNIASIVGEMGNAGQTNYSASKGGMIALTKSFAKEGAARNIRYNCITPGFIKSDMTEVLSDEIKQNYINNIPLKRFADASEVAQAVAFLLSDHSSYITGEILKVNGGLYM

SEQ ID NO: 42407 - protein, 180 aa, Triticum aestivum
  misc_feature (72)..(72): Xaa can be any naturally occurring amino acid
  unsure (1)..(180): unsure at all Xaa locations
KISPKAAPAAVLPLPSVKVTAAPVQAPAAKEKKANGKDKEGFQTIEMTEKFNCRSKDIYEILMDDNRWKGFXTQSNARISKDVGGQFSLFDGSITGVNEELQEGKLIVQKWWFGSWADGVHSTVRLVFDEPESGVTIIKLKQTDVPEEDRYGNSTVVENTEKGWKELIFQRIRAVFGFGV

SEQ ID NO: 42408 - protein, 281 aa, Azoarcus sp. BH72
MDSVPSKPTLLERLSSMLSREPEDRDELLVLLHAALERGLLDADAFSIIEGALQVSELQVRDVMVSRSRMDVIRLADPMERIAEFVIDTAHSRFPAVGESKDDVVGILLAKDLLRYFAGREFNLREMLRPAVFVPESKRLNVLLREFRVSHNHMAIVVDEYGGVSGLITIEDVLEQIVGDIEDEYDFDEIGARIRLDHKGRYRVQASTEIEDFNAAFGTRCHEEDVDTIGGLILRRLGRLPVRGEVIDVDGLRVQVLRADSRRIHTLLVERLPQVSDVTAN

SEQ ID NO: 42409 - protein, 209 aa, Triticum aestivum
  misc_feature (41)..(41): Xaa can be any naturally occurring amino acid
  misc_feature (55)..(55): Xaa can be any naturally occurring amino acid
  misc_feature (91)..(91): Xaa can be any naturally occurring amino acid
  misc_feature (151)..(151): Xaa can be any naturally occurring amino acid
  unsure (1)..(209): unsure at all Xaa locations
MTSVWKTKVLPGLNKIFDKDGKKAAAAEFLKSFNKEEIGQXRLEDKKTELDPRLXETIEASPPKKFKGLMKDKKTSKIKKNSVAVTKFLGXLAKIDFPRTKLVSDAVAKSGTTPLSPAIVFILDKVAPFVPAPKEEPKAEPEAAAPAEETXTREVAVEEKEEEAEPSAAPAEADRRQRLCSMRILWILERDEAGENRRRKRQLLAAGDQ

SEQ ID NO: 42410 - protein, 524 aa, Nocardia farcinica IFM 10152
MAETQRPVLVVDFGAQYAQLIARRVREASVYSEVVPHTATVEEIAAKKPLAVILSGGPASVYAEGAPQLDPRLFDLNLPVFGICYGFQAMAQALGGTVAHTGTREYGRTELNIDGGVLHGGLPTIQPVWMSHGDAVTDAPEGFEVTGTTAGAPVAAFEDRARRLAGVQYHPEVLHSPHGQQVLSRFLHELAGIPASWTPSNIADVLVEQVRAQVGDGHAICGLSGGVDSAVAAALVQRAIGDRLTCVFVDHGLLRAGEREQVQQDFVASTGAKLVTVDAVDKFLGELKGVTDPEEKRKIIGREFIRSFEDAVRQIVDEQGAAEGKQPEVEFLVQGTLYPDVVESGGGTGTANIKSHHNVGGLPEDLEFELVEPLRLLFKDEVRAVGRELGLPEEIVARQPFPGPGLAIRIIGEVTADRLATLRQADAIAREELTAAGLDRQIWQCPVVLLADVRSVGVQGDGRTYGHPIVLRPVSSEDAMTADWTRLPYEVLERISTRITNEVAEVNRVVLDVTSKPPGTIEWE

SEQ ID NO: 42411 - protein, 169 aa, Triticum aestivum
  misc_feature (58)..(58): Xaa can be any naturally occurring amino acid
  misc_feature (72)..(72): Xaa can be any naturally occurring amino acid
  misc_feature (92)..(92): Xaa can be any naturally occurring amino acid
  misc_feature (107)..(107): Xaa can be any naturally occurring amino acid
  unsure (1)..(169): unsure at all Xaa locations
MAPTVMASSATSVAPFQGLKSTAGLPVSRRSNGASLGSVSNGGRIRCMQVWPIEGIKXFETLSYLPPLSTEXLLKQVDYLIRSKWVPCLQFXKVGFIFREHNASPGXYYDGRYWAMWNCLFPEHRPTRCQVEERRIPDPSHNGKISVHANYPTTGQDRKAKVSHRHLSH

SEQ ID NO: 42412 - protein, 428 aa, delta proteobacterium MLMS-1
MTIRQDAINGKLTPIFQQCAEHEQVSAETLMAGVAAGTICIPKNRHHDFTRITGIGQGLKTKVNANIGSSKDHPELANELQKLCICMKAGADAVMDLSMGGEISAIRREILQNCPVPLGTVPIYQSIAQCVEREGKKIGEVSVDHLFRTIEEQARDGVDFMTVHCGITRDTLARVNNHQRLLGVVSRGGSFTIEWMSYNQQENPLYEHFDDLLAILREHEVTLSLGDGIRPGCLADATDRGQVQELIHLGELTQRAWEAGVQVMIEGPGHVPLGQIEANVLLQKRLCHNAPFYVLGPLVTDIAPGYDHITGAIGGAIAAAAGADFLCYVTPAEHLKLPSPQDVHDGVIASRIAGHAADIAKGVPGAMEQDIEMAKRRGALDWKGQIEMSIDPEKARRYREEGNTYTGDACSMCGSFCAIKVYKQATRR

SEQ ID NO: 42413 - protein, 766 aa, Oryza sativa (japonica cultivar-group)
MMLHHEASVQQAREEEEELDHHGDPMITSPLLRPSTSGSSPENGEEENSPVELVALTVPVSDEPETPVLTFRMWVLGTASCAVLSFLNQFFWYRKEPLTITAISAQIAVVPLGRLMAATLPEHAFFRGRPWEFTLNPGPFNVKEHVLITIFANSGAGTVYAIHVITGVRVFYGKTLSFFISLLVVLTTQYHQMLGFGWAGIFRRYLVEPASMWWPSNLVQVSLFSALHEKEARRKGGLTRNQFFLVAFVCSFAYYIFPGYLFQMLTSLSWICWVFPSSVLAQQLGSGLRGLGVGAIGLDWSSISSYLGSPLASPWFATVNVGVGFFIVMYIITPIAYWFNFYKAQNFPIFSDGLFTSTGQKYNVSSIVDSHFHFDTKAYEKNGPLYLSTSLLVTYGVGFATLAATIVHALLFHGSEIWLLSKSAFQEKRMDIHTKLMRRYKQVPEWWFICILIANIGTTIFACEYYNEELQLPWWGVLFACSIAFFFTLPIGIIKATTNQTPGLNVITEYIIGYLYPGRPVANMCFKVYGYISMKQALAFLEDFKLGHYMKIPPRTMFMAQVVGTSIAAFVYIGTAWWLMETIPNICNTELLPSDSPWTCPGDHVFYDASVTWGLISPRRIFGDLGTYSALNWFFLCGAIAPLLVWFAHKTFPGQNWILLIKTPVLIGATFQMPPATAVNYTTWILVGFLSGYVVYRYRRDWWERHNYLLSGALDAGLAFMAVLIYLCLGLEDISLNWWGNDLDGCPLASCPTAKGIVVKGCAVYT

SEQ ID NO: 42414 - protein, 471 aa, Bacillus cereus ATCC 10987
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGIPYAADIMNFVIITAVLSVANSGLYANSRMLWAMAKQGMASPAFTKLTKKGVPLNALIFSLIFASLSLLTSIFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQISLKKEVN

SEQ ID NO: 42415 - protein, 547 aa, Archaeoglobus fulgidus DSM 4304
MPVVTLYWDELERLVGADRDTILSRLPMLGCDIERVEDDHVDVEFFPNRPDLYSVEGVARALRGFLGIEKGLKSYSAVKGEWKITVEESVLAVRPRIVGCVVKGIRMTDEVIRSLMEVQEDLHWTIGRNRRKMAIGVHDLSKVYFPLRYKAVDANFSFVPLDFDREMTVAEILEEHPKGKAYAFILEGKDSYPMIVDSKDEVISFPPIINAEKTRVTEETTDLFIDVTGFDENVDRAIAILACMLADRGGRIESVEVVYPDHVELTPNLDVRFMEVDVDEVNSLLGLSLSAEEIKESLEKMRFSCEIEGEKLKVGIPPYRADIMHEWDVIEDVAIGYGYENITPEIPPTLTFGRTHPWNDIRSLAKEIMIGLGFTEVITFTLTNEAVMYEKMRRKGEPWKDYVPVMHPLTTEHTILRTSLLPKLLELLSYNKHHEMPQMVFEVGDVVVNSKNRLHLAACITHSRANFSEIRSYVQAVMRELDLTWEVRESDDEAFIDGRRAEIVVDGKAVGVFGEVHPEVLEGFELTMPVSAFEIDLSAFFDTGELL

SEQ ID NO: 42416 - protein, 1500 aa, Oryza sativa (japonica cultivar-group)
  misc_feature (77)..(77): Xaa can be any naturally occurring amino acid
  unsure (1)..(1500): unsure at all Xaa locations
MEKVWESGRRMSRSIGRGMGMEAWGVDEAFMPQNSGGGGGSRGRRRSGRGGTADDDEEALRWAAIERLPTYSRMRTXILSFAEEEAAAAAAGAGKQQYKEVDVRRLGVGERQEFIERVFRVAEEDNQRFLQKLRNRIDRVGIELPTVEVRFEELMVQARCHVGSRALPTLLNTARNIAEAALGLVGVRPGRQATLTILRGVSGAVRPSRMTLLLGPPSSGKTTLLLALAGKLDPSLRRGGEVTYNGFELEEFVAQKTAAYISQTDVHVGEMTVKETLDFSARCQGVGTKYDLLTELARREKEAGIRPEPEVDLFMKATSMEGVESSLQTDYTLRILGLDICADTIVGDQMQRGISGGQKKRVTTGEMIVGPTKVLFMDEISTGLDSSTTFQIVKCLQQIVHLGEATILMSLLQPAPETFELFDDIILLSEGQIVYQGPREYVLEFFESCGFRCPERKGTADFLQEVTSKKDQEQYWADKHRPYRYISVSEFAQRFKRFHVGLQLENHLSVPFDKTRSHQAALVFSKQSVSTTELLKASFAKEWLLIKRNSFVYIFKTIQLIIVALVASTVFLRTQMHTRNLDDGFVYIGALLFSLIVNMFNGFAELSLTITRLPVFFKHRDLLFYPAWIFTLPNVILRIPFSIIESIVWVIVTYYTIGFAPEADRFFKQLLLVFLIQQMAGGLFRATAGLCRSMIIAQTGGALALLIFFVLGGFLLPKAFIPKWWIWGYWVSPLMYGYNALAVNEFYSPRWMNKFVLDNNGVPKRLGIALMEGANIFTDKNWFWIGAAGLLGFTMFFNVLFTLSLVYLNPLGKPQAVISEETAKEAEGNGDARHTVRNGSTKSNGGNHKEMREMRLSARLSNSSSNGVSRLMSIGSNEAGPRRGMVLPFTPLSMSFDDVNYYVDMPAEMKQQGVVDDRLQLLRDVTGSFRPAVLTALMGVSGAGKTTLMDVLAGRKTGGYIEGDMRISGYPKNQETFARISGYCEQNDIHSPQVTVRESLIYSAFLRLPEKIGDQEITDDIKIQFVDEVMELVELDNLKDALVGLPGITGLSTEQRKRLTIAVELVANPSIIFMDEPTSGLDARAAAIVMRTVRNTVDTGRTVVCTIHQPSIDIFEAFDELLLLKRGGQVIYSGQLGRNSQKMIEYFEAIPGVPKIKDKYNPATWMLEVSSVAAEVRLNMDFAEYYKTSDLYKQNKVLVNQLSQPEPGTSDLHFPTKYSQSTIGQFRACLWKQWLTYWRSPDYNLVRFSFTLFTALLLGTIFWKIGTKMGNANSLRMVIGAMYTAVMFIGINNCATVQPIVSIERTVFYRERAAGMYSAMPYAIAQVVMEIPYVFVQTAYYTLIVYAMMSFQWTAAKFFWFFFVSYFSFLYFTYYGMMTVAISPNHEVAAIFAAAFYSLFNLFSGFFIPRPRIPKWWIWYYWLCPLAWTVYGLIVTQYGDLEQIISVPGQSNQTISYYVTHHFGYHRKFMPVVAPVLVLFAVFFAFMYAICIKKLNFQHR

SEQ ID NO: 42417 - protein, 120 aa, Campylobacter lari RM2100
MANYPKAIGPYSAYREANGLLFISGQLPINPESGNIESEDVKEQTRQSLLNIKAILEENNLYFNNVVKTTCFLANIDDFVAFNEVYSEFFAAPYPARSAFAVKDLPKGAKVEIEVIAHKG

SEQ ID NO: 42418 - protein, 499 aa, Glycine max
MDYLLLLPLIITIVWINIHVFISSFKPLKSSKNPPGPRPFPIIGNILELGNQPHQALAKLSQIYGPIMSLKLGKTTTIVISSPQVAKEVLQKHDQIFANRMVPDCVRALDHHILSVAWMPPLPQWRALRRACATKVFSSQQLNFTQVLRQRKMQDLMDYVKERCERGEAMDIGEASFTTVLNSISNTFFSMDLAYYTSDKSQEFKDIIWGIMEEAGRPNVVDFFPIFRLLDPQGARRRMSGYFRKLIAFFDGLVEERLRLRALENGSRECNDVLDSLLELMLEDNSQVTRPHVLHLFLDLFVAGIDTTSSTIEWVMAELLRNPEKLEKVRQELQQVLAKGEQLEESHISNLPYLQAVVKETFRLHPPTPMLLPHKSEVDIELCGFMVPKSAQILVNLWATGRDSSIWTNPDEFTPERFLESDIDFKGHDFELIPFGAGRRICPGLPLASRTLHVVLASLLYNYDWKLTDGQKPEDMDVSEKYGITLHKAQPLLVIPIQA

SEQ ID NO: 42419 - protein, 256 aa, Pseudomonas syringae pv. phaseolicola 1448A
MPEFRNAAKALLDAPEIVVFTGAGISAESGISTYGDPLTGIWASYDPRNMETAKAFRGNPPLVWGWYLWRRQQVSKAAPNAAHLAVSRLAKSGYSVSVITQNIDDLHERAGSVDVLHLHGSLSTPKCFACHRPAEIPPSQVTSHIGGEVEPPRCVRCNGKLRPGLVWYGEDLPSDVWKSAIALVKSCDVLISVGTSGIVTPAADIPRIALSYGATVIHVNTEDVSTGAQNELMLIGKATEVFKKLCALLPSGEQAL

SEQ ID NO: 42420 - protein, 358 aa, Rickettsia rickettsii
DISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLAAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAVVLKETCKEVLKELGQLDNNPLLQIAIELEAIALKDEYFIERKLYPNVDFYSGIIYKAMGIPSQMFTVLFAI

SEQ ID NO: 42421 - protein, 331 aa, Azoarcus sp. BH72
MDPIAPGTAPTHRAAELARHVLRVEAAAVAALAERVGDDFERAVELILGRSGRVIVTGIGKSGHIARKLAATLASTGTPAYFVHAAEAAHGDLGMITPEDVVIALSNSGASEELLMIVPLVKRQGARLIALTGRPDSPLAREADVHLDGAVSEEACPLNLAPTASTTAALALGDALAVALLDARGFGPDDFARSHPGGSLGRRLLTHVSDVMRPAPEVPVVGREAALAEALLAMTRGGMGMTVVADPDGRPLGIFTDGDLRRALEKGIDVRAARIADLMTPQPRHISPDALAAEAAEVMERQRISQLLVLDAAGKLAGALTTHDLMLAKVI

SEQ ID NO: 42422 - protein, 137 aa, Triticum aestivum
  misc_feature (71)..(71): Xaa can be any naturally occurring amino acid
  misc_feature (89)..(89): Xaa can be any naturally occurring amino acid
  misc_feature (93)..(94): Xaa can be any naturally occurring amino acid
  unsure (1)..(137): unsure at all Xaa locations
MAPAVMASSATTVAPFQGLKSTAGLPVSRRSSGSLGRVSNGGRIRCMQVWPIEGIKKFETLSYLPPLSTEXLLKQVNYLIRSKWVACLXFNKXXFVFRWQKNSPRVTKNGILGQCWKLPNSGWQNNRLVKRWGRKVP

SEQ ID NO: 42423 - protein, 336 aa, Pyrobaculum aerophilum str. IM2
MSVVGSFEQLERLRDLFYKLLDLRDTLRERGVAWPKPLSEEAALGTVRVKVGFPAMLKRGVIMDVTNVEQAQIAEDAGAVGVMVLDKLPYDVRRAGGVARMADLKVIEEVMAHVTIPVSAKVRIGHYYEAFLLEQVGVDLIDESEVLTPVDEQHHINKWMFTVPFVNGARELCEALRRISEGASMIRSKGEAGTGNVAEAVKHFKSIYGAIKSLAAGDEERVRDFARQCQVPFELVALTAKLQRLPVITFAAGGIATPADAALMMWLGADGVFVGSGIFKSQDPRERAEAIVLATAHWDDPETVVEAQKMVSERGAMMGIDIRTLKPEELLQTRGV

SEQ ID NO: 42424 - protein, 540 aa, Lactococcus lactis
MRAHEILNNPFLNKGTAFTMKERQELGLIGLLPPTVQTIEEQAVQTYEQYLTKPSDLEKRHFLMEIFNTNRTLFYYLFNKHIVEFNPVVYDPTIADTIENYSHLFVDPQYAAYLDINHPENITETLKSAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKRADYKDAGDMTDLLNVVKTVKPTILVGTSTNPGAFTKEVVEAMCANTERPVIFPISNPTKKMETTAEQVIEWSDGKAFVATGVPSGTISYKGVDYQIGQANNSLIHPGLGLGMLASEAKLLTDEMIGAAAHSLSGLVDPGKPGAPVLPPFEFVADVSIKVAEAVAKKAQEQGLTESKETDMAKAVRDLKWYPEY

SEQ ID NO: 42425 - protein, 203 aa, Triticum aestivum
AWASKLVKSVTGADLPAQPVHTLVCYWRVKPGHEEELTTEAGFPTFATYGEPGFYGTPSMEYPGLIKVCRNGGPPCDPDGRDWATGTGAGGIAEIVARWIDEFMPGVVDTAGGPVLRQPCMCCMTPDEDFVIDFLGGEEFGKDVVIGAGFSGHGFKMGPAVGKILAELALDGESGTAAEAGLELEHYLIGRFEGNPMGNATSH

SEQ ID NO: 42426 - protein, 393 aa, Mesostigma viride
MTMLQTKTDPMVISMGPHHPSMHGVLRLIVTLDGENVIDCEPVLGYLHRAMEKIAENRTIVQYLPYVTRWDYLATMFTEAITVNAPEKLANIEVPKRASYIRVIMLELSRIASHLLWLGPFMADIGAQTPFFYILREREMIYDLFEAATGMRMMHNYFRIGGVASDLPYGWVDKCLDFSDYFLPKVDEYERLITNNPIFLKRVRDVGFISREEAINWGLSGPMLRASGVQWDLRKVDNYECYGELDWNVQWQSDGDCLARYLVRLGEMRESTKIIQQALKAIPGGPYENLEARRLSKGRKSEWNNFEYQFVGKKPSPTFKIPKQEHYVRVEAPKGELGVFLMGDDNVFPWRWKIRSPGFINVQILPELVRGMKLADIMTILGSIDIIMGEVDR

SEQ ID NO: 42427 - protein, 361 aa, Nocardia farcinica IFM 10152
MSKIVLFGATGYTGRLTAAELVARGAVPVLAGRDAAALAALAVELGGAPTAVADVGDPASVRALLGRGDVLVTTVGPFLRHGRPALDAAIDAGAHYIDSTGEGPFIRSVFERHDRAVATGSVLLSAFGFDYVPGNLAAGLALREAPDAARVEVGYFIDRPGTSGGTRASIAGMLFESGFALRGGALVDERAGARLRRFDVAGATRAGVSIPASEQLALPRSYPNLREIDVFLGVPELAGRGMQATSVLTAAVGHLPPLERGLRAGVTALVRGSTGGPDAASRARTRSWVTARTFDAAGLPRATVTLAGGDPYDFTARIMAWAADTVRDDGVSGTGALGPVDAFGLDPLHAACAEAGWRPAR

SEQ ID NO: 42428 - protein, 381 aa, Oryza sativa (japonica cultivar-group)
MATFSGTDRLRDLQAFDNTKAGVKGLVDAGVTAIPYFFRHHPDPLPIAAPSEAAAAILVIDLAKADVDRGHVVSQVRSAAETVGFFQVVNHGVAGELMEEMLAAVRRFHEEPLEAKVPYYTRDVASKVWFNSNFGLFRNGFRSPEANWRDTMFVEMFPEAPSPEEIPPPCRGVLEVYAAAVRRLGERLFELLSEALGLPVGYLGRDAGCMDGLSLSVAAHYYPACPEPEATMGATKHSDPSFLTVLLQDTSGGLQAVLPRPPEERWVDVPPVAGALVVNVGDLLQLVSNDRLRSVEHRVLPTGAAGPARVSVACFFRHAYASTRPCVPVVVGGGGARAAAVYRSTTAGEFLAHYNGKGLDGRSALDHFRLPAAASSPPPPL

SEQ ID NO: 42429 - protein, 302 aa, Nostoc punctiforme PCC 73102
MIDHSDRIASRKEGTFQGVGGLDLYYQSWHPEGKVRGILAIVHGLGAHSDRYSNVIQHLIPKQYAVYALDLRGHGRSPGQRGYINAWSEFREDLGAFLQLIQTQNPGCPIFLLGHSLGGVIVLDYILRYPQQASVLQGAIALAPTLGKVGISPIRVLLGKMLSRVWPRFTLNTGIDISAGSRDPQVLAAIAQDTLRHTLGTARLATEFFATVDWINAKAGDWQLPLLILHGGADRVALPAGSDIFYQRINYTDKLRIEYPEAYHEIQRDLNYREVMADLENWLERHLSSEVVQLGRGSAELE

SEQ ID NO: 42430 - protein, 579 aa, Photobacterium profundum SS9
MFIKWRDTMTVGKYLRWKDEAGNDFRPVALTGTELLNDRNLNKSTAFSYEEREAFQLVGLLPPKVQTFDDQLNRVYDGFRNASTDIEKYLFLRALQDRNETLFYALLSRHVEEMTPIIYTPTVGKACQEFSHRYQKARGLYITEDSVDQMGDMARHFTGKDIKIIVVTDSQGILGLGDQGVGGMGIPIGKLSLYTLGAGIHPAHCLPIALDVGTDNQDLLDDPMYLGMPRKRMRGEEYKIFIRKFVKQIQQHFPKAVLQWEDFSKSNAFDNLSDYEDDLPSFNDDIQGTGAVVLAGILGAVKIKEEKLADQTYVVYGAGAGGVGVADQIYAGLLKEGCSHSAAREKIFVLDSQGLVFDDREGLDEYKKRYAKPRELANNWQTKELGKVSLTELIDNHRVTVLLGTSGIGGAFKAEHVQKMMEYTKRPMVFPLSNPTANCEALPEDVYQWSDGQVIVATGSPFSDVNYNGREYRIGQGNNVFIFPGVGLASIVSGTPKITLDMFTMASYALADCISDDDLAAGCVFPRISKLKEVSMVVATRILENMQTTEPNSPLRGKNIQQELAMHMWEPAYLPYRRV

SEQ ID NO: 42431 - protein, 356 aa, Zea mays
MRPGGPPNSRALQPPGTPGRSRRRPDLTLPLPQRDLTSLAVPLPLPPPPSSAPSSGSLSAPASLGAPTPPTSAGAAPPNPPPLCELERVRRVGSGAGGTVWMVRHRPTGRAYALKVLYGNHDDAVRRQITREIAILRTAEHPAVVRCHGMYEQAGELQILLEYMDQGSLESHRIADERFLAHVARQVLSGIAYLHRRHIVHRDIKPSNLLIDSGRRVKIADFGVGRILNQTMDPCNSSVGTIAYMSPERINTDLNDGAYDGYAGDIWSFGLSILEFYLGRFPLGENLGKQGDWAALMFAICYSDSPQAPCNASPDFKNFISLCLQKNPVNRPSAMRLLQHPFVAQPQPQPLAAPPS

SEQ ID NO: 42432 - protein, 318 aa, Campylobacter lari RM2100
MSQIDAIKIAKEVFEIESKTILDLCDTLNEEFSKAVELILSIKGRCVVSGMGKSGHVGAKIAATLASTGTPSFFMHPGEALHGDLGMIASEDVLLAISNSGETEEVLKLIPVIKKRKIPLIVMAGDQNSTLAKQADVFINIAVKKEACPLQLAPTSSTTATLAMGDAIAVALMKARNFKPDDFALFHPGGSLGRKLLTKVGDLMVSSNLPIVSPNSEFNELVDVMTSGKLGLCIVVENEKLVGIITDGDLRRALRANDKPRFDFKAKEIMSESPKTIEASAMASEAEELMLKHKIKEIVVTQNEKIAGIIQLYAIGNV

SEQ ID NO: 42433 - protein, 509 aa, Magnaporthe grisea 70-15
MSLSTIIAQVALALIASVWIWRSITLYYRRRKLKLLHGCMPVTKIPDWDPIFGLGFTYTLIKSDINNHRLINNTVERLQTYGYTHMANVMRHRMFFTCEPENLKAIMHGQFDHFDNELRSVPAGHFMGMGIFLADGEKWQRSRALVRPNFARDQVADLGSLERHFQILLSIIPKDGSAVDLAPLFFAFTMDSITDFLFGESVKALQAHASGAHASSSPWSQKGIEQFAEAWEYAQNDMLFRFILGPARYVYQDKKANQCVKMIHAHVDRYVEQAVRFRNEELARGGDEKEPKSEGRYIFLQALAKQTQDRKVLRDELMNLLMAGRDTTAALLSNLFHTFARRPDVWAKLKNEVMFLEGRLPTYEDIRNMKYVRWCINEFGILGKQASFDTTLPRGGGPNGRSPIFLPKGSIVLYSMLAQHRRKDLFGEDALEFRPERWETLRPGWNYVPFNGGPRICVGQQYALTEASYLVVRFVQTFATVESRDPEPWSIGKRLLTCPMNGTIVSLSR

SEQ ID NO: 42434 - protein, 448 aa, Aspergillus nidulans FGSC A4
MFIGGLNWETTDQSLKEYFSQFGEVQECTVMRDSATGRSRGFGFLTFKDPKTVNTVMVKEHYLDGKIIDPKRAIPRDEQEKTSKIFVGGVSQEATEQDFKQFFMQFGRVIDATLMIDKDTGRPRGFGFVTFDSEAAVEAALSRPLEILGKTIEVKKAQPRGNLRDDGDRGRRGRDFRDGSQGGSDGSQQQAGAQGQGVMPGGLTPQMMAQYWQRMQQYFALMQQQMAVAATQGQGMGAMGMAGMNPALMQQMQMKQLQQMQMGNNQQSPSMSPPAQSPTPQSMQNMMNPAMMQQMQQQMPNQGQANNMGGQMGMGGNGSGNMNMGSNYAGGGRGGPGYNAHEQIAFEQQKYEQQQARRAMENRAFSPYQQGGPTSWEGMYDEVPQPNIPTGPQAMNRSSSVGRGQTPQPQGAAPANAPTGPKNAGKPGANYRGGGRGGHRGFHPYARG

SEQ ID NO: 42435 - protein, 349 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFELARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVEAFTATVGI

SEQ ID NO: 42436 - protein, 554 aa, Shewanella sp. MR-7
MCSIFSILDIQSDAKELRQVALEMSKLMRHRGPDWSGIYASDKAILAHERLAIVDIEHGAQPLLTEDGSLILAVNGEIYNHKELKAQLGDKYSYQTNSDCEVILALYQEYGTEFLDKLNGIFAFVLYDKAKDAYLIGRDHMGIIPLYTGRDAAGNFYVASEMKALMPVCKTVAEFQPGQYLYSTTGEPVQYYTRDWQSFDAVKDNAASQEELREALEAAVKRQLMSDVPYGVLLSGGLDSSVISAITQTFAKRRIEDDDQSGAWWPQLHSFAVGLKGAPDLAAAKKVADAIGTIHHEINFTFQEGLDAIKEVIYHLETYDVTTIRAATPMYLMARKIKAMGIKMVLSGEGADELFGGYLYFHKAPNAQAFHEELVRKLDKLHLFDCLRANKAMAAWGLEARVPFLDKEFMDVAMRINPEAKMSKDGRIEKHILRQAFEHKLPKEVAWRQKEQFSDGVGYSWIDGLKAHAAEQVDDLQLANAKFRFPYNTPETKEAYFYRCFFEEHYPLASAAETVPGGKSVACSTPEALAWDESLRGIIDPSGRAVRSVHAASY

SEQ ID NO: 42437 - protein, 234 aa, Solibacter usitatus Ellin6076
MYGNSRRGASRRDFAIFAAAAGLGRAAPQPQIGRRITADQALRDLLEGNHRFTLGKPATPRRSPKDFQQLAHAQFPEAVVVSCADSRVAPEILFDVGIGDIFVVRVAGNVIDGAGVTVKGSIEYAIAELNVPLILVLGHAGCGAVKSAIKHIDDRDALPGAINGLVELIKPAVTRSKGMPGDPLENAIRQNVAIGVERLRSLDPILSPRVKAGNVKVAGAVYNLQSGAVALTIG

SEQ ID NO: 42438 - protein, 127 aa, Xylella fastidiosa 9a5c
MSFQTIHTEKAPAAIGPYSQAVRVGNTVYFSGQIPLDPATGTIVVGDLAVQARRAFDNLRAVAEAANGSLSKIVRLGLYLTDLEQFAVVNAVMQEYFQAPFPARSTIQVSGLPKGADFEVDAVMVID

SEQ ID NO: 42439 - protein, 487 aa, Burkholderia sp. 383
MHIKQLYIDGAWQPAAAGGQRAIIDPATGEAIARVAYGSAADAGHAIRAARAAFDAGEWPHLPAEERAACLRRLANALRDEAPALARIETANTGKTLAESSSDVHDAASAFDYFASLAVTETGSMNAAKPHVISVTLREPVGVCGLITPWNYPLLQAAWKLAPALVAGNTVVVKPASLTPLSTHRLVELAHDAGLPRGVLNLVTGGADVGDALAASPQVDLISLTGSNAAGASVMRAAAGNFKRVSLELGGKNPNLVFADADVDTALDYALNAAFFNAGQMCSAGSRLLVERTLHDAFVDALAARIAAIRVGRGDDDATRMGPVISAQQRDRVLALIGEAARDGARIVCGGRAPAGDAFATGFWVEPTLIAGVRTTMAIAREEVFGPVLTVEAFDSEDEAVALANDTPFGLAGAVWTRDFARANRVMRRLRAATVWINDYNVTLPGAPWGGYKASGIGRELSRSGLDEYTELKHAYLNFEASPQRWF

SEQ ID NO: 42440 - protein, 405 aa, Photobacterium profundum SS9
MGGVLGMILAGGEGSRLRPLTDSRTKPAVPFGGSYRLIDFALNNFVNADFLKIYVLTQFKSQSLYVHMKKGWNITGITDRFIDPIPAQMRMGKRWYDGTADAIYQNLSFIELAEPEHVCIFGSDHIYKMDIKQMLNFHKEKEAELTVSALRMPLSEASAFGVIEVDENGCMVGFEEKPTNPKSIPGDPENALVSMGNYIFNKDTLCTELEEDAAKEDSSHDFGKDIIPKLFPLGKVYVYDFTTNIIPGEKNTGYWRDVGTIEAYWQAHMDLLSEDAPFSLYNRQWQLHTHYPPLPPATILDSENSKVDINNCMISAGSYIRGAQIHKSILGFRTNVDHNTMISESVILGDVKIGANCSIRKAIIDKNVHIAPGTVIGENPEEDKKNYHVSDEGIVVIPKGAKIGY

SEQ ID NO: 42441 - protein, 464 aa, Burkholderia xenovorans LB400
MTETTSVANVIDARPIGWLQLVIAAVGALALLCEGFDLQIISYVMPRIVQEWGIERARQGTILSAGYGGMLIGFLALAPLASRIGAKRLAVYCLLAMGVLNLGTLFATGGWMLIAFRVAVGLTLGGVVPPTLALVAEFFPTRHRSALIAMLYLGTTSGIMIAGVVAWLTLARYGWRGAMVVGGVMPIVAAIAVRLVWFESPVWLLSRGAAGAARVSVMLERLYPRMPSSNPVAAAEASTPDAGSVVHLFTERRLVGTLMLWLGLSCNAVVYFFALSWIPLILVGIGATQQNAILASTLANLGGIAAIVTGFLMDRYGRSRVVIGYFFAGAAFVLLVGAMLSPTVMVIAPTAFCLGYCVSGLQKGVSALAIEFYPSALRSAGVGWVLGVGRSGAILGPMVPGLLMQAGWPPAHVFYLMSVPLVLGGAGIALMQAWYRPRTSRDHALLHAVAPVHDDYPGTKVRTR

SEQ ID NO: 42442 - protein, 1961 aa, Aspergillus nidulans FGSC A4
MSNKSIFLRSIDDPAVARQYTEHKVQTTVARFAPSGFYVASGDASGVVRVWDCVGEGITKGEYSIVNGRINDLAWDGDSQRIIAVGDGKQRYGHCITWDSGNTVGEISGHTQAINAVSIRQQRPLRAAAAGDDKNVVFYHGAPFKFNTGIRDKHTNYIYGVGFSPDGSTLVSVGADRKIWLYDGKSGEVKGQIGEGEHKGSIFAVSWSKDSRKFVTASADKTVKIWDAEAGKVTQNWNIGGEGNQNFLNQQVGVVWPPGRSDNLLISLSLSGDLNYLVEGTPEPRQIIQGHQKNITSLTAFESSSGEETLWTGSFDGRVCGWDVPTGKAETIEGDGSSSYIAGLTSTQEGAGRLYSVAWDDTIRSLDIGAKTYTGSSSKLSGQPKGIAGGGTTVLVANAESIEIHRDGQKVGDFKPNFSVTAVAAHGSIAAIGGDDSTVQICDIAGTSLTPKHDFKASRDVVSAMAFSPDGSKLAIGDSRGRVLVYKVADGSLVNDRWTAHTSRITSIAWNDNGAHIVSGALDTNIFVWSLTNPGDWLQVSNAHKEGVNGVAWIAGGSKVASAGADAAVKLRQATFILPKTGQRLKGLVQLRNSHHNSDGHRDNEERRGLLSGELPPAAEGVVRRVRGKLEEQWTLLRRFVTSEPGIGVLKCSLAYLLGSLATFVPILTALLGHQDSKHMVATITVYFHPARSQGSMFKALVCACLAFIYTAFISITMFCGGGLGFIGWTKQRLNDPLVNVACSLASLSTISVLTKEGAVQAGDLSFTKISHVLKMIIMGVSATMTVSFLIFPISARKKLRSNLTSATETMATMLALITESFLSGSEEELQTAEFVNAAAQHKKAYGQLDSLVKEAKLEHYVRGTEKEYRLEKNLVRWVQDITHNLGGLRSAASMQFQLLKQTKPFGSPQPQSIGLSHQGVDVCRSISPWSMAEDRPYLEPIDERPEDDISEPDVLRPTLSRRQTSESEASAALLPADIFAIFIDHLGPSMEIFKEIPFGPAPSYKVTVDSRFITSLDRALELYKASREEALKSIYREKDIFKVKTLEIEADLEEVAASCGHFSFSLLEFGEQLKELLAILDELQLESEERPHGRSWNWLKFWRKNDLERRRFAESSPLRNSIAIPQPSYSSSQLQNSAPEFKKPFAKTRIGYQIWRSLSVFRRDDMKFAIKVGTGAALYACPSFITSTRPIYSHWRGEWGLLSYMLVCSMTIGASNTTGYARFLGTCLGAVCAILSWYITDGNALGLAFSGLMMATWTSYIIIVKRQGPMGRFIMLTYNLSVLYAYSLTQQDGQDDQDEGGDSPVITEIALHRVVAVFSGCIWGIIITRLIWPISARKRLKDGLALLWLRLSLIWKSGPLSATHSSKQQTEFMTARDKLEVERFLAHLESLQVSARSEFQLKQAFPDAVYTNLLAHTRNMVNAFVAMNLELAKNMTASQGELAILDYTVSERRHLSSRISHLLSFMASSMKMEYPLVDNLPNVEHARDRLLARLFHYRKNWEISKSSTDEDYSLLYAYDFIVIRLDSNRLPSRLRAARRVPVSLTSPTMQQIDLAALNRAAEDSASAVPPSRNAAPTQKSKALISVSRLDLGPPYLELKSRIGANWAEYKEAITLFLLGQLNQDELSSRIDPIICADPKTEHLHNNFICAIIANLTRDLPDHGVASWVSANDKPSVVSKPTSGDAAEQRLKTEVMQLPPRDRRRIKAIPERDPHDAVRNELEEYHLAKQIKLPSQVPASAGGLNMTNWELEVRKRYVQPLASETGEFPDAESIHARMTPICYEESVVNGAGVACAEFMAIATETFVKEVLSVVFSRTRCNGPSGTINGMMKRSYKQQLEREELAFTRGEIAKDGATGLLPVEAKEARTRSALGVRDLRLSLELGSGVLSHMPLLVDQIMGGYFEDELEADRRGRTDTNGTEPTDMDEMDVDEADWGWEGATAGDHQQLGTLLDECLAMAS

SEQ ID NO: 42443 - protein, 403 aa, Rhizobium leguminosarum bv. viciae 3841
MAKQKVAMLTAGGLAPCLSSAVGGLIERYSDIAPELEIVAYKSGYQGVLLGDSIEITRAMREKAPLLHRYGGSPIGNSRVKLTNAADCVKRGLVKEGENPLRVAAERLANDGITILHTIGGDDTNTTAADLAAYLAANGYDLTVVGLPKTVDNDVVPIRQSLGAWTAAEVGAHFFDNVGNEQTAAPRTLVVHEVMGRHCGWLTAATARAYLQRTSRNQYVDGLMMDAHLKSIDAVYLPEMAFDLEAEAARLKESMDRNGHATVFVSEGACLDAIVAEREAAGETVKRDAFGHVKIDTINVGAWFQKQFANLLDAERSLVQKSGYFARSAPANGDDLRLIQSMVDLAVESALNKVSGVTGHDEGQNGKLRTIEFPRIKGGKAFDLSTAWFAEVMDNIGQKYKEA

SEQ ID NO: 42444 - protein, 140 aa, Brassica napus
ICLYPEASPLCSSAVTNGVKVRASAVFVPEHPRRGHVGTHLYSYSIRLSVPEACMLGGVYFSSCQLHSRHWIIRCKDTVVSDMHGEGVIGEYPLLLPGQDEFVYESCTPLNGSSGSVEGSFTFVPGRLTQPEGKPFDVTV

SEQ ID NO: 42445 - protein, 506 aa, Deinococcus radiodurans R1
MSIVILDFGSQFTRLITRRFRELGAYSVILPGTASLERIQQENPQGIVLSGGPSSVYDEGAPRPAPGVLDLNVPILGVCYGMQYLAHEAGGDVKRAGKREYGKADLTEYGGRLFEGIQGEFVAWMSHSDSVTQLPQGYQVVARTEHTPVTAIENNDTRRYGVQFHPEVVHTPKGGQMLANFLDICGVTRDWNAEHIVDELIEGVRAQVGDTGRVLLGISGGVDSSTLALLLAKAVGERLTAVFIDHGLLRLGEREQVEAALTPLGVNLVTVDAKDEFLGQLAGVSDPEQKRKIIGREFIRAFERETAKLGDFEFLAQGTLYPDVIESAGGEGAANIKSHHNVGGLPDDVQFKLVEPFRTLFKDEVREIARLLGLPDHIRMRHPFPGPGLAIRCLGEVTAEKVDILQRVDDIFISGLREFGLYDGCSQALAVLTPIQSVGVMGDERTYSYTAALRAVTTDDFMTAEWARLPYDFLATMSNRIVNQVHEINRVVYDITGKPPATIEWE

SEQ ID NO: 42446 - protein, 149 aa, Glycine max
  misc_feature (141)..(141): Xaa can be any naturally occurring amino acid
  unsure (1)..(149): unsure at all Xaa locations
MASRNSSSVALFFALNILFFTLTVATDCGCSPSPKPKPVPSPKPPKHVPSPSVPSPSVPSPSVPHPNPRPATPPRTPGSSGNCPIDALKLGVCGNVLSGLLNIQLGQPSAQRCCSVIQGLVDLEAAVCLCTALRANVLGIXLNVLYLSA

SEQ ID NO: 42447 - protein, 480 aa, Arabidopsis thaliana
MAVSSSSFLSTASLTNSKSNISFASSVSPSLRSVVFRSTTPATSHRRSMTVRSKIREIFMPALSSTMTEGKIVSWIKTEGEKLAKGESVVVVESDKADMDVETFYDGYLAAIVVGEGETAPVGAAIGLLAETEAEIEEAKSKAASKSSSSVAEAVVPSPPPVTSSPAPAIAQPAPVTAVSDGPRKTVATPYAKKLAKQHKVDIESVAGTGPFGRITASDVETAAGIAPSKSSIAPPPPPPPPVTAKATTTNLPPLLPDSSIVPFTAMQSAVSKNMIESLSVPTFRVGYPVNTDALDALYEKVKPKGVTMTALLAKAAGMALAQHPVVNASCKDGKSFSYNSSINIAVAVAINGGLITPVLQDADKLDLYLLSQKWKELVGKARSKQLQPHEYNSGTFTLSNLGMFGVDRFDAILPPGQGAIMAVGASKPTVVADKDGFFSVKNTMLVNVTADHRIVYGADLAAFLQTFAKIIENPDSLTL

SEQ ID NO: 42448 - protein, 282 aa, Shewanella sp. MR-7
MGSVTTKKHANGLDYVEVNTALCQARIFLQGAQIDHFQPVGKPPLLWVSSADDYQPGNGIRGGVPVCWPWFGMSNQANFPQHGFARTRIWTLESVEMRNQLVDLRFSLTISEEDKVFWPHHTQVNVLFTLGETLSISLVNTNLGDVPVTLTQALHSYFPIEDIHQLKATGFSGAQYIEFAEGPYPQTTDDVLFDRETDRVYTKLGPVQHLHTPQGVIEVSRENSHSAVLWNPWIEKSTRLARFNDDDYLTMVCLEAANVLEDKLTLAPGESHSLVTHIRWAD

SEQ ID NO: 42449 - protein, 252 aa, Medicago truncatula
MASSTLISDTQPWKDLKDHVEDIKKTHLRDLLSNEERSKSMTVEFDGILLDYSRQQATLETTEKLFKLAEAASLKQKINQMYNGEHINSTENRAVLHVALRAPRDAVIESDGKNVVPDVWNVLDKIKEFSERVRSGSWVGATGKELKDVVAIGIGGSFLGPLFVHTALQTEPEAIESARGRTLRFLANVDPIDVAKTITGLNPETTLVVVVSKTFTTAETMLNARTLREWIISALGDLPIGYGDFTLWTLFE

SEQ ID NO: 42450 - protein, 134 aa, Papaver nudicaule
MKTLFVFTLLFFLCMSFSDGSRSRVQVRVMNRRGNGKTVEIHCQSGDDDLGNHVVPDGQEVNFSFRESFLENTRFWCDVQWSNEVKYHFDAYWSDRDRLGRCLSQCLWTMMEDGLYGYDQEKQVWELVHLAVKG

SEQ ID NO: 42451 - protein, 388 aa, Triticum aestivum
MPYLQPPRPHPHPHPTSRLSRASPPSPFPFFPAGTSRSGRLQPVPVSGHSASRVSKGKFAVAAVTLDDYLPMRSTEVKNRTSTDGIKSLRLITAVKTPYLPDGRFDLEAYDSLINTQINGGAEGVIVGGTTGEGHLMSWDEHIMLIGHTVNCFGANIKVIGNTGSNSTREAVHATEQGFAVGMHAALHVNPYYGKTSTEGLISHFKEVLPMGPTIIYNVPSRTSQDIPPPVIEALSSYSNMAGVKECVGHERVKCYTDKGISIWSGNDDECHDSRWKYGATGVISVASNLVPGLMHSLMFEGENAALNEKLLPLMKWLFCEPNPIGLNTALAQLGVVRPVFRLPYTPLPLEKRVEFVRIVEAIGRENFVGQKESRVLDDDDFVLISRY

SEQ ID NO: 42452 - protein, 1576 aa, Aspergillus nidulans FGSC A4
MARSRQPTRFSSEAPSESSSSTSPERAADDDTDFFTLQANDSQSSIGAGNPRDSHIQNDPETVLPPIAYLPPEILISIFSKLSSPRDLLSCLLKIAAAVGEEDSFFLYSSLIKRLNLSALTEDVSDGTVVPFSQCNRIERLTLTNCRKLTDIGVSDLVVGSRHLQALDVSELRSLTDHTLFKVAENCNRLQGLNITGCVKVTDDSLIAVSQNCRLLKRLKLNGVSQVTDKAILSFAQNCPSILEIDLQECKLVTNQSVTALMTTLQNLRELRLAHCTEIDDSAFLDLPRHIQMTSLRILDLTACENIRDEAVERIVSSAPRLRNLVLAKCKFITDRAVWAICKLGKNLHYVHLGHCSNINDSAVIQLVKSCNRIRYIDLACCSRLTDRSVQQLATLPKLRRIGLVKCQLITDASILALARPAQDHSVPCSSLERVHLSYCVNLTMVGIHALLNSCPRLTHLSLTGVAAFLREELTVFCREAPPEFTRQQREVFCVFSGEGVNRLRNHLNREAAPQRDANEATMYDDEEELDEDEGQPEQASPSSTGAFLLSGYCIGSGYTGSPILLIIICQPPIVGVPSGPVRPPLLPASVLSRLLRTLLKLKLSLSRDFVRQAQAPEPGVKTMDQTKPPRRNPLAFTPWPVTLITAVVYLAFVIPLLVIHHVVPSAPTSSPDGLNITEAWNDLQVLTAGYRPYNSRQNDKIHDWLLHRINEILGAAPPATTDEKKPDVFVFDDTRSNLTFARDNLAVYFEGTNILVYIRGEDDDQEQWWELPEGSPKGKGGVLVNAHYDSVSTGYGATDDGVGVVTCLQLVKYFTTPKNAPRKGLVVLFNNGEEDFLNGARVYSQHPLSRFPHTFLNLEGAGAGGRAVLFRSSDAEVAASYMRSKHPFGSVLGSDGFKAGLIRSQTDYVVFEGDMGLRGLDVAFLEPRARYHTDQDDTRHTSKDSLWHMLSTAVATTEDLVSDTSDRFDGPARNDHKIASGTGHQAVWFDLYGSTFVLFRLHTLFALSVTLLVVAPIVLLLTSIILTKVDKMYLFRTSIRPEGSLEVLPLYGDRGVIRYPFLLGIPTAVTIGLAYLLTKFNPYIVHSSQYAVWSMMVSVWIFLAWFVSRVADFARPSAFHRVYTLTWTFVVMWVLQVIATVYQDRWALGGSYFIFFAYAGTFLATWISYLELFALPRKSEYANHLRPVSRHASSHSSRRGLSEEDEEDEDEAPTESTSLLGSRQRTTFANYVRVNADTADLSDSEEHTQDVNVYGLEQRWSASLPKWLWLLQFLLAAPIVLILVGPIALLLTGSLHQTGQDGSSSLFIYIAIVALTTLLLSPMLPFVHRCTYHIPLFMLAVFAGTLIYNLVAFPFSDSNRLKLFFIQEVDLDTGLNTASLTGVQPFVHDVAVGLPSAAGQNVTCGPFGDRFKCSWTGIPPHVLTEDKPVEEWLSFEVSRSIDKPRHAQLQISGQNTRACKVVFDSPIKNFHVAGSAYDPRFPHTYAKGIKEIRLWSRVWDNTWTVDVEWFNPDSSSDHSKTSGSLTGQVVCLWSDYNQPGTIPALDEVRQYGPAWIGVSKLADGLVEGRKSFEIA

SEQ ID NO: 42453 - protein, 249 aa, Triticum aestivum
MRTMGLGLGAPFFLLVLLLLAAGTGAVPQDKRVRRNYVLLDLNTIEIRPNDKEEIASSKIPVSVESGSTVCSTCENLTNKAVSYLSEKQTQDEIMEILHGACSQTFSLEQKCLEMVDSYATLLFAKITEIKPDEFCKQYGLCRDVSFLSVAKSESTCTFCRHLVDEVLSKMRDPDAQFEILQLLIKECNKVKGHVQECKRMVLEYVPLILVNGEKLLEKKDVCTLMQACDASKTRAGGSFFDGELRSDA

SEQ ID NO: 42454 - protein, 159 aa, Brassica napus
MDNSAPDSLPRSETAVTYDSPYPLYAMSFSSSTHRIAVGSFLEDYNNRIDILSFDSDSMSLKPLPSLSFEHPYPPTKLMFSPPSLRRSGGGDLLASSGDFLRLWEVNEDSSSAEPVSVLNNSKTSEFCAPLTSFDWNDVEPKRLGTCSIDTTCTIWDVE

SEQ ID NO: 42455 - protein, 649 aa, Photobacterium profundum SS9
MFAKLAQAYPLGATLCDQGCNFSIHSTDNQEIKLVLFDIENKKTIIDFDHTHLDIHYTFVPNIKAGQVYGFQIKDKHNERLILDPYAQALNQTPFYVEPFTAEESWKFTKSVVIDHQFDWQNTVFPQVPYEETILCETHVKGFTQLQEHIEEQYRGTYLGLCQPAAIEFYKEQGITSLQLLPVTSCMSEPHLLKMDKVNFWGYNSLCFMAPEPRYAMSDAVTEMKTMVRELHKEGIEVIMDIVFNHTAEGGEGGPKFHLKCLDKHYYLLDSNKNHHNYTGCGNTVDLTYQPSLTLVIDTLRHWVTHYQIDGFRFDLAATLGRNGHRFDSQSAFFKAIEQDPILQKVKLIAEPWDVGPDGYQLGNFPRGWNECNDKFRDTVKSHWLGDKNNIKEFATRLMGSRDFFSAGGWPDKLPVNFISYHDGFTLQDLVSYNHKHNEANGERNLDGHGDNRSFNHGVEGKTDNLSVLYKRERQKRNLMTTLLFSFGIPHLLAVDSLSHTQGGNNNAYCQDNEISWANWILSPDNISFKNWLAGMVKARKEVMSPFIRAFSGRERGHHRIRWNHSNGKLMNTDDWQNLEAFALYLGLYKNGKELLFLINSSTIPTRYRLPAGGKWRIICDTSESVLGNRQTQTTYMQSTQSITILSRE

SEQ ID NO: 42456 - protein, 230 aa, Brassica napus
  misc_feature (208)..(208): Xaa can be any naturally occurring amino acid
  unsure (1)..(230): unsure at all Xaa locations
MKLTTVVTCFLLSSMCLLALFTFTHQPLEKGQKYSRRPRDKLLGGLLTEEFDEESCLSRYHSSFYRKPSPHKPSQYLLSKLRSYEMLHKRCGPGTKAYKEATKILGHHDSMSRSVGECKYIVWLAVYGLGNRILTLSSLFLHALLTGRIILLDQRTDIRSLFCEPFPGTSWLLPQDFPLTDQLDSFNKNGSHCYGTMLKNNTIKSTIXETVPSYLCLYLIHDYEDHDKMF

SEQ ID NO: 42457 - protein, 172 aa, Aspergillus nidulans FGSC A4
MALLRTSRPSRLESFIFSSFLLSSSFSLLSIRTISDPTWVSDLSSLTYYFIPSDIFRLRMSRKLAPEANRILFVKNLNYNVTAEQLFDLFGKFGPIRQIRQGIANNSKGTAFVVYEDVHDAKQACDKLNGFNFQNRYLVVLYHQPEKMLKSKEDLAERQENLERLKQQHGIE

SEQ ID NO: 42458 - protein, 524 aa, Aspergillus nidulans FGSC A4
MRKAEAIYHITANNQVLRRTYQETADRARGLAYFLKKHGYKRVGILCPNTPAFLESIFGIAAAGAVNVSVNYRLKEDDIAYIFTHSDAEIIIADKEYLPLLSAYRAAKPHVRVILDTDTDATEGQLAGPFDEAILEGLNYDRDTGRKGWSALESQAASEDDVIALAYTSGTTARPKGVEYTHRGCYLAAMGNIIESGLNFQGRRCKYLWTLPMFHAMGWTFPWAVTAVRGTHYCLRKIDYPQIWKLLKQEGVTHFNAAPTVNTLLCSSPEAEPLPEPVHVTVAASPPTPHLFEQMTGLNLHPVHVYGMTETYGPITKGYYMTAWENLPRKEKFARMARQGHGFLTSLPVRVIQTEVPEGTIIDVKQDGKEIGEIVFVGNICARGYYKDPEATRKLFAGGVLHSGDLAVWHPDGAIQILDRAKDIIISGGENISSVALESMLVTHPDILEAGVVAVPDSHWGERPKAFVTVKPGRQLKGKDVVDWARNTSGISKFMVPREVEVVAELPKTSTGKLRKNVLLWLDR

SEQ ID NO: 42459 - protein, 116 aa, Alteromonadales bacterium TW-7
MNKSMNKSPITTHILDTSTGKPAENVTVKLFVHTNNEWELIAQGKTNSDGRITDWLNTDIAFATYKLVFDLDSYYKKQPTPAFYPEAQITFRLQDQKHHHIPLLLSPFGYSTYRGS

SEQ ID NO: 42460 - protein, 166 aa, Alteromonadales bacterium TW-7
MSSLKINNLNAAQAHQALEHCCAAPNWVLGMLNTMPFKNKEHLFNSAQSVWDSLGESDYLAAFEGHPQIGDLSTLSKKYAATAQKAGHEQSGMSKANEQTLKKMIALNKQYLSKFGFIFIVCASGKSAEQMLELIEQRVHNTREKELTIAAGEQAKITKIRLESLL

SEQ ID NO: 42461 - protein, 687 aa, Blastopirellula marina DSM 3645
MAKLHLESLPLGTTNGGVFKLLIEEAGVNNRDIGRIQLQRRTAAIELPADVCGRTQRKLAESVPELVGWVEPDDVEQPALFRQFERCLNFEAKEQEERIANDPGSLRLKGLRLQDQWSALGGRMICRLTGKNPQARMPMHGLRVGSPIVLLSHNGEDRARGVVTRVFSTSLEVAIGGLWEGEEDKLSVAISTDEIARKRQERAMLKAASACGSRTAELRDVLLELQSPSFDERDESLASPQLNASQQAAVQLALSARDFSIIHGPPGTGKTITLAEIVRAAVARGEKVLACAPSNLAVDNLVERFWACGLKAVRLGHPARVSESLHDALLEALVREHPDAKLAEKLVSEAKTLFRKADRFTRSKPAPGEKRSLRDEARELLDDAARIQQQTLERLLDDAPVVCCTLTGVDDDLLGARRFDLAVIDEACQTTEPACWIPVSRSQRLVIAGDHCQLPPTIVSREAEAAGFGVSMLERLIARYPQAAQRLELQYRMHAHIMEFSSLEFYDGALLADPSVEAHSLTDLIAADELWAKPVQFFDTAGADYQEEQDDSSSRTNPREAELVVRKVNQLIALEMPPEQIAVISPYAAQVRLLRESLPGGVECDSVDGFQGREQEVVICSLVRSNEKGEIGFLADVRRMNVAMTRAKRKLIVIGDSSTIGGNEFYARFLEYVESMDAYHSVWEEID

SEQ ID NO: 42462 - protein, 457 aa, Oryza sativa (indica cultivar-group)
MPASPKEAQSRAGAGVRMISSEELRAHASRDDLWISISGDVYDVTAWVPHHPGGDIPLLTLAGQDATDAFAAYHPPSARPLLGRFLVGRLEDYTVSPASADFRRLLAQLSSAGLFERVGPTPKVQVAGMLLLLCAALYCVLACASAWAHLLAGGLIGFIWIQSGWMGHDSGHHRITGHAALDRLLQVLSGNCLTGLSIAWWKCNHNTHHIACNSLDHDPDLQHMPLFAVSSKLFGLWSYFYQRTLVFDAASKFLISYQHWTFYPVMCFARINLLIQSAVFLLSSRKVPQRGLEIAGVAAFWVWYPMVVSCLPNWWERVAFVVASFVITGIQHVQFCLNHFSSEVYVGPPKGNDWFEKQTAGTLDIQCSPWMDWFHGGLQFQIEHHLFPRLPRCHLRKVSPFVRDLCKKHGLPYAAASFWQANVLTWKTLRAAALQARKATSGAAPKNLVWEAVNTHG

SEQ ID NO: 42463 - protein, 433 aa, Ralstonia eutropha JMP134
MTPSDVKATLSFSDGSPSVELPIYKGTVGPDVIDIRKLYGQTGKFTYDPGFMSTASCNSKITYIDGDKGELLYRGYPIEQLAQKCDHLETCYLLLKGELPNAKQKEEFTGHVMNHTMVHEQLQFFLRGFRRDAHPMAVLTGLVGAMSAFYHDAMDIDDPHQREISAIRLIAKMPTMVAMAYKYNIGQPYIYPQNDLSYSGNFLRMLFGTPCAPYTVNPVLERALDRIFILHADHEQNASTSTVRLAGSSGTNPFAAIAAGVACLWGPAHGGANEAALKMLEEIGSVDNIGEFIKQVKDKNSGVRLMGFGHRVYKNYDPRAKLMRETCHEVLNELGLHNDPLFKLAMELEKIALEDEYFVSRKLYPNVDFYSGIVQRALGIPTSLFTCIFALARTPGWISQWEEMITDPEYKIGRPRQLFNGAASRDVPDISKR

SEQ ID NO: 42464 - protein, 557 aa, Dechloromonas aromatica RCB
MYKYDAIDRQLINQRVDQFRDQVRRWKAGELSDDEFRPLRLQNGLYIQRHAPMFRIAVPYGMLSSDQLRTLGQIAIKYDRGYGHFTTRHNLQLNWPKIEDVPDMMAELAKVEMHAIQTSGNCLRNITTDPFAGVAADEVIDPRPLAEILREWTTFHPEFAFLPRKFKIAISGTREDRAVTWFHDIGLHLQEQNGEVGFRVIVGGGLGRTPIRGQVVSEFLPWQHILTYCEAILRVYNRAGRRDNAYKARIKILVQATGIEAFSQQVEAEWAYMKDGPATLTQAEFDRVAAHFGAPDYAKQDEVTLPADQAFVKWVERNTHPHKVPGYAAVTLSLKKHGIAPGDITSEQMAAVADLADQYSFGELRISHEQNIILADVKKSDLHEVWQKAKAAGLATPNIGLLTGIICCPGGDFCDLANAKSIPIANAIQARFDDLDYLFDIGEIDLNISGCMNACGHHHVGHIGVLGVDKNDSEFYQVTLGGRQGNDAKLGKVIGPSFAAEEMPDVVDKIIKVYIENRHADERFLDTLDRIGIDPFKNRVYEGRAHGKAKAAQQEAA

SEQ ID NO: 42465 - protein, 288 aa, Bacillus cereus ATCC 10987
MPQQKNFITMPAQHQNKQPGIESLMNPLPQFEDPNYKGSEKLKGKNVLITGGDSGIGRAVSIAFAKEGANIAIAYLDEEEDANETKQYVEKEGVKCILLPGDLSDEQHCKDVVQETVQQLGSLHVLVNNVAQQYPQQGLEYITAEQLEKTFRINIFSYFHVAKAALSHLKQGDVIINTASIVAYEGNETLIDYSATKGAIVAFTRSLSQSLVQKGIRVNGVAPGPIWTPLIPSSFDEKKVSQFGSNVPMQRPGQPYELAPAYVYLASDDSSYVTGQMIHVNGGVIVNG

SEQ ID NO: 42466 - protein, 554 aa, Zea mays
  misc_feature (463)..(463): Xaa can be any naturally occurring amino acid
  unsure (1)..(554): unsure at all Xaa locations
MSVPGQCSSQPQFITSVGRSNRSNGPGTPLIESIDVDQIVIPEKNSWKNLFSYIGPGFLVSIAYIDPGNFETDLQAGAQYKYELLWIILVASCAALIIQSLAARLGVVTGKHLAEHCRAEYPKVTNFVLWILAELAVVACDIPEVIGTAFALNMLFRIPVWCGVLITGLSTLMLLLLQQYGVRKLEFLIAFLVFLIATCFLVELGYSKPNAPEVVRGLFVPELKGNGATGLAISLLGAMVMPHNLFLHSALVLSRKVPRSVHGIKEACRFYTIESAFALTVAFLINISIISVSGSVCGSGNLNPEDQANCSDLDLNKASFLLKNVLGNWSSKLFAVALLASGQSSTITGTYAGQYVMQDRYGGFLDLRMKPWIRNLVTRSLAILPSLIVSIIGGSSAAGQLIIIASMILSFELPFALVPLLKFTSSKTKMGQHTNSIFTAVLTWMIGSFIVVINTYFLITSFXKLLVHSGLTTISQVFSGIFGFLGMLIYIVAILYLVFRRNRKSTQPLLESDAELAVSGSSADAGAECSLGHLPREDISSMQLPQQRSASDLD

SEQ ID NO: 42467 - protein, 250 aa, Triticum aestivum
MGGCCCCFPSKPPRENPMHPIAEPLIKRKPNHTPPYHQRPPVTTHAHKGMNAVVRLKTGFERFRTNVYNKNPKLFESLRKDQSPKYMVFACADSRVSPTITLGLNPGEAFTVRNIAGMVPAYQKTRHCSVGSAIEFAVVVLKVECIVVIGHSRCGGIRELLSLKDEGPNAYHFIEDWVKIGMEAKKKVQRENRLLPFDDQCTVLEKEAVKFSLRNLKSYPFVKDRLNKGTLNLIGARYDFVHGSFETWNA

SEQ ID NO: 42468 - protein, 512 aa, Arabidopsis thaliana
MDIISGQALLLLFCFILSCFLIFTTTRSGRISRGATALPPGPPRLPIIGNIHLVGKHPHRSFAELSKTYGPVMSLKLGSLNTVVIASPEAAREVLRTHDQILSARSPTNAVRSINHQDASLVWLPSSSARWRLLRRLSVTQLLSPQRIEATKALRMNKVKELVSFISESSDREESVDISRVAFITTLNIISNILFSVDLGSYNAKASINGVQDTVISVMDAAGTPDAANYFPFLRFLDLQGNVKTFKVCTERLVRVFRGFIDAKIAEKSSQNNPKDVSKNDFVDNLLDYKGDESELSISDIEHLLLDMFTAGTDTSSSTLEWAMTELLKNPKTMAKAQAEIDCVIGQNGIVEESDISKLPYLQAVVKETFRLHTPVPLLIPRKAESDAEILGFMVLKDTQVLVNVWAIGRDPSVWDNPSQFEPERFLGKDMDVRGRDYELTPFGAGRRICPGMPLAMKTVSLMLASLLYSFDWKLPKGVLSEDLDMDETFGLTLHKTNPLHAVPVKKRANIN

SEQ ID NO: 42469 - protein, 281 aa, Yarrowia lipolytica CLIB122
MLSRFARIGSMGIRPVAAARATFVTSARAAQAAPSWENIKDIRLDPKVHVDEVYEPIVNPADRYLQHVSDLHQYAKYIMAALPKYIQGFSVWKDELTLHVAPSAVIPVTTFLRDNTSTQYKSIIDITAVDYPSRENRFEVVYNFLSVRHNSRIRLKTYATEVTPVPSITCLYEGANWFEREAYDMYGVFFEGHPDLRRIMTDYGFEGHPLRKDFPLTGYTEVRWDEEKRRVVYEPLELTQAFRNFSAGSTAWEPVGPGRDDRPDSFKLPTPKPEEKEGDKK

SEQ ID NO: 42470 - protein, 457 aa, Campylobacter lari RM2100
MGQCPFHPKPYKNKASTLTTFLLKRRSWLDGLYERSYKMMMGRVKMPGFDLYVVNDPKEVRRIMVDEVREYPKSQLLHELLEPLLGISIFTTNDRVWEKQRELLRPSFEMTRISKVFNLMSEAASDMMARFAKYEDKAIVEVDEAMTFVTADVIFRTIMSSKLDEQKGKLVLDAFVTVQEETVKTAMRRMFRFPTWLSNLLGERKRLKAGGVIRKVLSDIIKPRYDNATNDQGKYEDILSSLLMVVDADTNERFSFNEILDQVAMLFLAGHETTASSLTWTLYILSISPNEQQKAYEEIMQVAGDEEFKIEHIRAMKYLTNVFKESLRLYPPVGFFAREARNDNKMRDKLIKKGSGVVVAPWLIHRHDSFWENPHEFDPSRHEDKSKIKKDTYMPFGMGERVCIGQGFAMQETVLILANILRTYKLELEENFIPDIVGRLTIRSANGMNIRFIKRQK

SEQ ID NO: 42471 - protein, 361 aa, Aspergillus nidulans FGSC A4
MGNESSTLVDEKTPPSVLEARTVEAVAKYVKEKPVRRVVVMVGAGISTAAGIPDFRSPDTGIYANLVHLDLPDPEAVFDISFFRQNPKPFYALARELAPGQYRPTLAHSFVKLLYDKGKLLKHFTQNIDCLERLAGVPGDMIIEAHGSFATQRCIECKTAYPDDLMKEAIAKGEVPNCAECQGLVKPDIVFFGEALPSAFFDNRTLPETADLCIVMGTSLSVQPFASLPSFVADGVPRVLINRERVGGLGSRPDDVLILDDCDNGVRKLARALGWEDELERLWEEANPNQKSREEELATPRTREERLENEISRLTAEIDKTLKISDAYQKRVRERLEGEPLSSPESNGTGLAHVFPHLARR

SEQ ID NO: 42472 - protein, 520 aa, Medicago truncatula
MKMEIGELWSQLGSIMASIMFVYAMFDKFFPPNLRVYFLKYTNKFTNYMYPYIHIKFHELSGERLKQSETYKIIQTYLSDNSSQRARRLKAEVVKDSQNPLVLSMDDNEEIIDEFNGVKVWWTANYTTSKSQSFSYYPTSDEKRFLTLTFHKKHREVITTSYIQHVLDEGKSIMSKNRQLKLYTNNPSSNWWGYRSKKWNHTTFEHPARFGTLAMEPEKKQEILNDLLKFKKGKEYYAKVGKAWKRGYLLYGPPGTGKSTMISAIANYMNYDVYDLELTTVKDNNELKRLLIETSSKSIIVIEDIDCSLDLTGQRKKKKKKDDDENDEMKDPIKKAEEEEKNESKVTLSGLLNFIDGIWSACGSERIIIFTTNFVDKLDPALIRRGRMDKHIEMSYCSYQAFKVLARNYLDVETHDDLFPIIEKLLGETNMTPADVAENLMPKSITEDFESCLKNLIQSLEIAKKKDEEEAKKKIEDEEAKLKAQKEKQELIQEEEKVKVDEKLEEKVKENGVKENGVIH

SEQ ID NO: 42473 - protein, 505 aa, Medicago truncatula
MASIMFVYAMYEKFFPPALRRYLRKYTHKFTNFMYPYIKITFYEKSGDNLKHNKTYTTIQTYLSANSSQRARRLKAEVIKDSQNPLVLSMDDNQEITDEFNGVKVWWSANHITSRTQSFSIYPSSDEKRFLTLTFHKRHRELITTSYIQHVLEQGKAITMKNRQLKIYTNNPSNDWFRYRSTKWSHTTFEHPASFETLALEPKKKEEILNDLVKFKKGKEYYAKVGKAWKRGYLLFGPPGTGKSTMISAIANFMNYDVYDLELTIVKDNNELKRLLIETSSKSIIVIEDIDCSLDLTGQRKKKKEKDDVENDEKKDPIKKAEKEEKNESKVTLSGLLNFIDGIWSACGSERIIIFTTNFVDKLDPALIRRGRMDKHIEMSYCSYQAFKVLARNYLDVEFHDDLFPIIEKLLEETNMTPADVAENLMPKSITEDFESCLKNLIQSLEIAKKKDEEEAKKKIEDEEVKLKAEKEKLELAQEEEKVKADEKLEENVKENGVKENGVIH

SEQ ID NO: 42474 - protein, 563 aa, Haemophilus influenzae Rd KW20
MRLKFQLFLMKGNTMKNINPTHTHAWKSLEAHKAELSNITIQDLFKQEKNRFDDYSLTFNNQILIDFSKNNINQTTLSHLRQLAQECALDSAKEAMFTGEKINRTENRAVLHTALRNRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNNMFEFWDWVGGRYSLWSAIGLSIALSIGFENFEALLNGAHEMDKHFLSTPIEQNIPTTLALVGLWNTNFLGAQTEAILPYDQYLHRFAAYFQQGNMESNGKYVDRDGNVIKNYQTGPIIWGEPGTNGQHAFYQLIHQGTTLIPCDFIAPAQRHNPLADHHNKLLSNFFAQTEALAFGKTKEEVEAEFVKAGKSLDDVKNIVPFKVFTGNKPTNSILVQKITPFTLGALIAMYEHKIFVQGVIFNIFSFDQWGVELGKQLANRILPELTDSEKVASHDSSTNGLINQFKAWR

SEQ ID NO: 42475 - protein, 318 aa, Coccidioides immitis RS
MAADYWSSTQHQSWLFGREELAEARKVLGDAERPFIQQYPLPDLRLFNIYVNQQLIKLAKRLNVRQQALATAQVYVKRFYTKVEIRRTNPYLVLTTAFYLACKIEECPQHIRLVLGEARGLWPAIMENVATSTLTRSPEFIAPDSAKIGECEFWLISEMNSQLIVHHPYRTLSELQSYLSLTSDEIALAWSVINDHYLTDLLLLHPPHVISVMAIFIAVVFKPNQHQVVSISGGSSATGALRDGSTNILSAFNDKTGAGMPAKVQRIVDWLANSDINIEAVIECTQDIVSLYEVWEQYSEKVCKEQIGRYVKSRGLDK

SEQ ID NO: 42476 - protein, 322 aa, Pichia angusta
TSVVCCVRFSKDGKFLATGCNKLTQVFSVETGDLVARLSDESSASSNGSYDTDTGDLYIRSVCFSPDGKFLATGAEDKIIRIWDLATRTIVKYLYGLVQDIYSLDFFPDGSKLVSGSGDRTVRIWDVFTGQCSLTLSIEDGVTTVAASPDGKLIAAGSLDRTVRVWDANQGFLVERLDSANESGNGHMDSVYSVAFTHDGKEIASGSLDRTVKLWSLKDLQKQQGSSKSNCEVTYVGHKDFVLSVCCTPDDEFILSGSKDRGVIMWEKATGEPYIMLQGHRNSVISVNVSPVMTQKRGVNGGYFATGSGDCKARIWRWEKVS

SEQ ID NO: 42477 - protein, 248 aa, Glycine max
MGMAAAESQFHVLAVDDSIIDRKLIERLLRTSSYQVTTVDSGSKALEFLGLRENDESNPSIPSVCPNNHQPQEVEVNLVITDYCMPGMTGYDLLKKIKESSSLRNIPVVIMSSENVPSRINRCLEEGAEEFFLKPVRLSDLNKLKPHMKKTKFKDQKQETVERFEDSEVQQQQSQQQIIIQNEHHQAPKLQVLQPESESESHPQPTIEQQQQILQQANNNNKRKTMEQGLSPETDRTRPRYSGIATVV

SEQ ID NO: 42478 - protein, 524 aa, Bifidobacterium longum DJO10A
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGSLAIFGVIPVAGYQHAPMFVNLIKDGVFPNGFMPVFATILTVNFAFSGTELIGVTAGETRDPQTAVPKAIHTTLWRLVLFFIGSITVMCALIPWRKAGVGESPFVLVFNGIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLAAGHSTSELKYRTPGYPYVSWAAFILCTASFVLVIFDVEQRFALVAELVFIVACYGAYFLQQWVRKRKKATEADDLDTLWVARD

SEQ ID NO: 42479 - protein, 338 aa, Blastopirellula marina DSM 3645
MSHTVCLIEGDGIGAEITAAVQHIIAAAGVTIDWRPCLAGVTALEKTGSPLPPETIAAIKETGVALKGPLATAIGKGFRSVNVGLRQELQLYANFRPARTIPGVKTRYDNVDLIVIRENTEGLYSGLEHIVVPGVVESLRVITEKCSRRIAIFAFETARKYHRKTVTCVHKANILKLSDGLFLDTVRDVAKSYPDIELNDCIVDAAAMKLVMDPTQFEVLVMENLFGDIISDLASGLVGGLGVTPSGNYGDGYAIFEAVHGTAPDIAGKDMANPTALLLSATMMLKHLGETDAADRIESALLSVLQNPATRTGDLGGKLGTSKFAEAVAEACAVGSSG

SEQ ID NO: 42480 - protein, 393 aa, Ralstonia eutropha JMP134
MSAANHTTPADAPQSAGPKPKKSVALSGVTAGNTALCTVGRTGNDLHYRGYDILDVADACEFEEIAHLLVHGKLPNRAELAAYKTKLKSLRGLPANVKAALEWVPASAHPMDVMRTGVSVLGTVLPEKDDHNAPGARDIADRLMASLGSMLLYWYHYSHNGRRIEVETDDDSIGAHFLHLLHGEKPSKLWERAMHTSMILYAEHEFNASTFTGRVIAGTGSDMYSAICGAIGALRGPKHGGANEVAFEIQKRYDSPDEAQADIARRVENKEVVIGFGHPVYTIADPRNQVIKETARNLSKDAGSMKMFDIAERLETVMWDIKKMFPNLDWFSAVSYHMMGVPTAMFTPLFVIARTSGWAAHIIEQRIDNKIIRPSANYTGPEDLKFVPIGKRK

SEQ ID NO: 42481 - protein, 112 aa, Glycine max
MVRGCVLNYALKSMYNAEKRVKRHVMIRPFSKVIIKFLLAMQKHGYIGEFEYVDDHRAGTIVDQLNGKLSKRGVITPRFDVGVKEIERWTAMLLPSRQFGSIELTTSAGIMD

SEQ ID NO: 42482 - protein, 291 aa, Streptococcus pneumoniae R6
MKKQEKLALVESALEDFYGDQQFASSLRESVLYSIHAGGKRIRPFLLLEVLEALQVAIKPAHAQVATALEMIHTGSLIHDDLPAMDDDDYRRGRLTNHKKFGEAMAILAGDALFLDPYALIAQADLPSQIKVDLIANLSLASGSLGMVAGQVLDMEGEHQHLSLEELQTIHANKTGKLLAYPFQAAAIIAELSPEMQVKLKTVGELIGLAFQVRDDVLDVTASFEEIGKTPQKDLQAEKSTYPALLGLEESIAFCNQTLDQANEKLEEIAQQVPFETESIVSVVESLRING

SEQ ID NO: 42483 - protein, 201 aa, Zea mays
  misc_feature (157)..(157): Xaa can be any naturally occurring amino acid
  unsure (1)..(201): unsure at all Xaa locations
MALLRLPPISLQYLGHKSEQKTPNPGVSLTNFSLTWSTPSLSRLHLAKPRNLTSYSFATTQEPILEPSSSEEISKTRLIAQNVPWTSTPEDIRSLFEKSGSVVDVEMSMHKKERNRGLVFIEMASPEEAASALQALESYEYEGRRLKVAYAKAKKKXTYAPREKPTPVPTFNLFVANLAFEARAKHLKEFFDADTGNVVST

SEQ ID NO: 42484 - protein, 562 aa, Myxococcus xanthus DK 1622
MSHQPKPLSEVEHIKTQSRLLRGSLAESLEDPVTGGLATPDTNLIKFHGSYQQDDRDVREERRQQKLEPDYSFMLRTRLPGGVCTPAQWLVMDALAREHANHTLRITTRQAFQLHGVIKDDLRPTIARINEAMMDTLAACGDVNRNVLCNPNPVDSRVHETVYQWAVRISEHLLPKTRAYYEVWLGKEKVAGGEDEPIYGATYLPRKFKAAVAVPPLNDVDVFAQDLGFIAIIEGDALVGFNVSVGGGMGATHGDAATYPRLADVVGFIPPEQTLAVAEEVVKIHRDFGDRTNRKHARLKYVLEERGVPWFTAELEKRLGFPLQPARPFAFEHNGDRFGWTEGHDGRWHLTLHLDSGRVADRPGAPHLTGLREIARIHTGDFRLTANQNLVIAGVTPEARDAIGALVTAHALDSFRSASPVRRNALACVALPTCGLAMAEAERYLPTFVGRLEDRLRAHGLQDANLLLRITGCPNGCARPYLAEVGLVGKAPGRYNLHLGGDARGQRLSHLYRENIDEDAILAALEPLFEGYARERQPGEGFGDFVVRAGHVPSPAVQPRPS

SEQ ID NO: 42485 - protein, 434 aa, Alteromonadales bacterium TW-7
MNITTPKIVVIGGGAGGLELATQLGHKLGKKKHAEILLIDKNRTHIWKPLLHEVATGSIDPDLDGVVYSAHAAKHHYNFQLGTFCNIDQSNKTITLAPLFDELGHTILPKRTVRYDHLVIAIGSVSNDFNTPGIKEHCYFLDSNQQAERFQHSLLDSFTRLHQDDNQQQSLDIAIVGGGATGVELSAELYHVSELLKLYGLTNMSSKRLHIHLIEAGPRILPALPERIAVSAKRELLKLGVNVLEQTQVKEATEQGFITKDEEHINADIMVWAAGVKAPDFIKDLGVFELTRSNQIQVNEFLQSTVDESIFVLGDCCAFTQEDGKLVPPRAQSAHQMAQCVEKNLIATLKHQPLSGFKYSDHGSLVNLSRYSTVGNLMGNLTSNTFFIEGKIARFMYISLYRMHQRAIHGSAKTFALWISEKVLRVVRPKMKLH

SEQ ID NO: 42486 - protein, 233 aa, Mycobacterium avium 104
MLSGAGISAESGVPTFRDDKNGLWARFDPYELSSTQGWRDNPQRVWGWYLWRHYLVADVAPNAGHRAIAAWQDHAEVSVITQNVDDLHERAGSRPVHHLHGSLFEFRCARCAKPYTGELPAMAEPALEVQPPVCGCGGLIRPDIVWFGEQLPDEPWRRAVEATESADVVVVVGTSAIVYPAAGLAELALSRGAAVVEVNPEVTPLSASATLSIRETASQALPGLLQRLPALLN

SEQ ID NO: 42487 - protein, 544 aa, Coccidioides immitis RS
MIPPLNVAEIARQAAAYEYSPSTKLQYWLRTAASLVKEADVYEREGNDQQAYLLLFRHAQLVLVNLIMHPQAQDPSCRRGLAEAQREVQNSLKRLEVLKPRINQRYKQYQEARDIEFRKTIAAQLDDHADLLRDRESHDPAIAGRPQPLAAAENKDLAVKLAQKELKRRAAAKLGHYLSENLHPHKQRKLLAPVQGQSTQEQHGVSDQDDLASRLQEVRARVEGDQTHRTSIQESQPASSEVQTILRRPEPNRSATGYKYPAVPAQSIFTITETVPPLPSKGLLQPLPLRPPAIPAKIPEPPSRPISATPPSAPPVPSKVAPNTTSITPPEPPRQPDYITPSSSDLQPSTFTFKPSSYLENGNPLRTIFISPDLRQRFLEIAYPNTRRNLETCGILCGSLISNAFFISKLLIPEQESTPDTCEMVNEGAVFEYCDAEDLMVLGWIHTHPTQTCFMSSRDLHTQSGYQVMLAESIAIVCAPSRTPDWGVFRLTDPPGLKTVLACTKQGLFHPHEETDIYTDALRPGHVFEAKGLEFETVDLRNKR

SEQ ID NO: 42488 - protein, 460 aa, Mesorhizobium loti MAFF303099
MHNSDSSKTPIGGISRDRIAQLRETEGAAFRKARPKSQAKVGNGLPGFFGGVPMHWMNDWPTPFPILVDSAKGAAITDIDGNRLDDFCLGDTGSMFGHSPPPVARAIRRQAGRGLTYMLPSEDALAIGPLLQQRFGLPFWQIATTATDANRFSLRVARAVTGREKILVFNGCYHGSVDETMVRLIGGKPVNRPGLAGEFRDLTRTAKVIEFNDVAALEAALKDRDVACVIAEPVLTNSCMVLADPGFHDALRRLTRETGTLLLIDETHTISTGPGGYTRKYGLEPDFFVLGKPIAGGVPASVWGMSDEVASRYADYNRTKEPGYSGMGTTLSANPLQFAAMRATLEEVMTAENYDRMDHLAERLDAGLTGVIDRYRLPWHVARVGARVEFICAPGPLRNGAEAETAHAPELEAAIHVALVNRGVLIAPFHNMMLISPATSGAQVNRLIAAFGAVAAKLAA

SEQ ID NO: 42489 - protein, 305 aa, Alteromonadales bacterium TW-7
MSILIDSKQGKDVSVSCFGEVLWDCFATGKRLGGAPLNMCVRINSLGIKADMISAVGNDELGTELLGEIKAKDVSCDYIAVNNDKKTSTVQVTLDKSGSASYEIVADTAWDNITLTDSLIEKVKASDVFVFGSLIGRSEASLATLNQLVDVANFKVFDVNLRAPHYTLDTLVDLMNKADFIKLNDEELYEIAKAMGCKFHSLEQNLAFIAEQTNTEYLCVTKGSHGALLTVKGQNYYNSGYLISVVDTVGAGDSFLGSLIYQLCSSDCAQHAVDFACAVGAMVAESAGATPTLTHEKINEFMRPL

SEQ ID NO: 42490 - protein, 443 aa, Leptospira interrogans serovar Lai str. 56601
MNQNKPTSKLISDFWKGKTSEELFERAKKVSPGGVHSPVRSFRSVGGTPVFFASAKGATLTDISGKEYIDYCLSFGPLILGHRDPEVEEVVRETTEIAWSFGAAEPYSLELAELISSRVPWAEKVRFVNSGTEAVMSALRVARAATGREKILKFDGCYHGHLDSLLVKAGSGLAGESSSDSAGISATSIANTLVLPLDDEASVERVFETEGKNIAALIIEPLPANYGLLIQRKEFLLKIVETARKYGTLVVFDEVISGFRVGFQGMSGLLGIWPDLVTYGKIIGGGFPVGCYAGKKDLLDLVAPSGPVYQAGTLSANPFGMRAGLATLKKVQRDSIYSVLDDRTKIFTDTMTKLLNKKSNQEWEAVIHSSLFWFRKKTQQPIRRIDLIPEGHKESFAKVFHTFLKNGIYLAPSGYEVGFLSWAHDDEIIAKTLEIADKALKTF

SEQ ID NO: 42491 - protein, 663 aa, Brucella suis 1330
MTNTDKQNQMANAIRFLSMDAVEKANSGHPGLPMGAADIATTLYTRFLSHDPKNPHWPDRDRFVLSAGHGSMLLYSLLYLSGYEDITIDEIKKFRQLGSRTAGHPEYGHAAGIETTTGPLGQGIANAVGMAISERILNAQFGDSLVNHYTYALVGDGCLMEGISQEAIALAGHLKLNKLIVLWDDNNISIDGPITLSDNTDQPARFAASGWNTMAVDGHDQDAIAKAIELARVSDRPTLIACKTTIGFGAPNKAGTNKVHGSPLGAEEIAATRKALGWSSEPFVVPAEVLDAWRVAGLNAAKKRLEWEKRLSAVEAETRAEFERRMRGELPSGFDAAIVEYKKKLSADKPKVATRKSSEMALEVINGVVPETVGGSADLTGSNNTKTSQTKAVTPENYDGRYIHYGIRELGMAAAMNGITLHGGLIPYSGTFLCFSDYARPAMRLSSLMGIRVVYVMTHDSIGLGEDGPTHQPVEHLAALRAIPNHNVFRPADAVETAECWQLALHSRKTPSTLALTRQNLPTVRTEHREENLCAFGAYELAAASSDAKVTIFATGSEVEIALKARDLLEGKGIATRVVSVPCFELFEQQSDAYKEATIGDAPIKLAIEAAISLGWERFIGENGIFIGMKGFGASGEINDLYKHFGITAEHAVEAAEKKLNAA

SEQ ID NO: 42492 - protein, 335 aa, Brucella suis 1330
MAVRVAINGFGRIGRNILRAIVESGRTDIQVVAINDLGPVETNAHLLRYDSVHGRFPKEVKVAGDTIDVGYGPIKVHAVRNPAELPWKEENVDIALECTGIFTSRDKAALHLEAGAKRVIVSAPADGADLTVVYGVNNDKLTKDHLVISNASCTTNCLAPVAQVLNDTIGIEKGFMTTIHSYTGDQPTLDTMHKDLYRARAAALSMIPTSTGAAKAVGLVLPELKGKLDGVAIRVPTPNVSVVDLTFIAKRETTVEEVNNAIREAANGRLKGILGYTDEKLVSHDFNHDSHSSVFHTDQTKVMDGTMVRILSWYDNEWGFSSRMSDTAVALGKLI

SEQ ID NO: 42493 - protein, 395 aa, Brucella suis 1330
MFRTLDDANVQSKRVLVRIDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAVVGWHFAADTPHQTYGVDSVPGDAMILDAGELSTDLIASAIDDAATLVWNGPLGAFELRPFDTATVKVARHVAKRTKEGKLVSVGGGGDTVAALNHAGVVDDFTYISTAGGAFLEWMEGKPLPSVDVLKK

SEQ ID NO: 42494 - protein, 503 aa, Muscari armeniacum
MSFTDHHYLLLILFLIPILVYTIRRKISSTKSKLPPCPPKLPLIGNLHQMGTLPHQSLHALSVKYGPLMLLKLGQIPTLIVSSADMAREIMKTHDHIFASRPSLMTAGIILYGSMDVVFAPYGEHWRQMRKLCVNHLLSPKAVQSFRRMHEEEVATMVAKISEVSSSSGVVNMSETLNLFASNAMLKAISRKLFRDERRSRVICELNEETAAILGQFSVSDFMPLLAWFDMVFGVGARAKKTARLWDRVLHEIIEDCRNRRDSEVNTDFVNVLLALLEDNDMDFSLNKDIIKAVLQDMIAAGTETSSTAMDWCMAELVRNPEAMKKLQDEVRGIANTKPMITDDDLSKMGYLKAVIKELLRLHPPVPLLIPRESMDHCEVQGFDIPKQTRVIVNAWSIGRDPNVWEAPEEFRPERFLDCAINFRGHDFELIPFGAGRRICPGMQFAVSTLELALANLVRSFDWELPDGMNNEDLGMGDGPGLSARRRQSLLLVAKPFLGLKCM

SEQ ID NO: 42495 - protein, 405 aa, Zea mays
  misc_feature (213)..(213): Xaa can be any naturally occurring amino acid
  unsure (1)..(405): unsure at all Xaa locations
MECSNSTSSQGHHVEKWNQVQIIDPSIVEMGPSHLPLSFMRRCRGVLCLVIMILTAFMMMVYLSPVTTFLVRLFSVHYSRKSTCFLFGMWLAMWPFLFEKINKTRFVFSGESVPAKERVLLFANHRTEVDWMYLWDFALRKGRLQCIKYILKKSLMKLPVFNWAFHIIEFIPVERKWEIDEAIIRSRLSEFKNPKDPLWLAVFPEGTDYTEKXKCIKSQEYAAEHGLPVLKNVLLPKTKGFNCCLQVLRSTIDAVYDITIAYKHRPPTFLDNVYGVGPSEVHIHISSIQVSDIPASEDGVAGWLVERFRLKDELLSGFSALGHFPDEGKGTEGDLSTAECLANFAAVVAVTGLLAYLTLFSSVWFKLFVAFSCSSLTLATCYSVHLPQMVGFGSGTPGSIHAKEA

SEQ ID NO: 42496 - protein, 333 aa, Brassica napus
  misc_feature (10)..(10): Xaa can be any naturally occurring amino acid
  unsure (1)..(333): unsure at all Xaa locations
MATDFKSLPXVIDISPLLLKCDDSDMAEDPGVIQVVQQLDRACRDAGFFYVIGHGISEDLIKKVREITREFFMLPYEEKLKIKMTPAAGYRGYQRIGENVTKGKPDIHEAIDCYREFKQGKYGDLGKAMEGPNKWPENPHEFKELMEEYLRLCTDLSRNILRGIALALGGSPYEFEGKIAGEPFWVMRLIGYPGAPFTNGKLENDFGCGAHTDYGLLTLVNQDEDKTALQVRNLGGDWISAIPIPGSFVCNIGDMLKILSNGLYESPLHKVINNSPLYRVCVAFFYETNFDAVVEPFDICKDKYPEGRGESQVFKRAVYGEHLVSKVQTNFAM

SEQ ID NO: 42497 - protein, 667 aa, Clostridium difficile 630
MKSEKRFKILDIDVYLQPFESDIKKRMKHYEDMKSKTLKNYKDFSSFANAHLYYGFHQTNDGFFYREWAPNADSLSLIGDFNNWNRKSHPLRKIGSGNWEIFIPGQNSLPHKSEIKVQVTANGKTFDRIPLYIKRVIQKDFGGFNGQIWQPKTPFIWTDNNFDLKNITSPLIYECHIGMSTESESIGTYNEFTEKILPKIKKAGYNTIQLMAIMEHPYYASFGYQVSNFYAISSRFGTPEDLKNLINTAHSMGIAVLLDLVHSHAVKNTLEGINEFDGSEHQFFHSGSKGNHPAWGTKLFNYGKPEVIHFLLSNIKFWLNEYHFDGFRFDGVTSMLYHNHGLGVSFDSYEKYFSMNTDIEAITYLQFANELIKEIKPNSISIAEDMSGMPGMCIPIKDGGIGFDYRLAMGVPDFWIKTISNLSDEDWDLGKMWYELTTRRPGEKNIGYCESHDQALVGDKTIIFWLADKEMYWNMEINSNNHVINRAISLIKLIKLITFSLAGEGYLNFMGNEFGHPEWIDFPREGNNWSYKYARRQWSLSEDNNLKYKQLLNFDKSMLELTKYSDIFIQNSHELIHMDNDKKILVYSKGKYLFIFNFHPNLIQSVDISKFQNTNYKTILNTDMVEFGGNTKKENLRDYDVYFSSTPPSSKMPIASRTAIVLLDNGI

SEQ ID NO: 42498 - protein, 342 aa, Alteromonadales bacterium TW-7
MSATSRQLTLASRPHGAPTDKNFELKTVDIPALKDGEVLLRTIYLSLDPYMRGRMSDAKSYADPVNVGDVMVGATVCQVEESKNDKFSEGEWVLAYTGWQSYAISNGEGLMQLGKEPANPSYALGIMGMPGFTAYMGLLDIGAPKEGETVVVAAATGPVGATVGQIAKIKGCKVVGVAGGSEKCAHAVEKLGFDACIDHKADDFAEQLEKACDNGIDVYYENVGGKVFDAVLPLLNTAARVPLCGLVSQYNATSLPEGPDRMGMLMGQLLTKRIKMQGFIIFDDYGHRYDEFAQDMQKWLQDGKVQYREHMVEGIENTVSAFNDMISGKNFGKTVVKINDAL

SEQ ID NO: 42499 - protein, 428 aa, Triticum aestivum
  misc_feature (19)..(19): Xaa can be any naturally occurring amino acid
  misc_feature (134)..(134): Xaa can be any naturally occurring amino acid
  misc_feature (154)..(154): Xaa can be any naturally occurring amino acid
  misc_feature (185)..(185): Xaa can be any naturally occurring amino acid
  misc_feature (370)..(370): Xaa can be any naturally occurring amino acid
  unsure (1)..(428): unsure at all Xaa locations
LACRGRGCESACIVSCGGXLCPGLNTVIRELVCGLAHMYNVNNIFGIQNGYKGFYSSNYVAITPKTVNDIHKRGGTVLGTSRGGHDTKKIVDNIQDRGINQVYIIGGDGTQKGAYEIYKEIRKRGLKVAVAGVXPKTIDNDIAIIDKSFGFDSXAVEEAQRAINSAHVEACSAENGIGLVKLMGXRFRGSFPLLPPLPSPDVDCCLIPESPFYMDGEGGLLQYVERRLKENKHMVIVVAEGAGQDIIAKSIPASDQLDASGNKLLLDIGLWLTHKIKDHFKSKKMEMTIKYIDPTYMIRAIPSNAADNVYCTLLAHSAIHGAMAGYSFTVGMVNGRHAYIPFYRVTSTRNKVKITDRMWARLLSSTNQPXSFLRQKDIDEAREADRLTNKPPLPPVAKQECGQKHLTNLHRLRRTARYSDALVCNRVQ

SEQ ID NO: 42500 - protein, 532 aa, Oryza sativa (japonica cultivar-group)
MPSCAAGRRRSPVSAVAGSAGAGGTTRSERRVPLWNLSNVVGGRARAAKAEKSSLTGRVANVKKGFLAVADVGFYRWGWITDRSIKKEPDIAPSLFVGSAPAFQSPCKPNISDLNGNDNNSAHHDRGGEKDLSVTRVGHHDCSPGLSDNSMSKEDAMSTGDSTESLDIDCLDDGDSEVVSSLQHLADDKLHISDNRDVAGVASKWTKHGCNSVEIDYIVDIDNNHEDPQLCATLAFDIYKHLRVAEQTKKRPSTDFVETIQKNIDTSMRAVLIDWLVEVTEEYRLVPETLYLTVNYIDRKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFILKPTENPWNSTLSFYTQYKPSDLCNCAKGLHRLFLVGPGGNLRAVREKYSQHKAQLPRANLMAKAHGSSSTFQFEKWRLRNLSLRKMENERRCARFCHQDGTRQLTPWDVLKAHDNEKLRASRKIVKIE

SEQ ID NO: 42501 - protein, 382 aa, Mycobacterium tuberculosis H37Rv
MARDYYGLLGVSKNASDADIKRAYRKLARELHPDVNPDEAAQAKFKEISVAYEVLSDPDKRRIVDLGGDPLESAAAGGNGFGGFGGLGDVFEAFFGGGFGGGAASRGPIGRVRPGSDSLLRMRLDLEECATGVTKQVTVDTAVLCDRCQGKGTNGDSVPIPCDTCGGRGEVQTVQRSLLGQMLTSRPCPTCRGVGVVIPDPCQQCMGDGRIRARREISVKIPAGVGDGMRVRLAAQGEVGPGGGPAGDLYVEVHEQAHDVFVREGDHLHCTVSVPMVDAALGVTVTVDAILDGLSEITIPPGTQPGSVITLRGRGMPHLRSNTRGDLHVHVEVVVPTRLDHQDIELLRELKGRRDREVAEVRSTHAAAGGLFSRLRETFTGR

SEQ ID NO: 42502 - protein, 242 aa, Zea mays
MLAKGRKVAGRREEMSANYAFGPQDDDAIIKHRLLTRTTTTRGEPPLKKLQKKFMSFATEIEKDADNISDCERLYKAFLHEINTFELPLLKSKAVVDANIREKESFNELQVEIERQILHAKTDIEDLKKQLEQSKIERQHKEECEAIRKLISLQPPRSETEKLIADLEKEITDLKAENVACIRTLELRKKQFALLLHVVEELQISIEDEQKSIADELRAIAGEQKMSMEEGSVGASDSMVVD

SEQ ID NO: 42503 - protein, 480 aa, Lachancea kluyveri
MEQVDLVQANILASGANKKTVRVVNGLGSLMGSKDMVDVDFDKDSNMDYLLRKDQEEKDVYKNKKHISEQPWTINNWHQHLNWLNMVLVVGIPLIGWYFALSGKVPLSKKVLIFSVAYYVLGGVSITAGYHRLWAHRAYSARWPLRMLFALFGAASVEGSVKWWGHSHRIHHRYTDTTRDPYDARRGLWFSHMGWMLLQPNPKYRARADIADLTDDWIVRFQHRHYIPIMALTAFILPALLCHYFFNDFWGGLVYAGIIRVFAIQQATFCINSLAHYLGDQPFDDRRTPRDNWITALVTFGEGYHNFHHEFPTDYRNAIKWYQYDPTKVFIYTSSLLGLAYNLKKFSQNAIQQGLVQQQQKKLDRSRSKLNWGTPLTQLPVWDKEEFMKSLKSNPGLVIVSGIVHDVSGYITEHPGGETLIQAAAGKDATKAFNGGVYLHSNAAHNVLATMRVAVIKDGVDAAAKFAARRGESFSSKKAI

SEQ ID NO: 42504 - protein, 315 aa, Alteromonadales bacterium TW-7
MTKLLSLGELLIDMLPQDSHNTAYLPIPGGAPANVAVGYAKLGGNAAFCGGMGDDYFAKQLTDALKQYNVGTEYLFTIKNAQTAMVIVSLDETGERSFNFYRHNTADLLLAPEHLQQIQWDEISTLHFCSNTLTSIAIANTTLSALKQAKIHNKLVSFDVNLRYSLWHNIRDIEPNVRACYAHCDIIKLSRDELNFLAEHTSQSSDEYLQSLLELGVSLIFLTDGPEPATVYHKTFNVSEAAPIINAIDTTSAGDAFIAGVLYHLNHFNETLLPSDKLNNKQVIKDALSFGLRCGSKACLSKGAFPALPVLDDVL

SEQ ID NO: 42505 - protein, 102 aa, Aspergillus nidulans FGSC A4
MSSAKVKAQQIIDENGVVVFSKSYCPYCKASKSLLSELGAKYYALELDTIDDGADLQNALEEISGQRTVPNIYIAKKHIGGNSDLQGIKKDLPALLKDAGAL

SEQ ID NO: 42506 - protein, 207 aa, Guillardia theta
WKFFGNLMDCEQYQPFLCGEESFGTGSNHIREKDGMWAVLAWLQILASKNPDQSKPLVTVEDIVRAHWSKYGRNYYVRYDYEGVELAQAENMMKYMSDMAGKWPADAFNGMEIETADVFKYNDPVDKSVSDNQGIRFIFKNGSRIVFRVSGTGVVGATIRLYLEKYEGPSGNLNAHPLETVKPIAELALKLSKLEEFTGRKAPSVMT

SEQ ID NO: 42507 - protein, 273 aa, Oryza sativa (indica cultivar-group)
MAICRLRLTARLVGGQLEVGADLLAMKTEWQEHGLMWSSCRCQRVSTQAGSCDWRRRLSRGAVVSVASGRSCGGALRRRQCRLTPCRDVHVDARTGTAYQVGVSLWPWEAEARSDSAVTKLHSESFSNGMKWDSTVIATVNFLRLSGMQSTDAGEAWMLDLLARFIRRQGRKGSLHVWKPKPWKHPQPITMVQLTKMREEFWDTAPHYGGRKEIWDALRVAAESEVSLAQAIVESAAIIVSNTDLTLCYDERGAKYELPKYVLSEPTNLIQDS

SEQ ID NO: 42508 - protein, 451 aa, Pseudomonas putida GB-1
MSESRKAYIPIAPPREPLPLFQLILVGLQHVLLMYGGAIAVPLIIGQAAGLSREEVAFLINADLLVAGVATIIQSFGIGPVGIRMPVMMGASFAAVGSMVAMAGMPGVGLQGIFGATIAAGFFGMLIAPFMSKVVRFFPPLVTGTVITSIGLSLFPVAVNWAGGGHEAETFGSPIYLLVAGLVLAVILLINRFMRGFWVNVSVLVGMGLGYILAGSIGMVDLSGLKDAPWLQVVTPLHFGMPTFSLAPILSMCLVVVIIFVESTGMFLALGKVTDREVTPGMLRRGLLCDAGASFIAGFFNTFTHSSFAQNIGLVQMTGVRCRFVTIVAGALLILLSLLPKAAFLIASIPPAVLGGASIAMFGMVTATGIKILQEADIGDRRNQLLVAVSVGFGLIPVVRPEFFAQMPQWMEPITHSGIAMATVSALVLNVLFNILGGADRAVHNDACHQH

SEQ ID NO: 42509 - protein, 254 aa, Treponema pallidum subsp. pallidum str. Nichols
MHERNTTTNTPLDVTAQKLLVAQRSVDTLVQEGVLHAHMSIGLGTGSTAMPAVKRIADHLARGTLSDIAAVPTSFQTALICERYNIPLFSLSSKRIGGKLDVTIDGADEIDTQNFVIKGGGAALLQEKIAAYNSAHFVIIVDETKVVETLGTRAALPIEVVPEARMSVMRTLQDWGLSVHIREAVRKKGPVVTDHGNFILDARWQSLPTRTPQDMERALNALPGVIENGLFTERTVRVFVAHADGSVEERSASF

SEQ ID NO: 42510 - protein, 157 aa, Oryza sativa (japonica cultivar-group)
MAADKKEVADDTILLISSDGEHFNVPSAAASLSQLVSNMIENDCTTNGVPLPNVASKVLAKVIEYCVKHAAAAEDEEKELKSFDAEFMIDVDKNMLYGLLLASNFLNIKSLLDLCCQHTANLIKGKSPEQIRKEFGIKNDFTPEEEEIRKENTWAFE

SEQ ID NO: 42511 - protein, 144 aa, Chromobacterium violaceum ATCC 12472
MQTVRQLLDSKPTRALVYVTPDSTVFQALQVMAENDIGAVLVMESGDIVGIFSERDYARRIVLQGRTSAGTKVRDIMTSRVVYVTPQQTLDECMGLMTEKRIRHLPVMEDQTVLGILSIGDLVRATIEEQEQVINHLVHYIQSA

SEQ ID NO: 42512 - protein, 556 aa, Streptococcus pneumoniae R6
MKTDIEIAQSIELKPIVDVVEKLGISYDDLELYGKYKAKLSFDKIRAVESNPVGKLILVTAINPTPAGEGKSTLTIGLADALNKIGKKTMIAIREPSLGPVMGIKGGAAGGGYAQVLPMEDINLHFTGDMHAITTANNALSALIDNHLHQGNELGIDQRRILWKRVVDLNDRALRHVTVGLGGPLNGIPREDGFDITVASEIMAILCLATDIEDLKRRLANIVIGYRYDRTPVSVGDLQVEGALALILKDAIKPNLVQTIYGTPAFVHGGPFANIAHGCNSVLATTTALHLADYTVTEAGFGADLGAEKFLDIKTPNLPTSPDAVVIVATLRALKMNGGVAKDALTEENVEAVRAGFANLKRHVENIRKFGIPAVVAINEFVSDTEAEIAVLKELCASIDVPVELASVWADGAEGGVALAETVVKTIAENPANYKRLYDNDLSVQEKIEKIVTEIYRGSKVNFEKKSQTQIAQIVQNGWDKLPICMAKTQYSFSDNPNALGAPENFEITIRELVPKLGAGFIVALTGDVMTMPGLPKRPAALNMDVESDGTVLGLF

SEQ ID NO: 42513 - protein, 356 aa, Streptomyces avermitilis MA-4680
MKALVFHGSGESVWEDVADPGIQDAGDAIVRVDTVTICGTDLHILKGDLPEVRPGTVLGHEAVGEIVETGGDVRTVRPGDRVLVSCITACGRCRFCRESAYGQCRGGGGWILGHLINGTQAEYVRVPHADLSVHPLPGAMDSKDAVLLADILPTAYEVGVLNGRVRPGDTVVVVGAGPVGLAAVATSRLYTPEKIIAVDLAPARLDAAKRLGADAVAVAGEEAEPLVADLTLGLGADVVIEAVGVPETFEMCTRMVRPGGHVANVGVHGRPAVLHLEDLWIKNVTITTGLVDTRSTPTLLRMMAAGHLPASSMVTHTFPLDAMEEAYDVFSRAADTGALKVVLGEQQHDVLMVRAA

SEQ ID NO: 42514 - protein, 438 aa, Ustilago maydis 521
MGQAPSGGAPGRGGKDNKKDQQKKWEPPLPTRVGKKKKRGPDSSSKLPTVYPNTRCRLKLLKLERIKDHLLLEEEFVQNQERLKPQEDKDAEERTRVDDLRGSPMAVGTLEEIIDDEHAIVSSATGPEYYVSIMSFVDKDLLEPGCSVLLHHKAMAIVGVLSDDADPMVSVMKLDKAPSESYADIGGLETQIQEIKEAVELPLTHPELYEEMGIRPPKGVILYGVPGTGKTLLAKAVANQTSATFLRVVGSELIQKYLGDGPKLVRELFRVADEHAPSIVFIDEIDAVGTKRYDSNSGGEREIQRTLLELLNQLDGFDTRHDVKVIMATNRIESLDPALIRPGRIDRKIEFPLPDQKTKMHIFKLHTSRMNLDSDVDLEEFVAMKDDLSGADIKSLVTEAGLLALRERRMRVTKKDFTTARERVIDRKNEGTPEGLYL

SEQ ID NO: 42515 - protein, 218 aa, Glycine max
  misc_feature (209)..(209): Xaa can be any naturally occurring amino acid
  unsure (1)..(218): unsure at all Xaa locations
MASLHANVTSVVCKSGNHASQSKFTSSSFLPGFDVVGRASNAWKKELVPSSISLVPRATLTFDPPTTNSDKTKQRKHTVDPASPDFLALPSFEQCFPKSTKEHREVTHEETGHVLKVPFRRVHLSGEEGHFDTYDTSGPQNVNPRTGLPQLRKEWVDRREKLGYPRFTQMYYAKQGIITEEMLYCATRENLDPEFVRSEVARGRAIIPXNKKHLELEP

SEQ ID NO: 42516 - protein, 147 aa, Coccidioides immitis RS
MSKLFIGGLAWHTTDETLRQGFSKFGSIEEAIVVKDRDTNRSRGFGFVRFASEGEAEAAMNEMNNQEFDGRTIRVDKAADRPSGPRNDGFNRSNYSRFEGGGAGGYNRGGYGGNNGGGYDQRQGGTGGGWGGYQQNWSNQNQGGSAA

SEQ ID NO: 42517 - protein, 224 aa, Listeria monocytogenes str. 4b F2365
MINQKKIAGEKACEWIKDGMVVGLGTGSTVYYTIEKLGEMVNNGLHITGVATSEETSKQAQNLGIPLKSLNDVAEIDITIDGADEIDTDFQGIKGGGGALLREKMVASASLKNIWVVSEEKLVRNLGKFPLPIEVIPFGWKQIERTLEKEHIQTILRRQSSGEIYVTNNGNYILDIVNQTFRDAEMWQEKLAQIPGIVEHGLFLHYVDIIVCAKANGEIELIKK

SEQ ID NO: 42518 - protein, 1578 aa, Kluyveromyces lactis NRRL Y-1140
MSVELAKVSILGKECVHVGYQIHEHIVKSTLEHCKSSTYVIINDTNVSKVPYYHDLVSLFEKSLPEGSRLLRYDVKPGEAHKSRETKADIEDYLLLEGCTRDTVIIAVGGGVIGDMIGFVASTFMRGVRVIQVPTSLLAMVDSSIGGKTAVDTPLGKNFVGAFWQPQFVFVDIKWLETLPQREFINGIAEVIKTACIWNGEEFARLEANAETFLSVVNNSQTVSVFSPHHNETVELTYTNIESMLEHTYKLVLESIKVKAHVVSSDERESGLRNLLNFGHTIGHAYEAILTPQALHGECVSIGMVKEAELSRYMNILSATQVARMVKILAAYGLPISVNEKWFKELTLNKKTPLDVLLKKMSIDKKNDGSKKKVVILEKIGKCYGTSAHVVSDEDLRFVLSDETLVHPFNNIPEGQNKVITPPGSKSISNRALILAALGKGTCKIKNLLHSDDTKHMLNAVQQLKGATISWEDDGETVVVHGQGGSTLTAPSEALYLGNAGTASRFLTTVAALAKKDGKNDHVILTGNARMQERPIGPLVDSLRSNGLKIDYLNRQGSLPLKINTETNFKGGKIELAATVSSQYVSSILMCAPYAEEPVTLSLIGGKPISQLYVDMTIKMMDAFGIKVTTSTTEPFTYHIPKGNYINPAEYTIESDASSATYPLSFAAITGTTVTVPNIGSASLQGDARFAVDVLRPMGCEVTQTATSTTVTGPPRGQLKPLKHVDMEPMTDAFLTASVVAAICNNGTTNTTTIEGIANQRVKECNRIEAMVTQLAKFGVRANELPDGIQIHGVNSISELRQPSDAGIETYDDHRVAMSFSLLAGMVNSDKKDDESSVRILERQCTGKTWPGWWDVLHSQLGARLDGAEPSTTKSSEVKKSVVIIGMRAAGKSTVSKWCAESLGYRLLDLDEEFERQYGKGTVKDFVAESGWDEFRKEETRIFQEAVDKYGDKGYVLSSGGGIVERSESRQALKRFAESGGIVLHLHRDIEETIVFLKSDPTRPAYIEEIRDVWERREKWYHECSNFTFFAAHCSNEIEFRNLRHVFSNFIRRVLGAEKIPVPSRRSAFVCLTFEDLSDHLSKLDEITYGCEAVELRVDHLSSFSSDFVTKQISLLRAATKSLPIVFTVRTVSQGGKFQDDDYDLLESLLKVALKNAVEYIDLELTLPNNILYNVLNKKSNTKIIGSHHDFAAKFPWDDAEWENRYNQALSLDVDIVKFVGTAVSFDDNLALEKFRSTHTLKPLIAINMTETGKLSRVLNNILTPVTSKLLPSAAAPGQLTLAEINQLYHQIGGLPAKKFFVIGSPIGHSRSPILHNTGYELLGLPHHFDKFETEDIEVVKKELLTREDLGGLAVTIPLKLDIIDSMFELSEAAKTIGAVNTVIPLGKNKFRGDNTDWLGIKNSLVSNGVPSSVSGSAGLIIGAGGTSRAAIYALKQIGCDTIYMLNRTTEKLQKLKSEFSEEYKIVVVESAEQTESIKEQVSVAVSCVPADKPLDPELLNKLERLLAKGTNSSFKPTLLDAAYKPSVTPIMKLARDKFNWNIVPGAEMLVHQGVEQFSKWTGAKPPFKAIFDAVTQE

SEQ ID NO: 42519 - protein, 563 aa, Mycobacterium tuberculosis H37Rv
MSAKENPQMTTARPAKARNEGQWALGHREPLNANEELKKAGNPLDVRERIENIYAKQGFDSIDKTDLRGRFRWWGLYTQREQGYDGTWTGDDNIDKLEAKYFMMRVRCDGGALSAAALRTLGQISTEFARDTADISDRQNVQYHWIEVENVPEIWRRLDDVGLQTTEACGDCPRVVLGSPLAGESLDEVLDPTWAIEEIVRRYIGKPDFADLPRKYKTAISGLQDVAHEINDVAFIGVNHPEHGPGLDLWVGGGLSTNPMLAQRVGAWVPLGEVPEVWAAVTSVFRDYGYRRLRAKARLKFLIKDWGIAKFREVLETEYLKRPLIDGPAPEPVKHPIDHVGVQRLKNGLNAVGVAPIAGRVSGTILTAVADLMARAGSDRIRFTPYQKLVILDIPDALLDDLIAGLDALGLQSRPSHWRRNLMACSGIEFCKLSFAETRVRAQHLVPELERRLEDINSQLDVPITVNINGCPNSCARIQIADIGFKGQMIDDGHGGSVEGFQVHLGGHLGLDAGFGRKLRQHKVTSDELGDYIDRVVRNFVKHRSEGERFAQWVIRAEEDDLR

SEQ ID NO: 42520 - protein, 251 aa, Leptospira interrogans serovar Lai str. 56601
MSSMKNVIITGASSGIGKELARLYAQTGANVALTARRKDVLKKIVEELKSSGTKGKILFASLDVSDADQNFKVIPKLIKELGGLDLIVLNAGISTTSSFGGRSFEADRAVIETNLIGAMAGVEAVLPVFQKQKSGQIVAISSVASFRGLPGSASYSSSKAGLSVYMEALRGEVKRYGISVSVIHPGFIDTPINNRMKSRPFVISVERGAQKIFKRIENNVLSATVPWFPWVFLGYLMKRIPEFLWSKISLK

SEQ ID NO: 42521 - protein, 339 aa, Oryza sativa (indica cultivar-group)
MALASALSCLLACRWSRLSLSFESPRLVMCSAHGDVGAGQSGGGGAGAGGVPRHPRLSQIRDQQPDAHLEAFQIDLSSYKSIKKFETSLNQWIKDSNVEHSIQLLVNNAGILAKSYRITEDGLDEMIQANYIGPFVLTNILLPLLKNSSTPSRVVNLTSFTHRCVSEINLSEKGLSGVRSADPGVVQTGIMRELPPCLSWLALSVLRLLNLLQQPDTGVDAVLDAALAPPDSSGKYFFGGKGRTITSSQLSYNVEVAKKLWAESLALFNELQNRVYSVRWAIVSGLFSKLDKCLCTNFYKLHCKLVLVTTPFVPSNLEWDVTYPVQIMGWKQYKLGTSL

SEQ ID NO: 42522 - protein, 247 aa, Glycine max
MGMAAAESQFHVLAVDDSIIDRKLIERLLRTSSYQVTTVDSGSKALEFLGLRENDESNPSIPSVCPNNHQPQVEVNLVITDYCMPGMTGYDLLKKIKESSSLRNIPVVIMSSENVPSRINRCLEEGAEEFFLKPVRLSDLNKLKPHMKKTKFKDQKQETVERFEDSEVQQQQSQQQIIIQNEHHQAPKLQVLQPESESESHPQPTIEQQQQILQQANNNNKRKTMEQGLSPETDRTRPRYSGIATVV

SEQ ID NO: 42523 - protein, 422 aa, Leptospira interrogans serovar Lai str. 56601
MGEFNQKKVVVIGAGFGGLQAVKQLSQNNNLDITVIDKKNHHLFQPLLYQVATAVLSPADIAIPTRSLVGESKNVTVVLGEATKIDLKTKTVYYQNTSTNYDYLILSAGARSSYFGNDHWEKYTIGLKNLKDALKIRHKLLISFEKAELSGDPEVVKSLLNYVIIGGGPTGVELAGSIAELSHQIIRDEFHTIDPALSKITLIEASPRLLMTFDPSLGEFTKKRLERRGVEVLTGTRVIDINERGVQLEGKMIPTQTVIWAAGVQANSIAATLGVTLDRGGRVIVDEFCNIEGHSEVFVIGDIASYSKGLERPLPGVSPVAMQQGRYVASLIQNDLKNKKRKPFHYIDKGSMATIGRTDAVAQVGILKMKGLFGWLAWLFVHLFYQVGFKNKITILITWVWSYIAFRAEARVIQDEISADNG

SEQ ID NO: 42524 - protein, 492 aa, Debaryomyces hansenii CBS767
MSNRDSSEHGDSSNKIASNECNEATKLGFNFTQLWLQITTTYSLIDRNDSNMFNRDERVESEQEKKSVVILGKKYDDISVDDGVIEQDIYSKIWLTYRTGFEPIAKCLDGPQPLSFVQSMVFNRNPISSTFNNFHGLLDNDNFTTDVGWGCMIRTSQALLANTYQLLFLGRGFSYGRDRSPRHDEIIDMFMDEPRAPFSLHNFIKVASELPLKVKPGQWFGPNAASLSIKRLCDNVYESNGTGRVKVVISESSNLYDDIITQMFTTLNPVPDAILVLLPVRLGIDKVNPLYHASVLELLALRQSVGIAGGKPSSSFYFFGYKGNDLLYLDPHYPQFVRNKTSVYDTYHTNLYQKLSVDDMDPSMMIGILIKDINDYEDFKSSCTKSSNKILHFHPTSEKADRRGSLSEFKRKNSEFVCIESKDVQRREDFITIDNVSRDDLNNMEGFIDMADEFDSEIDQNNKDDNFDDDEPVNVSQTSIGEEYTSTAGSRP

SEQ ID NO: 42525 - protein, 220 aa, Coxiella burnetii RSA 493
MSKNELKKAAAMEAIQFVKNVNIVGVGTGSTVNYFIDALAEIKHQIEGAVASSVATENRLKEHRIPVVDLNSVSNVDVYVDGADEFNKHFYLTKGGGGALTREKIIAAAAKRFICIVDESKQVDVLGQFPLPIEVIPMARSFVAREIVKLKGDPVYRQGFTTDNGNVILDIHNLTILNPVELEAILNNIPGVIANGLFAQQPADDLLIGTPAGVQLHHRK

SEQ ID NO: 42526 - protein, 117 aa, Pseudomonas putida GB-1
MGRLTTHVLDAAHGCPGSSIKVELYRVEGQQLELVNTALTNSDGRVDAPLLQGDDYRTGVYQLQFSAGDYYRARGVQLPAQAFLDVVVLRFGIDEQQEHYHVPLLISPYSYSTYRGS

SEQ ID NO: 42527 - protein, 717 aa, Alteromonadales bacterium TW-7
MIKKLLLIVIAAAAIGAFFHFNLHHLLTLDGLKGSMDQFDQYKAQSPLLVIGGFFLLYVVVTALSLPGAAILTLAAGALFGLVEGLLVASFASTVGATLAFLVSRYLLRDTIKQRFPERLDAIDAGVEKEGGFYLFTLRLVPVFPFFLINLLMGVTAIKSWTFYWVSQVGMLAGTFVFVNAGTQLAQIESLSGILSLDLILSFALLGVFPFIAKGILNVFKKRRVYKNYTKPKKFDRNMIVIGAGAGGLVTSYIAAAVKAKVTLIEAGEMGGDCLNYGCVPSKAVIKSAKIAEQIRHGEHYGLENATPQFSFKKVMARVHKVIADVAPHDSVERYTNLGVDVVKGYGKLLDPWTVEIKLNDGGTQTLTARTIVIATGARPFVPPLPGIEETGYVTSDTLWTKFAELEEAPKKLVVLGGGPIGCELAQSFARLGSSVTQIEMSERIIIKEDLEVSTFAHEALTESGVNILTSHQALRCEERDGKKFIMVKHNDTEIDIEYDELLCAVGRSARLKGYGLEELGIETNRTVVTNEYLETLYPNIFAAGDIVGPYQFTHVAAHQGWYAAVNGLFGNLKKFKVDYRVIPWTTFIDPEVARVGLNEQDAIDKGIDYEITRFEFEELDRAITDSATKGFIKVITPKGKDKILGVTVVSEHAGDLIAEFVLAMKHGLGLNKILGTIHSYPTWAEGNKYAAGEWKRAHAPEKVLNMLEKYHTWRRG

SEQ ID NO: 42528 - protein, 395 aa, Coxiella burnetii RSA 493
MNKWEKIPYGFDESALKRRRQWMKEQGLNWESCSPELSGSMRGLIENHIGQIAIPLALAGPCVIDGTYAQGTYYMPVATLEGTLTLSMSRGFYATAQCGGIQTQHIQQMISRSPIFSFKDLNSLKVFSTWVTEHFNTIKNVAEQSTQYGKLIRIDQYQVHDHLILDFVYTTAEAAGQNMTTFCTHNACEFIRGTLAEHLSFTYLLESSFNADKKPSTKTLLAGRGHKVIASCVLSAAVCKRTLGISPRQLAEGMRVARYASTLANIVGINLHVANALTAIYLATGQDCACVSENAVAFFDILYLPESDEAKCVLTMPSITVGTVGSGMQLPQQQSNLKLINCVGKHSSKRLAELITASALALEISLAAAIGANKFAKAHMIFGRKKKKRKVHEKI

SEQ ID NO: 42529 - protein, 421 aa, Chromobacterium violaceum ATCC 12472
MSQQQLMQRKSDATPRGVGVMCSFFADRAKNAEVWDTEGRRYIDFAGGIGVLNTGHLHPKVEAAVAEQLSRFSHTCYQVVPYESYISLAEKLNALAPGKHAKKTAFFTTGAEAVENAVKIARAATGRPGVIAFGGAFHGRTLMGMALTGKVAPYKLGFGPFPSDVYHAPYPNTLHGVSVQDSLVGLEKLFKFDIDPARVAAIIYEPVQGEGGFYAAPAEWVKALRELCDRHGILLIADEVQSGFARTGKLLASEHFDAVPDLITMAKSLAGGFPLSAVTGRAEVMDAPAPGGLGGTYAGNPLALAAAHAVLDVIDSEKLAERAQRLGDALKEKLNGLKSAVPQIAEVRGLGAMIAVEFNQPGSHQPDPDFAKKVQQHALANGLILLTCGIYANVVRFLFPLTIEDEIFAEALGKLEAALKA

SEQ ID NO: 42530 - protein, 477 aa, Mycobacterium sp. JLS
MVDLAASYVAGKWVSSGSAEQMDVTSPTTGKVLGTVGIAGSDEVDAAVAAARGALRSWGRTSPADRGAALGRLADALTARKSELADLATAEIGSPRSWSTFGQVITAAGVLRAYATITPGHPFSSSRPSMTGGSVEVRQLPVGVVGAIVPWNTPLFIAALKLGPALAAGCTVVLKPAPDAPLGFGVLMEAIEEAAIPDGVVNLVNGGAATGEMLTEHPGVDKVSFTGSTAVGAKIAASCGSRIRRCSTELGGKSAAIVLPDASLTETVTGLVSGVMGNNGQLCAALTRILLPRSRYSEFVDALTTAVADLTVGDPADRSTDIGPLINEAARNRVEGFLQRARAEGATVATGGERPEGTGWFVTPALVEATNDMEIAREEVFGPVAVVIAYDDDGDDVSEAVTIANDSRYGLVGAVWSADEERAASVAAQLHVGSVAVNSTAVLDFASPFGGFKQSGIGREGGPEGITGFIEYQAIIR

SEQ ID NO: 42531 - protein, 486 aa, Chromobacterium violaceum ATCC 12472
MLNLQDPSLLRQQCYLGGEWLDADGGQHIAVHNPATGEKIGQVPKMGAAEAERAVAAAARAFPAWKAKSAKERAAILRRWFDLIIAHQQDLAIILTSEQGKPLAEAKGEIAYGASYIEWYAEEAKRVYGDIVPGPAGDRRVLVTKEPIGVTAAITPWNFPSAMITRKAAPALAAGCTMVVRPASQTPLSALALAELAERAGIPAGVFSVITGGSSEIGAVLTGSDTVKKFSFTGSTEVGRKLIAQCAGTVKKVSMELGGNAPFIVFDDADLDAAVEGALISKYRNAGQTCVCANRIYVQDGVYDAFAEKFAAAVATLKVGNGLEAGVSQGPLIDHNAVAKVEEHIADALAKGGRLIAGGKRHALGHTFFEPTLIADVTRDMKVAREETFGPLAPLFRFKTEEEAIRLANDTEFGLASYFYARDVGRIFRVAEGLEYGMVAVNSGLLSNEAAPFGGVKQSGLGREGSKYGIEDYLEIKYVLLGGLDR

SEQ ID NO: 42532 - protein, 448 aa, Oceanicola granulosus HTCC2516
MTETLDLIVIGAGMAGINAAKKCSKAGWSVAIVDELPYGGTCALRGCDPKKMLRAGAEAVEAAQRLTGKGISGETRIDWPALMKHKESFTDPVPENMESGLKEAGVQTLHGRARFIAEDRIEIEGHGEIGFRHALIATGAKPRPLDFPGAEKLVDSTDFLNLAELPRRIVFVGGGYISFEFAHIAARAGAEVTILDRGARQLKMFDPDLVDMLIERSRAAGIEIVAEAAIEQVEDKDVGHRVVYRRGDENHAIEADLLVHGAGRVPAIDHLDLAAGGIETERGGVKVTPWLQSPSNPRIFAAGDAAASPGKPLTPVAVFEGKIAASNMLKDKRTEPDYTGVPSVVFTIPELARVGLLEEEARERGDVDVSFTDTSGWFSQKRLGESHAGAKVITGKDGKVLGAHMFGPDYAELINVFSLAIKLGLTAAQVKSMPAAYPTGASDIGSMF

SEQ ID NO: 42533 - protein, 397 aa, Azoarcus sp. EbN1
MRRIGEVADTVHCVVDIVEKGVLCCPEVRLCDYRRAMLAFAHLMRIDHIRQRLRASGAKPCHEQRVLRAWTHALPLDRGRCRSEDFFPAPLGARLPALGAELAALAQVRSEHAGEDGARLLVELADGQTVESVLLPRDGLCVSTQVGCAVGCAFCMTGRDGLLRQLGSAEIVAQVVLARSRRAVRKVVFMGMGEPAHNLDNVLEAIALLGTEGGIGHKNLVFSTVGDRRVFERLPQGSVKPALALSLHTTRPALRTKLMPRAPRLDPAELVELGETYARATGYPIQYQWTLLAGVNDDDEELDGIVRLLAGKYAVMNFIPYNSVAGAGFARPSWEHAAAMARYLHRRGILTKLRHSAGQDVDGGCGQLRARVIASGALGQPAEAAPDRVVLVRRGQA

SEQ ID NO: 42534 - protein, 147 aa, Azoarcus sp. EbN1
MKSVAAILKEKPDPTVHTIGPDASVFDALGRMAEHNVGALLVMEGERLAGIVSERDYARKVILLARSSRDLTVSAIMSSPVMYVSLNQTNEECMALMTEKRLRHLPVVESSRVVGIVSIGDLVKSIVSEQRFIIEQLEHYIAGDRGI

SEQ ID NO: 42535 - protein, 449 aa, Burkholderia xenovorans LB400
MTVETTSIDTLVVGAGQAGVAMSEHLSRLGVPHLVLERARIAERWRTGRWDSLVANGPAWHDRFPNLEFADVDPDAFAPKEQVADYFVAYAKKFDAPIRTGVEVKNVVRNAGRQGFTIETSEGTIEARRVVVATGPFQRPVIPPIAPQDSSLTQIHSADYRNPGQLPEGGVLVVGGGSSGVQIADELQRAGRRVYLSVGAHDRPPRAYRGRDFCWWLGVLGEWDAEVMKPGREHVTIAVSGARGGHTVDFRRLANQGITLVGLTKSFDNGVATFETDLAENIARGDENYLSLLDAADAYAARNGLDLPEEPEARVIPADPECVTHPLHDLDLAKAGVTSIVWATGYALDFSWLNVDAFDEKGKPKHQRGVAKEPGIYFLGLPWLSRRGSAFIWGVWHDAKHIADHIVTQRKYLAYYDDSQRHAQGGSEQSTGNTSADSRVHKVSELGVN

SEQ ID NO: 42536 - protein, 748 aa, Campylobacter lari RM2100
MTNHFGDVTKHSKMMIIFGANTAVANPIGFKHLLQAKDRNNAKLVVVDPVFTKTAVHADEYVRIRPGTDIALVYGMLHLIFKNGWEDKEIIKTRTYGVEEIKAEAAKWTPEVVEDVTGVPAAQLEKITRMLATIKPATLFWALGITQHSVGSSNTRILAILQLVLGNIGKPGAGTNIIRGHDNVQGATDMGCLADTLPAYYGLDDNAWNHFANFWNVDREYLNSRFYSKEWMHEKGFSLAKWWQGVLHEEKTYSNSPIRVLWVQGTGITSMAHTVKIQEALKKLDMIVIAEPFVNEVAVLADRPDGIYIIPACTQFETEGYVTATNRAMQWRSQVVKPIYESKEDQEIMFAFAKKFGFYKEYTRGMKMELKDHKLVQTRDDNDDNFIWPDDATREMSNGLLSIGLRGISAERLRKHQQNWEHFDPDTQRGLGGEVKGEYYGLPWPCWDKQHPGTSIMWNTDIPYEEGGMGFRNRFGLEHDGHSQLADEAFTPKGCKVKGGYPQITKENIEKVFNIKLSDKEKELMGASWSTDISGIILEKCREKSACCLGNARARMKVWEFADPIPLHREPIHSPRWDLVKKYPTWGDQEKNFRVESKFISEQQKTDWSKEFPTIISSMRLVNLSGAGMLERTSKYLAAITPEMFANVHPELALKYGINDGDMMWIHSPQGTKIKVKCVHNHSVTPDRICLPYNFAGIMQGVDLSYNYPEGTKPYTIGESSNTVTNYGFDINTQISEFNAGLCRLEKA

SEQ ID NO: 42537 - protein, 175 aa, Triticum aestivum
MPPPVMASSATSVAPFQGLKSTPGLPVSRRSYGASIGSVSNGGRITSMQMWPIEGIEKFETLSYLPPLSTEALLKQVDYLIRFKWVPCLEFSKVGFIFREHNASPGYYDGRYWTMWKLPMFGCTDATQVINEVEEVKKEYPDVYVRIIGFDNMRQVQCVSFIAFKPPGCAESGKA

SEQ ID NO: 42538 - protein, 339 aa, Listeria monocytogenes str. 4b F2365
MSKDIDWSNLGFSYIKTDKRYISYWKDGEWDEGTLTEDNTLHISEGSTALHYGQQCFEGLKAYRCKDGSINLFRPDRNAARIQKSCERLLMPHIPTEKFIDAVMQVVRANEEFVPPYGTGATLYLRPFVIGVGDNIGVHAAPEYIFSVFCSPVGPYFKGGMAPTNFIVSDFDRAAPNGTGAAKVGGNYAASLLPGQAAKERNFGDCIYLDPATHTKIEEVGSANFFGITKDDKFVTPYSPSILPSITKYSLLYLAEHRLGLEALEGDVYIDKLDEFKEAGACGTAAVITPIGGIQTKDDFHVFHSETEVGPVTKRLFDELCGIQFGDVEAPEGWIYKVK

SEQ ID NO: 42539 - protein, 369 aa, Photobacterium damselae subsp. piscicida
MKSRAAVAFGPGLPLEIVEIDVAPPKKGEVLVKISHTGVCHTDAYTLSGDDPEGLFPVVLGHEGAGVVVEVGEGVTSVKPGDHVIPLYTAECGECDFCTSGKTNLCVAVRETQGKGVMPDATSRFFVNGQPLYHYMGCSTFSEYTVVAEVSLAKINPQANAEQVCLLGCGVTTGIGAVHNTAKVQEGDSVAVFGLGGIGLAVVQGARQAKAGRIFAIDTNPSKFELAKQFGATDCINPNDYDKPVQQVLVEMTKWGVDHTFECIGNVNVMRSALESAHRGWGQSVIIGVAGAGKEISTRPFQLVTGRVWKGTAFGGVKGRTQLPGMVEDAMSGKIELAPFVTHTMELDKINEAFDLMHDGKSIRTVIHY

SEQ ID NO: 42540 - protein, 522 aa, Triticum aestivum
MSSMQFSSVLPLEGKACVSPVRREGSACERLKVGDSSSIRHDRASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGQSDPSFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 42541 - protein, 702 aa, Arabidopsis thaliana
MAPALAVTRDLTAVGSPENAPAKGRASVYSEVQSSRINNTLPLPSVLKGAFKIVEGPASSAAGNPDEIAKLFPGLYGQPSVAVVPDQDAPSSAPKLKIGVVLSGGQAPGGHNVISGLFDYLQERAKGSTFYGFKGGPAGIMKCKYVELNAEYIQPYRNQGGFDMICSGRDKIETPDQFKQAEETAKKLDLDGLVVIGGDDSNTNACLLAENFRSKNLKTRVIGCPKTIDGDLKCKEVPTSFGFDTACKIYSEMIGNVMIDARSTGKYYHFVRLMGRAASHITLECALQTHPNITIIGEEVSAQKQTLKNVTDYMVDVICKRAELGYNYGVILIPEGLIDFIPEVQELIAELNEILANEVVDENGLWKKKLTEQSLKLFDLLPEAIQEQLMLERDPHGNVQVAKIETEKMLIQMVETELEKRKQAGAYKGQFMGQSHFFGYEGRCGLPTNFDATYCYALGYGAGVLLNSGKTGLISSVGNLAAPVEEWTVGGTALTALMDVERRHGKFKPVIKKAMVELEGAPFKKFASLREEWALKNRYISPDSNPFAGMLSTCRDREERETKKRRLLLIMGQERPNDEERPESRDLGVYGCSPPHSPRLGPTRFYVFAGDPNPKQTIKRCKRKRIQACNDQRTAKTAIGVMAILGFFCLVNWFMLSRLHEGRVWLRRGLSENPKHVSAQNEERKKFEKRTRGNIMEHMVEC

SEQ ID NO: 42542 - protein, 529 aa, Oryza sativa
MAMGMMENLGSVSTLWSALVSVLLFWPVVNNHVPAGLRQWLSTMVDKLTSYLSPYLHVTISEYGHQRFRRSDFFLAVEAYLSHACARRARKLRADLGKDARTVQITVDDHQEVTDSFRGATIWWYPSKKPPRTNVISFYPRDDDARFYRLVFHRRHRDLVLDAYLPHVLAEGRAVTIRNRQRRLFTNNAPGASTSYYSRKSVWSHVPFEHPATFDTLAMEPADKDAILDDLTAFRDSKDYYAKVGKAWKRGYLLHGPPGTGKSTMIAAMANFLDYDVYDLELTAVKTNTDLRKLYIETTGKSIIVIEDIDCSVDLTAKRSNDKKKKKSSDEDDDDKPKLPTEQEKDEASKVTLSGLLNFIDGLWSACGGERIIIFTTNHKEKLDPALIRRGRMDVHIEMSYCRFEAFKVLAKNYLGVEQHEMLVEIRRLLEEIDMSPADVAENLMPKASKGKKRDPDACLAGLIEALNKAKVEAAEAAKAKEEEEAAAAKAKEEEEAAKAKAAKEKEKDDEAAGTKVDETVNNKSNGTI

SEQ ID NO: 42543 - protein, 209 aa, Triticum aestivum
PKCIGQQFGILQDLLERSDDAVQSTNDAMLYTLSKEELLELFETVSDQLSLVWSGFLKFHRTNKLKILDYLHDIWDVDRKSEWSIWIVHSKIEIPHRYMHGMGDSSSPRHSLRRVSSSKKLHHDPVQNASSRAELHRKSIAQMKINARSVQDMHIYANPSRVPVVLIEQHVMVVPQHGCNKDLLANAPDLYNTSVPPNLQGSFSPSGKN

SEQ ID NO: 42544 - protein, 712 aa, Oceanicola granulosus HTCC2516
MTTSAELIALVRSYNPRSDAALLRRAYAFGEEMHEGQKRQSGEPYFTHPVAVAVILAEQQMDDASIVTALLHDTIEDTRANFAKVEELFGREIAELVDGVTKLTNLQLSSTETKQAENFRKLFMATSRDLRVTLVKLADRLHNMRTIRSMRPEKQAQKARETMDIYAPLAGRMGMQWMRDELEDLAFRVLNPDGRNSIIRRFITLQRETGDVIEKITADMRLELEKAGIVAEVRGRAKKPYSIWRKMQAKDQGFSRLSDIYGFRVITATEADCYRVLGTIHQRWRAVPGRFKDYISQPKSNGYRSIHTTVSGRDGKRVEVQIRTREMHEVAETGVAAHWSYRDGERVENRFAVDPQRWITALTERLDEGHDHDEFLDMVKLEMYTDQVFCFTPKGEVIKLPRGATPIDFAYAIHTRIGHACVGAKVDGMRVPLWTRLKNGQSVEIITAEGQTPQATWIDIAVTGRAKTAIRRSLREEDRERFIKLGRELARVAFENVGKRATDKALATAAKALALEGPDDLLELLGSAEITSREVVRTIYPDLAEKPAETVDARRAIVGLESGQKHLRAPCCQPVPGERIVGITFRGHGVFLHAIDCAVLAQYENQNERWIDLQWQEGVHPAVNTVTLDISISNDAGVLGRICTLIGEQSANISDLSFIDRKPDYFRLLIDVDVRDAEHLHRVMTALEADSNVASIERSRDPDRAATVPFKG

SEQ ID NO: 42545 - protein, 307 aa, Triticum aestivum
  misc_feature (244)..(244): Xaa can be any naturally occurring amino acid
  misc_feature (258)..(258): Xaa can be any naturally occurring amino acid
  unsure (1)..(307): unsure at all Xaa locations
MDPCPFVRVLVGNLALRMPVAPPAAGAGAGVHPSTSPCYIKIRLGKMACQTAAAPLVLSDAAAEQPPSGALAAAFHLSKADLEWFARKPSLFSPSRGAATLKVSVYAGRKGTTCGVSSGRLLGKATISLDLKGAEAKPAVLHSGWMSVGRRGVGGKGGGPAAADLSLTVRAEPDPRFVFESDGEPECTPQVMQVRGSMKQPMFTCQFGCRTNSDLRRSVAQTEPEAAGEERLGWSVTVHDLSGXPVALVCMDDTFVAXPEDDRVSRSTRGRCSAPTRGHRRVTEGRIIVMARGDWSLRQVTDKVRAG

SEQ ID NO: 42546 - protein, 401 aa, Bifidobacterium longum DJO10A
MKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAAGAFTIVGGGDSASAVRNLGFPEDGFSHISTGGGASLEFLEGKELPGLKVLE

SEQ ID NO: 42547 - protein, 925 aa, Aspergillus nidulans FGSC A4
MAPSSQAAQRIEEARALAKKDASQAASIYKEVLAQGPGSTESSSRDYENALVGLGELYRDEKKPQEIAELIKTSRDSFSSFAKAKTAKLVRQLLDLFSEIPNTLDIQIAVIRSCIEWAVAERRSFLRQNLETRLVAIFMQKQSYYDALNLINSLLRELKRLDDKLMLVEVQLLESRVYHALGNQAKARAALTAARTSAASVYTPPNLQAGLDMQSGMLHAEDKDFNTSYSYFIEALEGYSSLDEGEKATAALQYMLLCKIMLNLVDDVTTLLGSKQAQKYASPRLEAMKAVARAHANRSLEEYEKALSDYRFELGSDAFIRNHLRRLYDAMLEQNLIKVIEPFSRVELDHIAKMVGLDTQQVERKLSQMILDKVIIGVLDQGAGCLIVYDETERDQAYDAALETIARLNFFGFPDKLPIMNAPPMPPGYGRAYPQGVQRSPATPRRGPQAPGPMPVPMPQHAVPPQYMAPQRNLQHQNDAALRRSRKPTDKNIPDGVEDVVIGEGVQQYKSLRDLEKRLDAAIVRKRLDIQDSISKTVKKYRTMRIWVSNTVENQPWQTGQNGSVPGTTPGSGRYKVRIEGRLLEDVSDLAEKDSDDEGGAQGPGDAMAEDGSDGKKAATTKRSEQRFSHFFKSITVDFDKSPSTSPAEMQTITWTKPQVPPNAVNLPPNADFDSVQFSRASQENLNVTISLVRDETPERYKLSKELAEVLDVEEETRSGIVLGIWDYIRAMGLQEDEEKRLVRCDDRLRAIFGRDQMFFPQIPESIGPHTSPLDPIKLPYTIRVDEEFHKDPTPTVYDIQVAVEDPLRSKMLALTQNPQYAAGMRQIAQLDDQVALIIQALTHSRAKHSFFTALSKDPATFVRRWINSQRRDLETILGEATRGGGEDASGPEFRRGGSNSVWDTAVAHEAVRYMLAKPDAGMSR

SEQ ID NO: 42548 - protein, 181 aa, Guillardia theta
PKFSPAETQLPTEELDKLAGPKLVSWYKRMLSQPSFAKVQQEISDALSKWDENNRWAGILHAGKRDEAEQTIFDKIVAKSIPSQVVFEDDKVLVFKDINPQAPTHLLVIPKRRETLSQLRFATAEHEGILGHMLAVVAKVASEEGLGDYRLVVNDGRGAGQEVFHLHMHVLAGRPLTWPPG

SEQ ID NO: 42549 - protein, 259 aa, Glycine max
YGCEKTTEGFVTVGERGIVRIWNSKGAGCIFEQKTSDVTAGMDEDGSRRGFTSAVMLASDQGLLCVTADQQFLFYSLDFTEQLLQLNLTKRLVGYNEEIVDMKFIGDDEKFLALATNLEQIRVYDLSSMSCSYVLSGHTEIVLCLDSCVSSSGKPLIVTGSKDNSVRLWESESANCIGVGIGHMGAVGAIAFSKRKQDFFVSGSSDHTLKVWSMDGLSDNMTMPINLKAKAVVAAHDKDINSVAVAPNDSLVCSGSQDR

SEQ ID NO: 42550 - protein, 359 aa, Salicornia herbacea
MSAFVGKYADELIKTAKYIATPGKGILAADESTGTIGKRLASINVENVESNRQTLRELLFTSPGALPFLSGVILFEETLYQKTSQGKPFAQLLQENGVIPGIKVDKGVVELSGTNGETTTQGFDSLGARCQEYYKAGARFAKWRAVLKIGPTEPSELSIQQNAQGLARYAIICQENGLVPIVEPEVLTDGNHDIKKCAAVTETVHAACYKALNDQHVLLEGTLLKPNMVTPGSDSPKVAAEVIAEYTVTALRRTVPPAVPGIVFLSGGQSEEEATVNLNAMIKLEVLKPWTLSFSFGRALQQSTLKTWGGKKENLSKAQSVFLVRCKANSEATLGKYVAAGNSDNGAASESLFQKDYKY

SEQ ID NO: 42551 - protein, 377 aa, Alteromonadales bacterium TW-7
MTTAQKKINLLDLNRDAMRELFVSFGEKPFRGDQVMKWIYHFGVDNFDEMSNVNKKLKEKLKAECEIVAPEISVRQQASDGTIKYALVLEGGQEVEAVWIPEKERATLCVSSQVGCALECTFCSTAQQGFNRNLKVSEIIGQVWRVAKDIGLDGNSEKRPVTNVVMMGMGEPLLNVKNVVPAMELMMDDWGFGLSKRRVTLSTSGVVPALDLLKEKIDVALAISLHAPDNALRDILVPINKKYPIEEFLAACRRYIDGSKANKDVTIEYVMLNGVNDSTDQAHELVKTLKGTPSKVNLIPFNPFPGNEYTRSSNSRIDRFSKVLQAAGITCIVRRTRGDDIDAACGQLAGDVVDRTKRMAKKKMRDDNKISVNIQQA

SEQ ID NO: 42552 - protein, 345 aa, Streptococcus pneumoniae R6
MAKKIVALVGDGIGPEIMEAGLEVLEALAEKTGFDYEIDRRPFGGADIDAAGPPLPDETLKASREADAILLVAIGSPQYDGVAVRPEQGLMALRKELNLYANIRPVKIFDSLKYLSPLKPERISGVDFVVVRELTGEIYFGDHILEERKARDINDYSYEEVERIIRKAFEIARNRRKIVTSIDKQNVLATSKLWRKVAEEVAQDFPDVTLEHQLVDSAAMLMITNPAKFDVIVTENLFGDILSDESSVLSGTLGVMPSASHSENGPSLYEPIHGSAPDIAGQGIANPISMILSVVMMLRDSFGRYEDTERIKRAVETSLAAGILTRDIGGQASTKEMMEAIIARL

SEQ ID NO: 42553 - protein, 638 aa, Burkholderia xenovorans LB400
MSTGVQTKAAPGAGQHADGPRLLADIGGTNARFALETSPGEIGSVKVYPCADYPGVAEVIKRYLKDTKIGRVNHAAIAIANPVDGDQVSMTNHDWSFSIEATRRALGFDTLLVVNDFTALAMALPGLTDAQRVQVGGGTRRPNSVIGLLGPGTGMGVSGLIPADDRWIALGSEGGHATFAPADEREDIVLQYARKKWSHVSFERVAAGPGIEVIYRALAGRDKKRVAANVDTIEIVKRAMEGEPLAAESVDVFCGILGTFAGNIAVTLGALGGIYIGGGVVPRLGELFARSSFRKRFEAKGRFEAYLQNVPTYVITAEYPAFLGVSAILAEQLSNRAGGSSSAVFERIRQMRDALTPAERRVADLALNHPRSIINDPIVDIARKADVSQPTVIRFCRSLGCQGLSDFKLKLATGLTGTIPVSHSQVHLGDTATDFGAKVLDNTVSAILQLREHLNFEHVERAIDLLNGARRIEFYGLGNSNIVAQDAHYKFFRFGIPTIAYGDLYMQAASAALLGKGDVIVAVSKSGRAPELLRVLDVAMQAGAKVIAITSSNTPLAKRATVALETDHIEIRESQLSMISRILHLVMIDILAVGVAIRRAVPSADVAETVAKARQGADDDATAVLDWLSHGAASSARD

SEQ ID NO: 42554 - protein, 478 aa, Bifidobacterium longum DJO10A
MTELKSKEDVEALINKEGIEYVSVRFTDLIGVQQHFTVPASEFLKDAFTDGMPFDGSSVQGFQAINESDMKLVPDVETSFVDPFRKHKTLDVAFSIVDPLTDEPYSRDPRQVAGKAEAYLKSTGIADTASFAPEAEFFIFDKVRFENSMQRSFYEVDSIEAPWNSGVDVEEDGTPNIGFKNRVKKGYFPVPPIDHTQDLRDDMVANLQKVGLILERSHHEVAGAGQQEINYRFNTLQHAGDDLMKYKYVVHETAALAGKAATFMPKPIADDNGTGMHCHQSLWKDGKPLFYDEKGYAGLSDLARWYIGGLIKHSSSVLAFTNPSLNSYHRLVPGFEAPVNLVYSARNRSAAIRIPLAGTSPAAKRIEFRAPDPSCNPFLAFSAQLMAGLDGILNHIEPPEPVDKDLYELPPEEHAGIKQVPSSLAEAMDALEEDHDFLTAGDVFTDDLIETWIGLKRDEIDQARLAPTPLEYELYFHI

SEQ ID NO: 42555 - protein, 565 aa, Wolbachia endosymbiont of Drosophila simulans
MDSGDQERERGITILAKCTSIMWGDEKINIIDTPGHADFGGEVERVLCMADGVLLLVDAAEGPMPQTKFVLSKALKANLKPIVIINKVDRPDSRIDEVLNEIYELFFNLDATNEQLDFPVLYASGRNGWCAKELSDERKDLSPLFSTVIDYIKPSVYDQNAPFAMLVTLLESDKFLGRILTGKVYQGVAKVNSDLKVLDLDGKVIERGRLTKLLSFSGLKRIPVEQAVAGDIIAIAGLEEASVSDTIAAPEVTTAVSSTPVDPPTMAITLSVNDSPFAGQEGTKLTSTAIKDRLYAEAETNVAITVTLAPSGEAFEVGGRGELQLGVLIENMRREGFELSVSRPRVLFKEEDGKKLEPIEEVVIDVDDEYSGIIMEKLSFRKGEVTDMRPSGNGRTRLTFLVPSRGLIGYQGEFLTDSRGTGIINRLFHSYAPHKGPISGRRNGVLISTDKGEAVAYAIFNLQDRGIMFIKPQDKVYCGMVVGQHSRDNDLEINVLKGKQLTNVRASGSDEAIKLTPPKIMTLEDMIAYIDDDELVEVTPKSIRLRKKFLDPNERKRAGRAKNKE

SEQ ID NO: 42556 - protein, 341 aa, Medicago truncatula
MDEFIELIPGLPSELGLECLTRLSNSSHRVALRVCNQWRRLFLSDEFYSHRKNTGHTRKVACLVQAHEQQPHSEFDKQTGSTPPSYDITVFDPESMSWDRVDPVPEYPSGLPLFCQLTSCEGKLVVMGGWDPASYEPLTAVFVYDFRMNIWWRGKDMPEKRSFFATGSGYDRVFVAGGHDENKNALKTAWAYDPKIDEWTMLAPMSQDRDECEGTVVGGEFWVVSGYATESQGMFDDSAEVLDIGSGQWRRVEGVWEAGRCPRSCVDIRENGKVVDPGLRIGVCSVRVGSRKWVTGSEYEGAPYGFYLVENDEGQNRKLNKISSVPDGFAGFVQSGCCVEI

SEQ ID NO: 42557 - protein, 653 aa, Mycobacterium tuberculosis H37Rv
MRTPCSQHRRDRPSAIGSQLPDADTLDTRQPPLQEIPISSFADKTFTAPAQIRNFCIIAHIDHGKSTLADRMLQLTGVVDERSMRAQYLDRMDIERERGITIKAQNVRLPWRVDKTDYVLHLIDTPGHVDFTYEVSRALEACEGAVLLVDAAQGIEAQTLANLYLALDRDLHIIPVLNKIDLPAADPDRYAAEMAHIIGCEPAEVLRVSGKTGEGVSDLLDEVVRQVPPPQGDAEAPTRAMIFDSVYDIYRGVVTYVRVVDGKISPRERIMMMSTGATHELLEVGIVSPEPKPCEGLGVGEVGYLITGVKDVRQSKVGDTVTSLSRARGAAAEALTGYREPKPMVYSGLYPVDGSDYPNLRDALDKLQLNDAALTYEPETSVALGFGFRCGFLGLLHMEITRERLEREFGLDLISTSPNVVYRVHKDDGTEIRVTNPSDWPEGKIRTVYEPVVKTTIIAPSEFIGTIMELCQSRRGELGGMDYLSPERVELRYTMPLGEIIFDFFDALKSRTRGYASLDYEEAGEQEAALVKVDILLQGEAVDAFSAIVHKDTAYAYGNKMTTKLKELIPRQQFEVPVQAAIGSKIIARENIRAIRKDVLSKCYGGDITRKRKLLEKQKEGKKRMKTIGRVEVPQEAFVAALSTDAAGDKGKK

SEQ ID NO: 42558 - protein, 639 aa, Glycine max
MSRKLDSPVQTQMAVAVIRSSPLGREYHGKQPAGRRRVFVQTEKGCVLGMDLDRGDNVHTVKRRLQLALNVPVDESYLTFGDMVFKNDLSAVRNDTPLLLTRGKNNLMPRSSSTPCLSPKGRDIDKSGPIEILGQSNRLDGIKHMIKDIMKAIKMGIEPIPVHSGLGGAYYFRNSKGESVAIVKPTDEEPFAPNNPKGFVGKALGQPGLKRSVRVGETGFREVAAYLLDYDHFANVPPTALVKITHSVFNVNDGVNGNNLWRKRLFSKIASFQQFIPHDFDASDHGTSSFPVASVHRIGILDIRILNTDRHAGNLLVRKLDGIGSFGQVELIPIDHGLCLPETLEDPYFEWIHWPQASIPFSEDELAYIEDLDPYRDCEMLRMELPMIREACLRVLVLCTIFLKEAAAYGLCLAEIGEMMTREFRRGEEEPSELEVVCLEARKIVAERDREELSPGAEMRDDEFLFDIDYYDEVGSDFTPKMAIDDPLTRATFQPALGNGHARNPLSKLDECIEEEEEEAEGESPKGFVTSSTEEKIPSVSELSVSLKNTMLDGKNQNQQKYGGKVDNGHFANTSSGHKSANEQLPPSISFVDVTEMTEDEWSNFLEKFQELLYPAFAKRKSITLGQRQRQRLGTSCQF

SEQ ID NO: 42559 - protein, 353 aa, Pyrobaculum aerophilum str. IM2
MKIPIKMRAALYKAPGQPLELAETEIPTPGEGEILIKVAATGVCHSDLHILDGEIVPPPEGFILGHEVSGWVVDFGPRCENPHGLSPGDPVVISWIIPCGKCYWCVRGQENYCPYAAARMPGLVGLNGGHAEYMSVPETAVFPIPKEVDVHTAAVISCAYGTAYRALKEAAVGPGTSLVVIGVGGVGLAAVELASALGARPIIAVDVRKHVLEKAAELGATHLINATNGDPLSKIRDILPQGADVVYETKPNPDLKLAVEIVRRGGTIVVTGLGTSTIEIPANHIVMNGIRIIGSLGYKPRTDIPELLTLAASGKIKPQRLISHKYAPNEINEAYKNLRIGLHHRAIIIWNTK

SEQ ID NO: 42560 - protein, 142 aa, Mycobacterium tuberculosis H37Rv
MRIADVLRNKGAAVVTINPDATVGELLAGLAEQNIGAMVVVGAEGVVGIVSERDVVRQLHTYGASVLSRPVAKIMSTTVATCTKSDTVDKISVLMTENRVRHVPVLDGKKLIGIVSIGDVVKSRMGELEAEQQQLQSYITQG

SEQ ID NO: 42561 - protein, 118 aa, Triticum aestivum
  misc_feature (56)..(56): Xaa can be any naturally occurring amino acid
  misc_feature (76)..(76): Xaa can be any naturally occurring amino acid
  misc_feature (84)..(84): Xaa can be any naturally occurring amino acid
  misc_feature (96)..(96): Xaa can be any naturally occurring amino acid
  unsure (1)..(118): unsure at all Xaa locations
FASLGRPKRLFFIVNPYGGKRGGRKIFQTEVLPLIEAAGIHYTMQETNYRLHAQEXAGSLDLRKYDGIICVSGDGXLVEVVNGXLQRDDWGQSNKXPLGIIPAGTGKWDGARPIASCW

SEQ ID NO: 42562 - protein, 131 aa, Brassica napus
MASPKSSTRPTQQNQDPTFHDFFPAMAGKLGGEGLIDELCKGFELLMDRDRGVITFESLRRNASAVLGLGDLTDEDVRCMIDEGDFDRDGALNQMEFCVLMFRLSPDLMEASRCVVTEAIEEEFCDRTHRR

SEQ ID NO: 42563 - protein, 418 aa, Azoarcus sp. EbN1
MNKANLLYAQSGGVTAVINATAASVIEAARARADAVGRVLAARHGILGALDEDLIDTAPLSVVDLRRLAGTPGGAFGSCRFDLDPPEANRDQYDRLFAVLAAHDIGYFLYNGGNGSMDTVAKVSRAAAERGYPLVCVGVPKTVDNDLEGTDCSPGFGSAAKYAATSMLEAGLDLAAMTSRVGRAFVLEVMGRNAGWLAAATALAARNDDEPPHVILMPEVPFDEEAFLAVVRSTVSRLGYCAVTVSEGIRRADGSLLMEQDEDAKGHVQLGGAGQCIARLIHSRLGYKHHWAIPDYLQRAAGHLVSATDHAQARAVGQAAVEYALAGRDGVMAAIRRLADAPYRWDVAPVAVAAIANLERQVPRAFIRPDGLHVTDAARTYLRPLIEGEMPACFAGGLPDYPRFPLPGVPRKLAPYRP

SEQ ID NO: 42564 - protein, 489 aa, Shigella flexneri 2a str. 301
MGSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 42565 - protein, 743 aa, Oryza sativa
  misc_feature (684)..(684): Xaa can be any naturally occurring amino acid
  unsure (1)..(743): unsure at all Xaa locations
MAAHSVAAAHATIAARAGAAAPAPAPPERLGFRLSALAGRGLRSPLPPRRGAPSASASRRRHNNRVRAAAVETLEGQAATGALLEKSVNTIRFLAIDAVEKANSGHPGLPMGCAPMGHILYDEVMRYNPKNPYWFNRDRFILSAGHGCMLQYALLHLAGYDAVLEEDLKQFRQWGSKTPGHPENFETPGVEVTTGPLGQGIANAVGLALAEKHLAARFNKPDSEIVDHYTYCILGDGCQMEGISNEACSLAGHWGLGKLIAFYDDNHISIDGDTEIAFTEDVSARFEALGWHTIWVKNGNDGYDEIRAAIKEAKAVTDKPTLIKVTTTIGFGSPNKANSYSVHGSALGTKEVEATRENLGWPYEPFFVPEDVKSHWSRHVPQGAAFEADWNAKFAEYEKKYPEDAATLKSIVSGELPAGWADALPKYTPESPADATRNLSQQCLNALAKVVPGLLGGSADLASSNMTLLKMFGDFQKDTPEERNVRFGVREHGMGAICNGIALHSPGLIPYCATFFVFTDYMRAAMRISALCEAGVIYVMTHDSIGLGEDGPTHQPIEHLVSFRAMPNILMLRPADGNETAGAYKIAVLNRKRPSVLALSRQKLAQLPGTSIEGVEKGGYIVSDNSTGNKPDFIVMSTGSELEIVAKAADELRKEGKTVRVVSFVCWELFDEQSAEYKESVLPXAVTARVSLEAGSTLGWQKYVGSKGKAIGIDKFGASAPAGKIYQEYGITAENVIATAKSL

SEQ ID NO: 42566 - protein, 389 aa, Azoarcus sp. EbN1
MSHLMNTYARLPVAFTHGEGVWLFDETGKRYLDGLSGIAVSTLGHNHPRLVRAIAGQAAKVLHTSNIYRIPLQEELSDRLAAVSGMDEVFFCNSGCEANEAAIKLARFHGHRKGIEQPAIVVMENAFHGRTLATLSATGNRKTQAGFEPLVSGFLRVPYKDIGAIRTVGEHNHNIVAVMLEMIQGEGGVNIADETFQRDLRALCDERGWLLICDEVQCGMGRTGSWFGFQQGGVTPDVMTLAKGLGSGVPIGACVTSGRAAGLFGPGNHGSTFGGNPLACAAGLETLATIEDDGLMANAVKVGEAIRTGLQEALAGLSGVVDIRGRGLMIGIELDRPCGDLVRQALDAGLLINVTADRVIRLLPALVFTEANAQELVSRLAPLVRKHLE

SEQ ID NO: 42567 - protein, 358 aa, Staphylococcus xylosus
MSEKIEFVQRETLKEKPDPSDLGFGKYFTDYMLSFDYDIDQGWHDLKIVPYGPIELSPAAQALHYGQAVFEGLKAYKHEGEVDLFRPSENFKRINNSLSRLDMPKVDEETVLEGLKQLVDIERDWVPEGEGQSLYIRPYVFATEGILGVRPSYSYKLLIILSPSGSYYGGESLRPTKIYVEDEYVRAVRGGVGHAKVAGNYAASLLAQTNASAQGYDQVLWLDGVEQKYVEEVGSMNIFFVENGKLVTPELNGSILPGITRKTVIELAQNLGYEVEERRVSIDELIEAHNKGELTEVFGTGTAAVISPVGQLKYGETEIVINNNETGEVTQNLYDNYTGIQSGKLEDPQGWRVVVPRY

SEQ ID NO: 42568 - protein, 1343 aa, Trichodesmium erythraeum IMS101
MINWGPYLESVCREYDRWWEVYTLTDVAGKKPHEQGQNIFPSFDLGLMVQRVKSEEKQGKDPQEKIERLTVLEGLRKYAANHVLLVGRPGSGKSTALARLLLEEAHKVWSGENGQIPILIELRYSKSSVLSRIQAFIDKHNHNTYIDEETLKSLLLQGKFLLLFDGFNEMASEEARQQVRMFRQDYPETAMVFSTRDLSLGGDLRIEKKLEMQPLTESQMQDFVCAYLPEQGENLWGQLQGRLRELGETPMFLLMLCSVFDYNKVIPAHLGLVFRGFTQTYSGRIKQDVLVDESSRRWWDRLLQELAWVMTTGGSKTEMMVAIPRKKAEDVLADFLRGQVVAPTDCAMGWLEDLLEYHLIQVGDDGQISFRHQLLQEYYAAERLSSQLSGLSDYELQWDYLNYLKWTEVVALMLGLVEDEVLAVRVVRLALEVDWFLGARLVGEVKEKFQEAAFAEVDGLELPGLAKVVLAGLTMSEVTVPRLVQFLEHSDKYMRGSAAHALGKIASEKAIEELIPLLKDSDEYVRWSAAYALGEIGSETAIEGLIPLLKDSDSFVCWSAANAMGKIGSQKAIEGLIPLLKDSDSFVRYAAAEALGKIDSEKAIEGLIPLLKDSDPNVNFSARSALSQIGSEKAIEQLIPLLKDSDEYVRYAAAEALGKIGSEKAIEQLIPLLKDSDSSVRSRAVYVLGKIGSEKAIEGLIPLLKDSDEFVRYSAVYVLGEIGSEKAIEQLIPLLKDSNSSVNFSAAEALGKIGSEKAIEGLIPLLKDSDEFVRYTAAEALGKIGSEKAIEQLIPLLKDSDPNVRRNAAEALGEIGSETVIEQLIPLLKYSDPNVRYTAAEALGKIGSEKAIEQLIPLLKDSDPNVRYTAAEALGKIGSEKAIEQLIPLLKDSDPNVRRNAAYALGEIGSEKAIEGLIPLLKDSDSFVRSRAAYVLGEIGSEKAIEQLIPLLKDSDYWVRDHVAEALGKIGSENTIIKLTKKLQNDSFVKQDLYKIIKIIQTIQQRLQYYKPTPKIPMSKSLSHNYALLIGVGDYKYPDWSLPVTVKDVQAIKSFLTNPDLCSYIDDENHLRLLCNEQATKQNILNNINWLQEQAKNDPEATILVYYSGHGWLDKSTEKYYLIPHDTSPIKLQKTQKTALPATDFNNALQEISAQKLLVIIDSCHAQGMATAKETDQLDLPENFSQTALPKNLIEDLKKGTGRAVFTSSTGYQLSWIRSDQTMSIYTYHLLEALQGGDNKPGDKYVTLSNLMHHVGKTVPQSAQQQGGEQTPIFDFSQTEDFPVALLRGGKGLPAEGKEKIQLEAQENIRNAITVQQGNAAGGDVKNQVFIDKIEGGGGITFS

SEQ ID NO: 42569 - protein, 461 aa, Oryza sativa (indica cultivar-group)
MGRKIKVKKKKASSKVWQPGVDTLEEGEELQFDPQAYNYLRGFNIGWPCLSFDIVRDQLGLVRSEFPHTLYGVAGTQAERATWNYIGIFKICNINGKKREPIPASAIDGDSDMDSESSSDEEDEAVNEDTMPILHLKKVAHAGCVNRIRSMNQEPHICATWGDTGHVQVLIFDSRGTESKLYQRLEWTCEVWDFSSFLNSLAESGAVAHNEDDRIHNHVPVKIFGGHKDEGYAIDWSPLVTGRLVSGDCNKCIHLWEPTSNSWNVDTNPFWSPTEADIFASCSADRTISIWDIRTGKKPCISVRAHNADVNVVSWNRLASCMIASGCDDGSFSIRDLRLIKDDSLVAHFEYHKHPITSVEWSPHEPSTLAVSSADHQLTIWDLSLEKDAEEEAEFRARMREQADAPEDLPPQLLFVHQGQKDLKELHWHPQIPSMIISTAADGFNMLMPSNIDTTIREADA

SEQ ID NO: 42570 - protein, 2742 aa, Myxococcus xanthus DK 1622
MKSSFGVSQAPVDSPLVSGVSGDRTRDEIAAWLRAYVAESAELTPEEVDPQEPFVRYGLTSKDAVFLSGELADWLGRDVSPTILWEHATIDALSQALGRGTEPVTHAPATPVTEAAQDEAIAVVSLGCRFPGAPTPEAFWALLQRGGDAITEVPADRWDAASLYAPDPSTPATMNTRWGGFLEDVGAFDPLFFGISPREAVRMDPQQRLLLEVAWEALERAGQAPQGLQGSRTGVFVGISTSDYAQRQFGDRSLLDAYAGTGNAHSIAANRLSYVLGLRGPSMAVDTACSSSLVAVHLACQSLRGRECDLAMAGGVNLILSPELTIAFSQAGMMAADGRCKTFDASADGYVRSEGCGIVVLQRLSDALASGAPILAVIRGSAVNHDGLSNGLTAPSGAAQQDVIQQALRQARLSPEQIGYIEAHGTGTPLGDPIELAALRAVLSPGRSAEQRCFIGSAKSNIGHLEAAAGIAGLMKSVLALGHGEIPPQVHLRVLNPHIALDATRFPIPTRPEPWPQAPGARIAGVSAFGFGGTNAHVILSEPPPRPADAPRVPERDSHVLTLSARSDAALRNMARQYQEHLLRPNAPALADVCFTANTGRNAWPHRLALTANSHAEMASRLESFAQGHAVPRLHQGEVQRGAAPRIVFLYPGQGTQYPGMGRQLFDSTPVFREALERYDAILRPHLDVPLLSVLFPTTDATAQLIHQTRYTQPALFALGHALTELWRSWGVVPDAVMGHSVGEFTAAHAAGALGLEEALALLATRSRLIQALPQNGAMAAVLTDEATVRMALEDEPLVDVAAINGPRHVVISGEREAVQRITAALQAQGVESRPLTVSHAFHSPLLEPMLDGFEQVARVLPAHAPRLPLISNLTGERMSQAPDAAYWRRHARAPVQFFKSLQTLTQAGPALFIELGPHDTLLGMAKRCVPEGASLWLPSLRRQQDAWETLLDSLGALHTRGVTVPWRAVDADRPRRRVPLPTYPFERQRYLLDSALPSPAHRPTMMTQTSAAAPVVSRKERILTELRAVVALLLQAPPEKLDPRMSFLEMGADSLVLLDAIRNVEKRFGVKLAIRQLFEELTTLDALASHLDQTLPASFALSSAPAATSVPAPLPMSTPPAAANALSAPPGSAVEQLIQQQLQLMAQQLALLGGRPSAPLQLPVAAQEAPVPKAVPTNTAKAGGASPFGAGPKSGTPERELPAVQQRHLDALIAKYTTRTKRSKEAAVRYRSKWSDVRWLMNFRAELKEVCYPIVSVRSKGSRVWDADGNEYIDFSMGFGVHLFGHNPPFIMEALQQRLAEGMELGPQSDLGGQAAELLCELTGMKRVTFCNSGTEAVMTALRLARAATGRTKIVMFTGSYHGHSDGTLVVGRMVNGEPQSLPMAAGVSPKVVEDVLVLPYGEDRTLELIREHLHELAGVLVEPVQSRRPNLQPRAFLQALRTMTREAGVPLIFDEVITGFRLHPGGAQAWYGIEADLVTYGKVLGGGMAIGAVADRGGFVDRIDGGDWNYGDASYPAVETTFSAGTFCKHPLTMATTVATLSHLKAQGPALQENLSRRAAGLVARLNDIFQREQAPIEAVHGGSVLRFSAAGNTSYLYQSLEMDLFFCHLIQRGIYIWEGRTCMLSTAHSDEDLDTIVRAITETVADMRAGGFWPRTTPPDPTRVEARTLPMTEAQRQLWVLAQMNAGGSISYNLSMSLRLEGVLQPEVLQRAIQHVVDRHEALRIHIHESGEQQTAAASLALSLALHDLSPLPAPEQAERLSAWYEQENNTPFDLHRGAPFRANLLKLGAQEHVFVLTAHHVAVDGWSLGVIVREIAARYTELRAGKSTPPPPAMQWGEYVQWLQQQAGTKEQTAHERFWLSRRVETLPALELPIDHGRPAHRSYRGARETLRLDRATTQSLREAAAQQQSTLFMLLLSVYTTFLHRLTGQDDVLVGIPTAGRGMEGSEGLVGYCSHLLPIASHVQGEQTFSEYVQGLKQVLWEAYEHQDYPFALLIKRLGLPRSTSHTPLVSVTFNLERPLGNLQMDGLRTHFVPQPVRYAAFDLSLNVIDAEDGLVLDFDYNTDLFEAATLARWAQGFRTLLSGTLAQPEARVADLPMLTPAERRKVLVAWNQNQLGYREDLLTHQLIEQQAAARPGVHAVELDGQCITYADFNRRANQLAHHLRGLGVGPGVLVGAFIDRSPEMLVTLLAILKAGGAYVPLDPAHPVERLRFLLDDARAAVLVTKQSLAERLPAHTAKVVHLDTDAVTLASRPTENPPNTATATSPAYVIYTSGSTGEPKGVVISHGQMAVHFQDMQLHFELTERDRVLQFASFNFDASLEQILPTFMTGATLVLRGNQVWTPEELARRVVEQRLSVMNFPTAYWQQLTQSWAESPPTIGAHDLRLVIIGGDTVLPKVLELWQHGPLGNVRTLNAYGPTETLITATTFAIPKGWSATRVPIGRPLSNRPCYVLDRHGAPVPIGVAGELHIGGPLVAAGYLNRPELTAQRFVPDPFSDDPAARLYRTGDLVRYRPDGTLEFLGRSDHQVKVRGFRIELGEIESALSAHEHVQEVVVMVREEPGALAGHDKRLVAYVVPSAQGSVTPAALRQFLLEKLPDYMVPAFFVLMEAMPLTASGKLDRKALPAPDPEASAPTRPFVAPRTPTEQTLAEVWMKALRLPRVGIHDDFFELGGDSLLATQVASRLRDALKVELPLERLFKQTTIAGLAEHVDTVLWAARAAEDTSVSGASREEGEL

SEQ ID NO: 42571 - protein, 449 aa, Haemophilus somnus 2336
MSAIVSLEDFLAKVEQRDGHQPEFLQAVREVFTSIWPFLEKNPKYRSEALLERLVEPERAFQFRVAWTDDKGQVQVNRAFRVQFNSAIGPFKGGMRFHPSVNLSILKFLGFEQIFKNALTTLPMGGGKGGSDFDPKGKSDAEVMRFCQALMSELYRHVGADTDVPAGDIGVGGREVGYLAGYMKKLSNQAACVFTGRGLSFGGSLIRPEATGYGLVYFAQAMLAEKGQSFAGKTVVVSGSGNVAQYAIEKALQLGAKVVTCSDSSGYVYDPEGFTQEKLTALLDIKNVKRGRVKDYAEQFGLQYVEGARPWGVKADIALPCATQNELELSDAQQLIANGVQLVAEGANMPTTIEATDAFLEAGVLFGPGKAANAGGVATSGLEMAQSSQRLYWTAEEVDEKLHRIMLDIHANCKKYGTVEGQKNINYVVGANVAGFVKVADAMLAQGVY

SEQ ID NO: 42572 - protein, 333 aa, Arabidopsis thaliana
  misc_feature (186)..(186): Xaa can be any naturally occurring amino acid
  misc_feature (201)..(201): Xaa can be any naturally occurring amino acid
  misc_feature (250)..(250): Xaa can be any naturally occurring amino acid
  misc_feature (261)..(261): Xaa can be any naturally occurring amino acid
  misc_feature (297)..(297): Xaa can be any naturally occurring amino acid
  unsure (1)..(333): unsure at all Xaa locations
MKSNMFSCKTRAETLEWLTAIIDFLKPFSFLINAHVVNFFKDKQWEAVNEEWMSCLKDEKPENILLIPSGGVQDHWPASLKRFVHTLRSLSFPREQADLQAILADVDMVPLSTVLSQGMNLKKKNKVEVLCSVVSSVVKSVGAPTVVDVGAGQGYLAQVLSFQYERSVVAIDSSSYHGKVKDASAXRIREHFGAQMRKCGXGKKCPDVPMTITCCVLSIEMLKALSDVDLGRDETDFGGSALDEEGQSRXQLLSDANRSCXVVLAGFYACGDVLVTMLRAFVGCEEVEGLVSIGCCXNLLCEMGGEGFCSKCGFLMSAGVRSLGFCFGKSGRD

SEQ ID NO: 42573 - protein, 546 aa, Caulobacter crescentus CB15
MPDRRRFAGRWGNAHMAGNRLFLKKSIASIQKEAAHSQLKRTLGPINLMSLGVGAIIGAGIFVLTGQVASANAGPAIMLSFIVAGIACALAGLCYAELASTMPVSGSAYTYAYGTLGEVFAWIMGWLLVLEYGVAASTVAVGWSGYVVSTLHALGINFPMIQVAGADAPMWATPLIQAVAAPGGGTMFAMTGTLNLVAAIGIAMVSALLVVGVSESANVNNAIVVIKVIVLVTFIAVGAQYINPANWHPFIPEPTGQPGEFGIGGIFRGAAIIFFAYVGFEAVSTAAAEAKNPSRDVPIGILGALIICTLIYMAVAAVMTGVVPFRELASPAPIAVAIDRMGLEWADIPYAAAEGGKLNLLSFAIKIGAITGLSSVMLVLCYGQTRIFYTMARDGLLPKVFAEIHPKFRTPWLGTILLGVVIAIAASFLPISLLGDLVSLGTAVAFSIVCLSVIYLRIKHPDLPRPFKVPGGIFTAAAGIAACLFLPYQNFQPMIVHAMNDNPLPLMILGGYAAVGAIIYIAYGYWHSKLAKGIDITEETDPNSPA

SEQ ID NO: 42574 - protein, 437 aa, Desulfovibrio vulgaris subsp. vulgaris str. Hildenborough
MSTIVSVWAREILDSRGNPTIEVEVSLESGHSGRAAVPSGASTGTREALELRDGDKGRYKGKGVEKAVDNVMGEIAEAVIGLDALRQVQLDNTLLDLDGTDNKERLGANAMLGVSLATARAASSFLGLPLYQYLGGVNAKVLPVPLMNIINGGAHAPNNLDIQEFMIMPIGAATFRDALRMGAETFHTLKALLAADGHVTSVGDEGGFAPNLKSHDEAFKYITRAIEESGYIPGAEIALAIDAAASEFYRDGKYHLAGEGKTFSNSEMTEWLGEFTAKYPLISIEDGLAEGDWEGWGELTYKLGDTVQLVGDDIFVTNPDILAQGIDEGVANSILIKLNQIGTLTETLDTIEMAKQAAYTTVISHRSGETEDHFIADLAVGLNAGQIKTGSLCRSDRLAKYNQLLRIEEDLDDAGIYFGPMIASHFGYEGDEEFEDA

SEQ ID NO: 42575 - protein, 310 aa, Candida glabrata CBS 138
MRLKVVGITGADKVITIGNDKLLKDLLEVIEVTGDQCKGIRFGYPPQKVDITEENLGRNLEELGLSTGEKVTLISDMPKDVSSSISGKNNSPPVELKGNQVRVDETNNEILQIHEVPDDNSCLFHSISYTKHQKISLTQILREICAQEILSDKAKYNAAILDQSNEDYARWILQKDAWGGGIEIGILSDYLKIAIYVLDLDTLTIGKFNEEKFDDFVIISFNGVHYDAVELLYRQTNVRKTVFNLISEPELCGNVLEKTIELGKKLRSSGYKFNTRKDKIKCNVCKAEFVGEREVARHAESSGHYDFGQV

SEQ ID NO: 42576 - protein, 465 aa, Aspergillus nidulans FGSC A4
MSALKKRKITEKQPETNSDSEAESVSSRGSAKDETQTSGEEPAPAKSFKELGIIDQLCEACENMGYKAPTPIQSQAIPLALEGRDVIGLAETGSGKTAAFALPMLQALMEAPQTLFGLVLAPTRELAYQISQAFETLGSTIGVRCAVIVGGMDMVAQSIALGKKPHIIVATPGRLLDHLENTKGFSLRNLKYLAIDEADRLLDMDFGESLDKIIRILPRTRHTYLFSATMSTKVESLQRASLSNPVRVSVSSKYQTVSTLQSSYICIPHKHKNLYLVYLLNEFAGQSAIIFTTTVHETQRVAFMLRALGFGAIPLHGQLSQSARLGALGKFRSRSRDILVATDVAARGLDIPSVDVVFNFDLPMDSKTYIHRVGRTARAGKSGVAISFVTQYDVEVWLRIEHALSKKLPEYQVEKDEVMVMSERVAEASRQATIEMKSFDEKKGARGKKFGKGKRSRDDMDQEEG

SEQ ID NO: 42577 - protein, 444 aa, Kluyveromyces lactis NRRL Y-1140
MSNEEFIRTQIFGTVFEITNRYTNLNPVGMGAFGLVCSATDTLTSQPVAIKKIMKPFSTSVLAKRTYRELKLLKHLRHENLICLEDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYNVEVDIWSAGCIFAEMIEGKPLFPGKDHVHQFSIITDLLGSPPKDVIDTICSENTLKFVTSLPHRDPVPFSSRFQNLEPDAIDLLEKMLVFDPKKRITAADALAHPYLSPYHDPTDEPIAEAKFDWNFNDADLPVDTWRVMMYSEILDFHQIGDPQINTNATFDDQVAAATVAAAEAASKQQQQQQHQTEEQTQQTIASTPPQAQVTPQQLESGANSNSNSNPSFSIGPDPANETLTNFANQADQYVSKFK

SEQ ID NO: 42578 - protein, 452 aa, Oryza sativa (indica cultivar-group)
MAGKKRKSASSDKQPKQQQQRLPLGADADAVADAAKRRRSGASKKHQAEEEASIPSSLSAKILREALTQQQEESLADQRPAAAATAAPSPSFSFPVPKKDGEEDEDDDDVDEFDGFDAQSEYDGGVPEIDEEDEKALAAFMSKDTSSKRSLGDIILEKIREKDAEISTEGRTPVKLDSSIIELYKGVGEFLSRYTSGKIPKGFKRIPSLECWPDVLQLTEPENWSPNAVYQATRLFSSNMNAKNAVRFYEAILLPRVRNDIRKNKRLHFALYQSLKKCLYKPAAFFKGILLPLCQERNCTLREAVIIGSIISKVSIPPLHASAALMKLAEMEYCGTTSYFIKLFLDKKYALPYRVVDAVFAHFMRFIDEERVMPVIWHQSLLAFVERYKNELEKKDKEKLARLLDHQKHYLVTPEIRRELRMSCNRGEKDTIMSIYILTAHADSYLFCIIIH

SEQ ID NO: 42579 - protein, 255 aa, Arabidopsis thaliana
MGSIQNTVHYCCVSRDNQIMYAYNNAGDHRNNESLAALCLEKTPPFHKWYFETRGKKTFGFLMKDDFVYFAIVDDVFKKSSVLDFLEKLRDELKEANKKNSRGSFSGSISFSNVQDQIVRRLIASLEFDHTCLPLSSPSIDGAEQSYASNSKAPLLGRSNKQDKKKGRDHAHSLRGIEIEEHRKSNDRGNVTECSNASSESATYVPRRGRSGGSQSIERKWRRQVKIVLAIDIAICLTLLGVWLAICHGIECTRS

SEQ ID NO: 42580 - protein, 335 aa, Oryza sativa (indica cultivar-group)
MAFADPNLQIPDRYDRSGEVPAGAVVADDDESYELPVVDMTRLLDPEHREAEVAWLGSACRSWGFFQLINHGVDEAVIQKMKDNTVHFFELPLEDKNAVAVCPDGGIEGFGHHFRTSADKLDWAENLIVETQPIERRKLEFWPSNPPTFRDSIDKYAMEMWNLAMQLLGFMASDLGVEQETLLAAFRGKRQSMTLHHYPPCHHPEKVIGIAPHSDGFGLTLLLQVNDTPGLQISKDGRWHPVRPQTGAFVINVGEILEVLTNGHYKSVFHRVVVDTERGRDTIVVFQDACIDGVVKPLLELGEARYHAIDRLEYSKGHATEIFSRGERFVDTLKK

SEQ ID NO: 42581 - protein, 488 aa, Coptis japonica
MEVLSIAIVSFSFLLFLFFILRDSRPKNLPPGPRPSPIVGNLLQLGDKPHAEFAKLAQKYGELFSLKLGSQTVVVASSPAAAAEILKTHDKILSGRYVFQSFRVKEHVENSIVWSECNDNWKLLRKVCRTELFTPKMIESQSEIREAKAREMVKFLRGKEGEVVKIVEVVFGTLVNIFGNLIFSKDVFDLEDPTGGSVELKEHLWKLLDMGNSTNPADYFPIMGKLDLFGQRRAVAEVLQQIYDVWGVMLKERRGTKGSESKNDFVDVLLNAGLDDQKINALLMELFGAGTETSASTIEWAITELTKKPLVVSKIRLELVNVVGDNTVKESDLPHLPYLQAFVKETLRLHPPTPLLLPRRALETCTVMNYTIPKECQIMVNAWAIGRDPKTWDDPLNFKPERFLSSDVDYKGNDFELIPFGGGRRICPGLPLASQFSNLIVATLVQNFEWSLPQGMSTSELSMDEKFGLTLQKDPPLLIVLKARASNI

SEQ ID NO: 42582 - protein, 334 aa, Oryza sativa (indica cultivar-group)
MAFADPHLQIPDRYIRAVGGSGVVVVGDGESLELPVVDMARLLDPEHREAEVALLGSACRSWGFFQLINHGVDEAVIQKMKDNTVQFFELPLEDKNTVAVRPGGIEGFGHHFRSSAGKLDWAENLMVETQPFQQRNLEFWPSKPPTFRDSIDKYAMEMWNLTTRLLRFMASDLGVEQETLLAAFRGKRQTFGLHRYPPCRHPEKVIGISPHSDGFGLTLLLQVNDTLGLQVSKDGRWHPVRPLPGAFIVNVGEILEVLTNGRYKSVFHRVAVDAERGRVTVVVFQDACINGLVKPLPELGETPQYRAIGKSEYFKGHTAEVLGQGERFIDTLKK

SEQ ID NO: 42583 - protein, 301 aa, Lactobacillus reuteri
MKKLIKRLFLKQNPRVYEEKDAQLTPSLRTRDLIGLGTGMVVGTAIFTLPGIVAAEHTGPAVPLAFIVAAIGAGLSALAYAETSSVLPFAGSAFSWINVLFGEFFGWIAGWALLAEYFISVAFVASGWSAYMQGFLGSFGIKLPHALTGGFDPHTGSYIDILAAFAILIVGVLISRGVHQVSRIENIIVSVKLLVILMFIVVGVTAIHPQNYVPFLPAHQPGTTFGGWQGILAGTAQIFIAYVGFDAIAANTAETINPQKTMPRGLIGTLLLGTGFFIAVSLVLVGMFKYSRYANNAEPAA

SEQ ID NO: 42584 - protein, 339 aa, Oryza sativa (indica cultivar-group)
MAFADHHLHIPDRFVRADEVPAAGEVVVVGGDDESSELPVVDMARLLDPEHREEEIAWLGSACRSWGFFQLINHGVDQAVIQKMKENTVQFFELPLEDKNTVAVRPGGIEGFGHHFRSSAGKLDWAENLIVQTQPFQQRNLDFWPSNPPTFRDSIDKYTTEMSNLAMRLLRFMASDLGVEQEPLLAAFRGKRQSTALHHYPPCRHPEKVIGIAPHSDGFGLTLLLQVDDTPGLQVSNGGRWHPVRPLPVPGAFVINIGESLEVLTNGLYTSVFHRVVVDAERDRVTVAVFQDACIDGVLKPLPELGEPRYHAIGKSEYFKGHTTEVVGQGERFIDTLKK

SEQ ID NO: 42585 - protein, 844 aa, Oryza sativa (japonica cultivar-group)
MAYLGGDPGRGGGAPPGMTPWPGPPPQPGQPAVVYTALHQGAYQPGVAQVVYWAPSPGAPSLGGIRAPPAPYQPAQVAAPQAAAPFAAALAKEVEQKLFVTENALGPPAAAAAVSKKGPAHPGRPGYGAAGKKVMIHENNFLHNVVDNNLFHNDEMINGGTEEPRFCGGLIQMCNVENALRDVQRRTTELPVRYAQGRTVLDSQIGLLGEIDSNINATGLQHTHDLMKKMKFAASATPHPRRVLAVALALMVAFAVGPMVALAKCEQQAHAVASLCGGTGIYARCCFALKRSLDGGDPLCLCSLANNREVAEMGLNSTRILSLYRKCEGNVFPVLPAGGCEEVPALSPSPPPLHGSVMPPPLPPATVEPVISAPMVEPPPPPAMITPLPPSTPVFTLPPPPPVTTAPSTALPAGASAAAPSTGVLRRIYQALIGLLCLVAGFLLVAVFVVVRKYWKPQLNNDVEMGSSNAADQSAIENAKKAAAEAQSSAEAAASAAAGSLATAQAASGAAQAAQAATEEVVTVQANAAEQAVLFVEALGRAAQQISTCTITLGQLLQLVSQIIQAVRAAQGGAASAAAAITGLFARFGEIFGRVGAATAFVEAQAVAAQGAPSDLIDIDCINRPGGDRGVSSFDEGGSNEDEDEANVERSTSRTSNRIRKSNVRYSEDVWVLDPPARASITEGTQLSRDPDLPDAAYHRLPQPKDSERVKNYIPKHPAVTPASFPQIQAPVVSNPAFWERMGGDSLSTVLFFAFYYQQNTYQQFLSARELKEQSWRFQRKYNTWFQRHVEPQVTTDELSAKSLTHNLWKKTAKSDGCRNSNSSRTKLEFRETKNRVKQSVCAA

SEQ ID NO: 42586 - protein, 213 aa, Clostridium difficile 630
MKICIVLNGEIEDYEVTRDIIIKECYDCIICADGGANHTYKMEIMPDYILGDLDSVEEEKINFYKNKGVKFEKFPSKKDETDTELCLFLAKTLKANHIDFFGALGGRIDHTLANIKLLYYLKEDGIYSRILSDKEEMYIVENEEISLYGNPGDTISVIAINGDAKGVTLTGLEYPLDNYYMKYSVPIGISNVMLSNSCKIKVEQGCVLVVRNL

SEQ ID NO: 42587 - protein, 496 aa, Mycobacterium sp. JLS
MTDITTEQLATFELLIGGEPAAAASGATYDSVDPYTGRPWARVPDGGSADVDRAVAAARAALEGPWGTLTATARGKLLWRLGEIIARDAEQLAELEVRDGGKLIREMVSQMRSLPEYYFYYAGLADKLQGEVVPTDKPNYLVYTRHEPVGVVAAITPWNSPLLLLTWKLAAGLAAGCTFVVKPSDHTPASTLAFAKLFAEAGFPPGVINVVTGWGPETGAALASHPGVDKVAFTGSTATGIQVGKAAIENMTRFSLELGGKSAQVVFDDADLDAAANGVIAGVFAATGQTCLAGSRLLVHESVADALVERIVERAATIKLGDPKDPTTEMGPVSNQPQYEKVLSHFASAREQGATVAYGGEPAAELGGLFVKPTVLTGVDPSMRAVAEEIFGPVLAVMTFTDEDEAVAAANASEFGLAGAVWTKDVHRAHRVAAKLRAGTVWVNAYRVVAPHVPFGGVGYSGIGRENGIDAVKDFTETKAVWVELSGATRDPFTLG

SEQ ID NO: 42588 - protein, 486 aa, Pseudomonas putida
MKEIKHFINGAFVGSASGRTFEDINPVNGQVIGRVHEAGRAEVDAAVKAARAALKGPWGKMTVAERADILHRVADGITARFDEFLEAECLDTGKPKSLASHIDIPRGAANFKVFADLLKNVANEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHSDVDAYTFTGETGTGETIMRAAAKGVRQVSLELGGKNAGIVFADCDMDKAIEGTLRSAFANCGQVCLGTERLYIERPIFDAFVARLKAGAESLVIGPPDDASSNFGPLVSLKHREKVLSYYQQAVDDGATVVTGGGVPEMPAHLAGGAWVQPTIWTGLSDNSAVVTEEIFGPCCHIRPFDTEEEAIELANSLPYGLASAIWTESSSRAHRVAGQIEAGIVWVNSWFLRDLRTAFGGSKQSGIGREGGVHSLEFYTELKNICVKL

SEQ ID NO: 42589 - protein, 1058 aa, Streptococcus pneumoniae R6
MPKRTDIQKIMVIGSGPIIIGQAAEFDYAGTQACFSLKEEGYEVVLVNSNPATIMTDKEIADKVYIEPITLEFVTRILRKEGPDALLPTLGGQTGLNMAMELSKNGILDELGVELLGTKLSAIDQAEDRDLFKQLMEELEQPIPESEIVNTVEEAVAFAATIGYPVIVRPAFTLGGTGGGMCANEKELREITENGLKLSPVTQCLIERSIAGFKEIEYEVMRDSADNALVVCNMENFDPVGIHTGDSIVFAPAQTMSDYENQMLRDASLSIIRALKIEGGCNVQLALDPNSFKYYVIEVNPRVSRSSALASKATGYPIAKLAAKIAVGLTLDEVINPVTGSTYAMFEPALDYVVAKIPRFPFDKFEKGERRLGTQMKATGEVMAIGRNIEESLLKACRSLEIGVHHNEIPELAAVSDDALIEKVVKAQDDRLFYVSEAIRRGYTPEEIAELTKIDIFYLDKLLHIFEIEQELGAHPQDLEVLKTAKLNGFSDRKIAELWGTTDDKVRQLRLENKIVPVYKMVDTCAAEFDSETPYFYSTYGWENESIRSDKESVLVLGSGPIRIGQGVEFDYATVHSVKAIQAAGYEAIIMNSNPETVSTDFSVSDKLYFEPLTFEDVMNVIDLEQPKGVIVQFGGQTAINLAEPLAKAGVTILGTQVADLDRAEDRDLFEQALKELDIPQPPGQTATNEEEAALAARKIGFPVLVRPSYVLGGRAMEIVENEEDLRSYMRTAVKASPDHPVLVDSYIVGQECEVDAISDGKNVLIPGIMEHIERAGVHSGDSMAVYPPQTLSQKVQETIADYTKRLAIGLHCLGMMNIQFVIKDEKVYVIEVNPRASRTVPFLSKVTNIPMAQVATKLILGQSLSELGYQNGLYPESTRVHIKAPVFSFTKLAKVDSLLGPEMKSTGEVMGSDATLEKALYKAFEASYLHLPTFGNVVFTIADDAKEEALNLARRFQNIGYGILATEGTAAFFASHGLQAQPVGKIGDDDKDIPSFVRKGRIQAIINTVGTKRTADEDGEQIRRSAIEHGVPLFTALDTANAMLKVLESRSFVTEAI

SEQ ID NO: 42590 - protein, 343 aa, Clostridium difficile 630
MEKKKIVLKNFTEDELKEFMKTIDEKPFRGSQIFSWIYKGAKTFDDMNNIPKSLRNKLEEVSCIGHIDIELKLESKVDNTKKYLFLLDDGNIIETVMMDYDSRVTVCVSNQVGCRMGCNFCASTMDGLIRNLEPWEILDQVIKIQEDTGKRVSNLVLMGSGEPLDNFENTKQFLKIINEKNGLNIGYRHITLSTCGIVPKMYELADLEIAINLALSLHSPYDEERRKIMPVANAYSIEEILNACRYYIKKTNRRVTFEYSLIKGVNDSEKEAKALAKLLKGMLCHVNLIPINKVEEREYEKPDKAFIYKFRDSLEKNNIPATVRMSMGSDISGACGQLRRKYK

SEQ ID NO: 42591 - protein, 604 aa, Cucumis sativus
MEIESLRVSVDEKVLKDEEKNEKEEMKMKMKMKRKLGGVKTMPFILGNEVCDRFASSGFHSNIITYLTQDLNMPLVPASNILTNFAATSSFTSLIGALIADSFAGRFWTITIASIIYELGMVTITISAILPSLHPPPCPTQINCTQASGTQLMILYLALLLTSLGAGGIRPCVVAFAADQFDMTKVGIAGRTWNFFNWYYFCMGMATLTALTVVVYIQDNVGWGWGFGLPTIAMALSVVAFVVGSPLYNKLKPSGSPLVRLAQVVVAAFKNRKAVLPDDSKLLYRNHELDAAIAIQGRLVHTDQFKWLDKAAVITSPDSTANPPNLWRLATVHRVEELKSIIRMLPIWAAGILLVTASSHQHSFTIQQARTMNRHLTPTFQIPPATLSIFGILSMLTGLVLYDRLLVPFAKKLTHNPSGITCLQRMGVGFAINILATLVSSIVEIKRKKVAANHGLLDNPTATIPFSVFWLVPQFWLHGIAEVFMSVGHLEFMYDQSPESLRSTATALYWLAISVGNYIGTLMVYLVHKYTGEEHNWLPDRNLNRGRLEYYYWLVSGIQVMNLVYYVICAWFYTYKPLEEEKINIENKDGDQEWERCEDTIKIA

SEQ ID NO: 42592 - protein, 300 aa, Oryza sativa (japonica cultivar-group)
MAHFQGQQHGHPAARVDEYGNPPQHAFGGATDAGGYGRQAGYGATGTGTHDAAGYGGSGQPAYGATGTGVHDAGGLMPGHTAGHGTTGTGVHHGAGAGLPAGQTAGYGTTGVTGAQHGAGGLGTGHTAGYGTTGAHHGAGGLGTRHMAGHGATTTPDTMAYGTTGTGAPHGATAGTGAYPHAGGQFQPAREEHKTGGILRRSGSSSSSSSSEDDGMGGRRKKGIKEKIKEKLPGGNKGGQQQPTATAATGGYGAGTGHTAAAGTTTDAGGTAYTPTTQPTHEKKGMMEKIKEKLPGGGHH

SEQ ID NO: 42593 - protein, 313 aa, Streptomyces avermitilis MA-4680
MVIMSASWSSHAFQPVLERIADEIERTPGRGRPADYIPALAACDPRRFGMAVAELDGTVYGVGDWRQPFSTQSITKVFTLALDLAREGDALWEHVGREPSGNPFNSLVQLEYESGIPRNPFINAGALVVTDRLQTQTGDAAGSLLEFLRAESGNPRLTFDQDVAASEAAHGDRNAALGHFMASYGNIDNSVPVLLDQYFRQCSIEASCADLALATGFLARHGIRADGSRLLTQSQAKQVNAVMLTCGTYDAAGDFAYRVGLPGKSGVGGGIIAVVPGRCTLCVWSPGLDERGNSVAGVAALDRFTTLTGVSVF

SEQ ID NO: 42594 - protein, 343 aa, Bifidobacterium longum DJO10A
MAKTYKIAVIPGDGIGKEVTPWAQKALEKAAEGVADFEYENFDLGAERYLRDGAILPEDEEERIKANDAILLGAVGDPRIKAGILERGLLLKLRFDLDQYVNLRPSKLYKGVTSPLANPGDIDFVVVREGTEGLYCGAGGAVRRNTPQEVATEVSINTAYGVERVVRYAFKLAMKRKKHVTLVHKKNVLVNAGDMWQRIVDKVGEEYPEVTHDYQHIDAATIFLVSDPSRFDVILTDNLFGDILTDEAGSVVGGVGYSASGCINASDEFPSMFEPIHGSAPDIAGQNKANPTAAILSAAMLLEHLGFDDAAKKIHTAVEADIEELGSTVRSTDQVGKDILARM

SEQ ID NO: 42595 - protein, 486 aa, Streptomyces avermitilis MA-4680
MSEQSLKGEAQGAIRTGTQPSRHVDAGDAGYAKSLKSRHVNMIAIGGAIGTGLFLGAGGRLADAGPSLFVAYAVCGIFAFLVVRALGELVLYRPSSGAFVSYAREFLGEKGAYTAGWMYFLNWATTGIADITAVAVYTHYWGMFSDIPQWVIALIALAVVLTVNLISVRMFGELEFWFAIIKVSALVVFMLIGIFLLVTQHPVDGHHPGPSLITDHGGIFPHGLLPMLLIIQGVVFAYASVELVGVAAGETENPEKIMPKAINSIMWRVGLFYVGSVVLLSMLLPWNKYTAGQSPFVTVLSNIGVPAAGGVMNLVVLTAAMSSLNSGLYSTGRILRSMAMSGSAPKFTGVMSRSQVPYGGILLTSGICILGVGLNFVVPADAFEIVLNFAAIGILATWGMIMLCHLMFWRKTRTGELSRPSYRLPGSPWTEIVTIGFLVSVLVLMYADGGAGRTTVLCLPLIAAALVAGWYGVRGRVARKASGADA

SEQ ID NO: 42596 - protein, 294 aa, Caulobacter crescentus CB15
MVQSHFKGVIPALVTPFRDGEVDEKAFVALVERQIAGGVHGLVPVGTTGETSTLSHEEHRRVVELCVKTTAGRVPVIAGAGSNSTDEAIELARHAKTVGADACLVVTPYYNRPSQEGMYQHYKAINDAVELPIFVYNVPGRTGVDISNDTLERLAKLPNIVGIKDATGDLTRISFQRLMCGPEWVMLSGDDPTALGYMAHGGHGVISVTSNVAPDACSAFMNACMQGEWEKGLYWQDRLVRLHKALFLDSSPAPTKFAMAQLGLCTEDVRLPITACAEGVRPAILEAMREAGLR

SEQ ID NO: 42597 - protein, 465 aa, Aspergillus nidulans FGSC A4
MSTLEDLDDLEREERDKKKEQGDGGDGKQPGGDGDAEMKDPDAKKKDEDDDLLDEEILNSSTADIIKRRRMLENELRIMKSEYQRLTHEQNTMKEKVKDNQEKIENNRQLPYLVGNVVELLDLDVEAEAAEEGANIDLDATRVGKSAVIKTSTRQTIYLPLIGLVDHEKLKPGDLIGVNKDSYLILDTLPAEYDNRVKAMEVDEKPTEKYTDIGGLDKQIEEIVEAIVWPMKEAERFKKLGIKAPKGALMYGPPGTGKTLLARACAAETNATFLKLAGPQLVQMFIGDGAKLVRDCFALAKEKAPSIIFIDELDAVGTKRFDSEKSGDREVQRTMLELLNQLDGFASDDRIKVLAATNRVDVLDPALLRSGRLDRKIEFPLPNEEARANILQIHSRKMTVEDSVNWAELARSTDEFGGAQLKAVCVEAGMIALRKGHSKIGHENYVDAIAEVQAKKKDTNMGIYV

SEQ ID NO: 42598 - protein, 785 aa, Ehrlichia canis str. Jake
MKFTFSWLRRYLDTDVSLDVIIKKLSDIGIEVNNVDYCEHLKTFVIAEVLEVNPHHSANKLKICKVSDGKQILQVVCGASNVKVGMKSVLACVGSIMPTDQSIIEVVKLRGVESYGMLCSNDELGIVDHRNSKNGIIELPNTYNVGDTFFPCDPIIEVSITPNRGDCLGVYGIARDLAAAGLGKLKCIGELSNHSNCSSPIEVSVQVDGIVKGRYIKGIKNCESPKWLKDYLLVCGINSISFVVDITNYIMLSFNRPLHVYDANKIKNKLIFKKADNQTEFYALNDKKYILGTENIVAVDLENSIHSVAGVIGSKLSSCLLDTEDIFLESAWFAPVDIVLSSKKIKLSTDSSYRFERFVDPRFLQTGLDLATKMILEYCGGTHFDVVSNEVHVVDNIELNFFPDSVRSIGNVNISNEEIFDFLIKLGFIVDNNNEFLWRVTVPSWRSDIKHSSDIVEEVLRLYGYDKICEEPIPISHVDISDDYHDRLKALLLSEGLMEVITWSFTNMVFAEKLGYSSELLLIDNPISDKLNLMRPSLLLNLLQVVYENQAYGSSEIAIFEIGQVYGFNNICGSNSNVVCGVRYGNNLPRNLYKCDRSVDVFDVKSDVISILQELNIESNSIELRKSDKSYLHPVRSADVYFKDICLGYFGELHPNIVHLYEIKRPVVCFEVFLYKIPKVDVAHKELTESCYQSVKRDFAFLIDKDTSVQHLIDVTKNSNPVLIDNVTVFDLYEGNSIGDNKLSVALSVTFNPVDHTLNDQEIKDASDLIINAVAEKLGGVLRSF

SEQ ID NO: 42599 - protein, 865 aa, Pisum sativum
MFLAFLNTNKSQKIKGTVVLMPKNVLDFNAVTFHPLRGSVLEAPGKIIGRVSPALSGGVVDPTAFLGRNVSMQLISATKTDAGGKGQVGKETFLSSHLPRLPTLGARQDAFSIYFEYDANFGIPGAFYIRNYTSAEFFLVSVTLGDIPNRGSVQFVCNSWIYNFRSYQKDRIFFTNDTYLPSQTPAALSHFRKEELLNLRGDGTGERKVYDRIYDYDVYNDLGNPDYGDKFVRPVLGGSSTYPYPRRVRSGRKSTRKVTDPKSEKQGEIYVPRDENFGHLKSSDFLMYGIKSISQTVMPLLKSVICDEFSSFEDVRGLYEGGIKLPTDILSQIAPLPALKEILRTDGEQALKFPPPHVIKVSKSAWMTDEEFGREMVAGVNPCVIALLQEFPLKSTLDTVVYGDQSSTITKEQLETNLGELTVEQALDGKRLFVLDYHDAFMPYLERINTRAKAYATRTILFLKDDGTLKPIAIELSLPHSNGVQYGAESKVILPAEDGSVESTIWLLAKAHVIVNDSCYHQLMSHWLNTHAVIEPFIIATNRHLSVLHPINKLLYPHFRDTININGLARQALINADGIIEQTFLPGPNSVEISSTVYKNWVFTDQALPADLIKRGLAVEDPSSPHGLRLAIEDYPYAVDGLEIWDAIKSWVQEYVSLYYPTDEAVQKDTEIQPWWKEAVEKGHGDLKDKPWWPKMQTVQDLVQSCSIIVWTASALHAAVNFGQYPYGGYILNRPTHSRRFIPEKGTPEYDEMVKSPQKAYLKTITSKYQTLIDLSVIEILSRHASDEVYLGERDSKYWTSDSRAVQAFTKFGTKLAEIEGKIHSRNKDSSLKNRYGPVQLPYSLLVRTSKEGLTFKGIPNSISI

SEQ ID NO: 42600 - protein, 137 aa, Guillardia theta
AAFAAAIASAAAFSAPGPLTLRASAKEVTGVAKVAAAGAAILAAGPAFAGDVDAGEKVFNANCAACHAGGQNSVVPDHTLEKAAIEKFLTGGFNEKAVITQVTNGKNAMPAFGGRLSDDDIANVASFVISKSEEGWE

SEQ ID NO: 42601 - protein, 1214 aa, Oryza sativa
AMADIKLGLDPVPKPTDSVAASAGAAAANAAAAASASSAEAPPDQLDTVVCVVAARGVAEQRVEPNIEAMAEAGLLVLERKKVELTPEVAAVFTVDPSARRAPASDTRKGQTEEAVARADGKRGPGLELAVELANIPEAKHLAVELFVSATGAGGANSARAKSIATQTETVTGNANPKFQTHLFVPYQPFHDSVAPTALGDEKDVKTAPALGVEYELRVLNRASAASPAATDLLAVVPLDSKQLTATTGSLAFPLSNHSDAAVDAKLKQSGAVLTIRAAPSKTSIRPDRVLIHVTARNLPVAPPPPKPKAKPEIGPDGEPLPPKPTATGLPEAILPEPLGHSVVCVLVPKRPTQDNGEQLTEAIVGNSNPTFTVPFSVPRPTDSEVEPDSVMSPANQYDLQIWAASTDAPQTPAALAAAASNPRGDLLATIQVNVSKLIDSPGGYQSFVLADSATSELNPHDQTVRIAKAAAAGKGWGEKLLAADASVTIVGVTTQPSEEGQLHLNKDELASVRAFTSGPVVCLLVRGANAFIKLKHLTLIRELDFMYFSAETWSALRDSLLLFPQRHGRGLSQQRVERTLAVLKPGTTAPELEAVLRAVDDVDMVVVARDKRVIDAKVAKQLWPTADAEELAYLSSDVSEVLVLEAPGAVDQWQLLLGPADPTEATKRAPQSLRGRFARSRVRNLAYGSLTPTQAKADIALLFRDPFPLQRTLAIIKPDAVAAGSTDAILSVVTEQYGFAVLATERTRLSKPRAEQFYAEHQGKPFFNSLVDFMSSGPIVALCLAKPAAITSWRKLIGPTRRHEALSKKPHSLRARFGHSDTQNACHGSEHDKAAEREIQFFFPQLPAESLPTEVEQLKAIFNAKPFAPRGPNAKAPKSLNDVLVDGLTALCRERPLKLDAVKWLGQWLLKNNPNQPTVEVADPSDAHTAPGKGADSKIKFIGSADRDEKVATVAAPVTPVVSGPVAAPPAPRKMVWVVGPPGVGKNTLCARLAKEFGYEHVNVGNLCRSAIRAGSDYADLLTDCALNGRVVPSSVVVRLLQQAMRASPSANNRWLISDFPASLDQAFDFESATGGAVSFIVHLTCASDVTLKQRIEQRTATTPAFARRSEDNPASVDKRLALFREDILPQVLSQFAQFPGKVRAVNVDGDVSDAYARLKALFEPKVLAAPDAAAGAGAGAAPAVASPKKGKKTVGAPAPAPPAVEYMKINGV

SEQ ID NO: 42602 - protein, 126 aa, Guillardia theta
EGVEYAVLQSGSGDKAKIGELVAIRFKASFNGNTFDDCFKTQNAYYYRVGSENIVKGLDLAVQNMRVGDRWALKVPPSLAFGDKGLKPSPGKPRIPGGATIEYEVLFETFPGREADILEVTGGEGV

SEQ ID NO: 42603 - protein, 187 aa, Glycine max
  misc_feature (167)..(168): Xaa can be any naturally occurring amino acid
  unsure (1)..(187): unsure at all Xaa locations
GGMKKDEGSAAMPQQPPYSFYGSHGHLAAGGDEHEMPAPPASKAQLSQMLLASSPRSCVTTSLGSNMLDFSNSAPPMELKRHHHHHSDNSSECNSTATAAGSAVKKPRVQAASSSAQSTLKVRKERLGDRITALHQIVSPFGKTDTASVLQETIGYIRFLLGQIELXXPYMGTEFDLLSLKWAWETC

SEQ ID NO: 42604 - protein, 379 aa, Lactuca sativa
MPPFLLPSPSRLPKKETNFRNNPFIFDASFLQNETSIPQQFMWPEDEKPHLDLPLPQLRVPPIDLNDFLTGDSLAVCNAAQLVDAACREHGFFQVVNHGIDQRLINEAHKIMDLFFGMPLLEKQKAQRKVGEYCGYASSFTNRFSSKLPWKETLSVRYSADPLSSNLVQDYFLKVMGEDFSYLGRVCQEYCEAMSKLSLSIIELLGMSLGIGQSYFRDFYEENDSIMRLNYYPPCQKPDQTLGTGPHCDPTSLTILHQDNVGGLEVFVDEKWHSIAPCSEAFVVNIGDTFMALSNGLYKSCLHRAVVNNHTPRKSLAFFLSPRMDKVVCPPKPLVEDVDKQRRYPDFTWSTFLEFTQKHYRADKNTLDAFSNWLKNGRK

SEQ ID NO: 42605 - protein, 292 aa, Arabidopsis thaliana
MDGDGSSFEQFIMPPSALDRLASLHIEYPMLFQLSNVSVEKTSHCGVLEFTADEGLVYLPYWMMQNMSLEEGDVMQVKNISLVKGTYIKLQPHTQDFLDISNPKAILETTLRSYSCLTTGDTIMVPYNNKQYYINVVEAKPSSAVSIIETDCEVDFAPPLDYKEPEKPQKLTPSNKRPLQVKEEEEPASKVPKFTPFTGSGKRLDGKAQTQTEPEDTKQQEKPTENGKDDEKLSVTTPRQISGKLVFGSNSKSAAKETAKVDDPKNIVQESSTKSDEAKFKVFTGKKYSLNG

SEQ ID NO: 42606 - protein, 1113 aa, Cryptococcus neoformans var. neoformans JEC21
MQQPANDVQDIILDESPAPMEVDDIPNVHDYEAYAAKCMPDLGLEIEDFQYQTWRIEHWSQQPKRIVGPEFSCGGHKWRILLFPQGNANGQPNDMVSVYLDYANPKTAPEGWHACAQFCLAISNPWDPTIQTSSHAHHRFVAEECDWGFTRFVDLRKLYTADPANGKNRPTIENDEVEITAFVRVLKDPTGVLWHNFVNYDSKKETGHVGLKNQGATCYMNSLLQSLFCTNYFRKAVYQIPTEDDIPSESLALALQRVFYHLQTSNQPVGTTELTKSFGWKSLDSFMQHDVQEFSRILQDKLEIKMKGTPAEGAIPKLFKGQMKNYIKCIDVDFESSVIEDFYDIQLTIKGLKDLRASFKEYVSVETLDGENKYQAEGHGLQAARKGVIFKSFPPVLHLQLRRFEYDVEKDALVKINDRHEFPFEIDLGEFLDESADRAQSHVYKLHGVLVHSGDLHGGHYFALIKPEKDGRWYKFDDDRVTPVTDKEVLEDNYGGDMLNGLVPPHQRTQARTLKKFTNAYMLVYIRETELDTVLAPFTESDTPPHLKARLDHEREQLEAKKREKDEQHLYLTAKVITDEIFSQHQGFDLASFEDKNIPATDLPTFRVLKNESYPTFKSRIASHFKIPERDFRLWVLVNRQNKTTRPDVPIHENDNTQTMENIRNSMAARASDLKLYLDYNPDHARFNELHAEGKEPPIMIFLKWFDCSRQTLLGQGKVFVDKYQKVSDLLGIIQERMGWPSSTPIKLYEEIKAGMIEGMKLKQSFIQNEIQDGDIICYQVELPEKEIADLEAQSLYSSVPQFYDFLQNRILVHFKPRYEDRAASVPEFDLMLSKKMTYDVMAHRVGEFLKHDPLKLRFTSAHNQNGAPKAIVKRSLNQSVADITQTSYYNQHAHICIYYELLDISIIELETKKSLKVVWTGRHNKEEATHSFLLPKTCTFNDVADNMLKLVKLEPNGSGKIRIFDVSPSGRSPREHTGSEMIGNLPESAELYAEEIPVEELQAGEGTKIVNVFHYSRDPSRTHGVPCKFVLHEGEPFSETKARLQERIGVPEKEFAKYKFSLVTSTVFKQPSIVEENDIIYDHKWAPDDALGLDHIDRRPNKANVEKGIVMR

SEQ ID NO: 42607 - protein, 362 aa, Candida glabrata CBS 138
MVSAKQIVIKNEPTPGYPFQFDKHSDDATFTTVEKNIDENDLSDGEVLVETHYLSNDPAQKFWIASIDKNYAKGVSKGEVIPARGIAKVLASKNSKFSVGDFVSARTGWTSHCILKDSDGVELTKLDLTKVSDPSWYLSVLGGTALTAYFIFYRYAELQERESDYGKTFLISGAAGAVGSVCIQIALHRFKAAKVIAIAGGAEKVKFVESFGSRVVGVDYKDPSFKDNLLKAAGGQNTVDYFIDNVGGEILDFSTALLKVHAYIIACGSISGYNDPSKLPFKNYVSVVTKRLTIKGLLLYDNKENFPAGYSKLLEMIESNQLDVSKAETMVDATGEKFDDIPLIWNSLFEGRNKGKLITKLK

SEQ ID NO: 42608 - protein, 784 aa, Caulobacter crescentus CB15
MPDGALTAKRQEIALLRRLEERILWLAAWTIHNANHLRESRDGLKVGGHQASSASLTTIMTALYMKALRPQDRVAVKPHASPVFHAIQHLFGRQSLDNLKRFRALGGAQSYPSRTKDVDDVDFSTGSVGLGVAMTAFASLTQDYLAARGAVKPEKMGRMISLLGDAELDEGNIYEALIEACKHDIRNTWWIVDYNRQSLDATTQDRMFTRYGEIFEAAGWAVETLKWSRRQREAFARPGGDKLQAWIETAPNDLFSALTYQGGAAWRERLTADLADSPEALALIAAYKDVDLAELMTELGGHCLETLLEAFEKASQDDRPRFFIAYTVKGLRLPFQGHKDNHAGLMTPAQIAELRARLGVVEGEEWDPLSGLSAAERTAIKGLVARAPFAAEVERNHLAPQIPTPSASELLAAVAGGGDQSTQAAFGKVMFEIAARKDEFAGRVVTTSPDVTVSTNLGGFVNRRGVFQRRAHDDVFKRRRIPSAQVWSKAETGQHVELGIAENNLFIALAALGLTAPLFGERLFPVGTLYDPFIARGLDALNYACYQDARFLLVATPSGLTLAPEGGAHQSINAPVIGMAQPGLDTYEPAFADETAVLMAHAFERIQAKDGASTYLRLSTRAIPQPDRTGEAWRQGVIDGGYWLRAPARGARLAIAYSGALAPEALAAFEALAEDMPEAGLLAVTSADLLHRDWTASGRARWTGEGARTSTIETLLAPLAQGAGLVTLTDGAPLALSWLGSVRGQRVRALGLETFGQSGDLPDLYAKYRLDADAVLDACADLLA

SEQ ID NO: 42609 - protein, 333 aa, Sinorhizobium meliloti
MFEGSITALVTPFADDRIDEVALHDLVEWQIEEGSFGLVPCGTTGESPTLSKSEHEQVVEITIKTANGRVPVIAGAGSNSTAEAIAFVRHAQNAGADGVLIVSPYYNKPTQEGIYQHFKAIDAASTIPIIVYNIPGRSAIEIHVETLARIFEDCPNVKGVKDATGNLLRPSLERMACGEDFNLLTGEDGTALGYMAHGGHGCISVTANVAPALCADFQQACLNGDFAAALKLQDRLMPLHRALFLETNPAGAKYALQRLGRMRGDLRLPLVTISPSFQEEIDDAMRHAGDPFMMDNARFAERIEMDLIGANNQRRKQGGTCMGLDSGEAPCTS

SEQ ID NO: 42610 - protein, 378 aa, Acidobacteria bacterium Ellin345
MTRMASTATNAKRDYYEVLQVTRTATDQEIKSSYRKLALQFHPDRNPDNKDAEEKFKECSEAYGVLSDSEKRAAYDRFGHAGLGGNGGSGGFDPNMVDFSEIFTDMFGMGDLFGRGRGRSRAQRGADLREDITLEFEQAVFGIETESRVRRHETCETCHGSGAAPGKAPVSCRKCGGRGQERFQQGFFSVSRTCGTCGGLGQVITDPCAGCRGQGAVVRERTIAVKVPAGVEDGTRIRYNGQGEAGTHGGPAGDLYIVLHVKEHKFFEREGKDLFCTVPVSFAQAALGTDIMIPTLEGEHKLHIPEGTQTGTQIKLRGKGVPVLNGHGKGDIFVEIKVQTPSKLNKRQRELLQELEAGASVENSPEKSLMSKMKDMFS

SEQ ID NO: 42611 - protein, 55 aa, Zea mays
AASSSAQSTLKVRKERLGDRITALHQIVSPFGKTDTASVLQETIGYIRFLLGQIE

SEQ ID NO: 42612 - protein, 234 aa, Zea mays
MEVEADGIQEATAGAGDGGGVDDVFFCVAATSRGNKNSISYFHTNAGGEDAESALALAALCLDHAPDHDRWHHHTVARTKTFTFLSADDGRTYFAAADPSPGAAEVVRFLERVRDACDAAPRKRLRDEAVAPVARQFARTLRAAAAGPSSGAELPEASLQAKEPSTPLAPVCEKDEEERQRAGERRRAFLQPEESASALPGWRPWWRHASVVIVVDVVLCLVLFAVWMGVCKGF

SEQ ID NO: 42613 - protein, 337 aa, Lactuca sativa
MVALSKPSIEQFFMKPSKPNTNPLIFPTIPLIDLSKPESKQHLVKACQDFGFFKVVNHGVPTKFIKKLESEALKFFSSPLSTKEKAGPPDPFGYGNKRIGRNGDVGWVEYLLLNAKPESDYQRYLSVFEENPEIFQGVVNDYVTAVKKMACEILELLADEMKLQPRNVFSKLLMDEQSDSVFRVNHYLPCPEFQENERNGRKLVGFGEHTDPQIISVLRSNNTSGLEISLRDGSWMSVPADSDSFFINVGDSLQVMTNGRFKSVKHRVVANSTKSRVSMIYFGGPPLSEKIAPLPSLIQGEEDSLYKEFTWFEYKKSAFNTRLADNRLGLFEKITAT

SEQ ID NO: 42614 - protein, 463 aa, Pseudomonas putida GB-1
MSTASSLAQVPPASVPQSLYEFTDSPLLQRQQQQESNARSYPRRIPLALKRARGIYVEDVEGRQFIDCLAGAGTLALGHNHPVVVEAIQRVLADELPLHTLDLTTPVKDRFVQDLFAILPEALRREAKVQFCGPTGTDAVEAALKLVRTATGRSTVLAFHGAYHGMSQGALALMGSHGPKQPLGALLGNGVQFMPYPYDYRCPFGLGGEAGVKANLHYLENLLLDPESGVPLPAAVILEVVQGEGGVIPADIEWLKGVRRITEQAGVALIIDEIQSGFARTGRMFAFEHAGIVPDVVTLSKAIGGSLPLAVVVYRDWLDTWKPGAHAGTFRGNQMAMAAGSAVINYLVEHRLAEHAEAMGLRLRQHLLQLQREYPQLGDVRGRGLMLGVELVDPQGKLDALGYPVANRELAAKVQRECLKRGLILELGGRHGAVVRFLPPLIISDEQVDDVAQRFAQALIASV

SEQ ID NO: 42615 - protein, 391 aa, Oryza sativa
  misc_feature (212)..(212): Xaa can be any naturally occurring amino acid
  misc_feature (340)..(340): Xaa can be any naturally occurring amino acid
  unsure (1)..(391): unsure at all Xaa locations
MVAEAEVMHQPVPVLEVPYHRCVAKGVEEVAAAAAVAPPPVVEVEVAVQVPHMGLESAAGAPSISVDALQFVPSIRSGSFADIGPRRYMEDEHIRIDDLSAHLGSLLVCPLPSAFYGVFDGHGGLDAAAYMKRHAMRFLFEDSEFPQASQVDETYVQSVENSVRRAFLQADLALADDLDISRSSGTTALTALVFGRQLLVANAGDCRAVLCXRRGVAMEMSRDHRANYAEECERVAASGGYIEDGYLNGVLSVTRALGDWDMKMPDGSISPLIAEPEFRQTMLTEDDEFLIMGCDGIWDVMTSQHAVSIVRRGLRQHDDPERCARELVMEAKRLETADNXLTVIVVCFVSELGSPRQEQVGGQAGVASPRSCKSLSAEALCNLRSWLETDR

SEQ ID NO: 42616 - protein, 352 aa, Treponema pallidum subsp. pallidum str. Nichols
MNVLGIETSCDETAVAIVKDGTHVCSNVVATQIPFHAPYRGIVPELASRKHIEWILPTVKEALARAQLTLADIDGIAVTHAPGLTGSLLVGLTFAKTLAWSMHLPFIAVNHLHAHFCAAHVEHDLAYPYVGLLASGGHALVCVVHDFDQVEALGATIDDAPGEAFDKVAAFYGFGYPGGKVIETLAEQGDARAARFPLPHFHGKGHRYDVSYSGLKTAVIHQLDHFWNKEYERTAQNIAAAFQACAINILLRPLARALQDTGLPTAVVCGGVAANSLLRKSVADWKHARCVFPSREYCTDNAVMVAALGYRYLIRGDRSFYGVTERSRIAHFSKRGGDRLAAQRSAASQPLF

SEQ ID NO: 42617 - protein, 391 aa, Staphylococcus aureus subsp. aureus NCTC 8325
MKEGHGAYLYDVDGNKFIDYLQAYGPIITGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHNNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIKQTLKAADYAFSQMK

SEQ ID NO: 42618 - protein, 155 aa, Zea mays
  misc_feature (99)..(99): Xaa can be any naturally occurring amino acid
  misc_feature (131)..(131): Xaa can be any naturally occurring amino acid
  unsure (1)..(155): unsure at all Xaa locations
CARRACLASRHGLPRRRLREAPSAYKGLAGSSLSEKNLDTARPSARSIRRARPAGAQYNYRDKRDYFDLDDLGNTTGQSDLYGSDAPYVYNTVHSEIFXETIWCPFTERGLLLKVLLLRGGSLVAYVTTGXLSADLLPIKKVSQEPHQPDQRGKI

SEQ ID NO: 42619 - protein, 1037 aa, Coccidioides immitis RS
MHRRPSSLLIKRRLPFLPRHEYPLAHHRTITCYNLRANGSRNSIATTNPANERSLGLNSSSTFSESLGTYSRPQLSLTPPLYSTPLCAQRFFASSSVNMAGTKIDGTAIAKGIRERLNAEIRKTQESNPRFNPSLVIFQVGDRSDSSTYVRMKLKAAEEANILCRLAKFPEEITETELIQEITNANNDPSVHGILVQLPLPNHLSEHTVTSAVSNEKDVDGFGAINIGELAKRGGKPLFVPCTPQGIMELLRSSGVNPAGKNAVVLGRSDIVGSPVSYLLKNADATVTVCHSKTKNLPEVIKEADILVAAIGKAEFVKGEWLKPGAVVIDVGTNFVPDASKKSGQRLVGDVEFGSAVEVASQITPVPGGVGPMTVAMLLQNVVNSANASFERLKDRRISPLPIKLQNPVPSDIAISRAQRPKAISQVAAEIGIAPHELEPYGHTKAKVSLDVLSRLSHRRNGRYVLVCGITPTPLGEGKSTTTMGLTQALGAHLNRIVFANVRQPSQGPTFGIKGGAAGGGYSQVIPMDEFNLHLTGDIHAITAANNLLAAALETRMFHESTQSDAALYRRLVPTKKGKREFQPIMFRRLKKLGIDKTDPNELTGEEVHRFARLDIDPDTITWRRVLDVNDRHLRTITVGQAATEKGHTRQTGFDISVASECMAILALSNDLGDMRERLGRMVVATSKNGDPVTCDDIGVGGALTALMKDAIKPNLMQSLEGTPVFVHAGPFANISIGANSVVADKLALKLAGTEPDEDHEAKTGFVVTEAGFDFTMGGERFFNIKCRSSGLVPDTVVIVATVRALKVHGGGPDITPGAPLPEAYRNEDIELLRRGCINLKKHIENAKQYGIPVVVAINKFETDTEAEMAVIREEAIAAGAEDAIPANHWAEGGAGAVELAKGVIMASSKPKDFKLLYSLEGTIQERIEKIGQLMYGADKVEFSELAQKKVDTYTKQGFGNLPICIAKTQYSLSHDPSLKGAPTGFTVPIRDVRLAVGAGYLYALAADIQTIPGLPTAPGYLNVDVDAETGEIDGLF

SEQ ID NO: 42620 - protein, 507 aa, Caulobacter crescentus CB15
MTQVFPTPAAHAREILAKLGAPPLPADAGEPVRGPIDGAILGHVVYDDARQIEAKVAAACRAFADWRVVPAPRRGELVRLFGEELRAAKADLAALVTLEAGKIASEAAGEVQEMIDICDFAVGLSRQLHGLTIASERPGHAMRETWHPLGPVAVISAFNFPVAVWAWNACLALVCGDPVIWKPSEKTPLTALATQAILERALARFRDAPQGLSSVVLGARDAGERLARDPRIPLVSATGSTRMGRAVAPMVAERFGRSILELGGNNAMIVTPSADLSLALRAIVFSAAGTAGQRCTSLRRLIVHESLVDKVSDAVEAAFQRLSVGDPRDPKTLLGPLIDKAAYDAFIAAMNQVRAEGGSVAGGERVLIDEHPDAYYVRPALARLPAPAPCMQRETFAPLLHVVPYNSFDMAIAIQNDVPQGLSSCVMTNDVREAERFLAAAGSDCGIANVNIGPSGAEIGGAFGGEKETGGGRESGSDSWKQYMRRQTATVNYSGALPLAQGVRFDL

SEQ ID NO: 42621 - protein, 136 aa, Mycobacterium tuberculosis H37Rv
MTERTLVLIKPDGIERQLIGEIISRIERKGLTIAALQLRTVSAELASQHYAEHEGKPFFGSLLEFITSGPVVAAIVEGTRAIAAVRQLAGGTDPVQAAAPGTIRGDFALETQFNLVHGSDSAESAQREIALWFPGA

SEQ ID NO: 42622 - protein, 544 aa, Gloeobacter violaceus PCC 7421
MDIKTVATTPFSDQKPGTSGLRKKVPVFQQPHYLENFVQSIFDSLEGYAGQTLVLGGDGRYFNREAIQIILKIAAASGFGRVLVGKDGIFSTPAVSCVIRKTAAFGGIILSASHNPAGPHEDFGIKYNVGNGGPAPEKVTEAIYARTKTIDHYQILDGPDVDLGKLGTFALGPLTVEVIDPLTDYIELMESLFDFGRIRDLLAGGEFRLCVDSMHAVTGPYAHALFEDRLGAPAGTVHGGTPLEDFGGGHPDPNLVYAHELVEILFGEDAPDFGAASDGDGDRNMILGRHFFVTPSDSLAVLAANAKLVPGYQAGLAGVARSMPTSQAADRVAAQLGIDCYETPTGWKFFGNLLDAGKATLCGEESFGTGSGHIREKDGLWAVLFWLNILAVRRQSVEQIVREHWQIYGRNYYSRHDYEAVDSAQAQALIEHLHAQMPHLAGKAFGSYEVAYTDDFSYTDPVDGNVSKNQGIRVGFTDGSRVVFRLSGTGTQGATLRVYLESFEPNIAKHNQDPQQALAGLITIAEELAQIRKFTGRDKPTVIT

SEQ ID NO: 42623 - protein, 419 aa, Mycobacterium tuberculosis H37Rv
MTATPREFDIVLYGATGFVGKLTAEYLARAGGDARIALAGRSTQRVLAVREALGESAQTWPILTADASLPSTLQAMAARAQVVVTTVGPYTRYGLPLVAACAAAGTDYADLTGEPMFMRNSIDLYHKQAADTGARIVHACGFDSVPSDLSVYALYHAAREDGAGELTDTNCVVRSFKGGFSGGTIASMLEVLSTASNDPDARRQLSDPYMLSPDRGAEPELGPQPDLPSRRGRRLAPELAGVWTAGFIMAPTNTRIVRRSNALLDWAYGRRFRYSETMSVGSTVLAPVVSVVGGGVGNAMFGLASRYIRLLPRGLVKRVVPKPGTGPSAAARERGYYRIETYTTTTTGARYLARMAQDGDPGYKATSVLLGECGLALALDRDKLSDMRGVLTPAAAMGDALLERLPAAGVSLQTTRLAS

SEQ ID NO: 42624 - protein, 677 aa, Prochlorococcus marinus str. MIT 9312
MTHINKGNPFPLGSSLTAKGVNFSLIATNAAFVEILLFEKEDSISPKNIFKLDHNHNTGPYWHAEIENLNEGCIYAFRINQKNNGINNNYEKKVLLDPCSRGITGWGIYKRENALNTNDNTNSCLKSVVCDRKLFNFEDYPRPKHSWEETIIYELHIRAFTESTDKDKSCFKKFLKKIPYLKELGITTIELLPVFCFDPTDAPNGLENFWGYSPINWFTPHFEYLSNESAEKNREEFRRLVEECHKADIEVILDVVYNHTSEGDSQGPVISWKGIDENLYYFIGKDKNYQDVSGCGNTIAANRGLVRKLIIESLKCWASELGVDGFRFDLGIALSRGENLSPLDNPPIFEDIECEPELIDIKFISEPWDCGGLYKLGDFPSKTTFTWNGHFRDDLRRFWKGDKDTAWNMSDKIKGTPSMYKEDNIFPKSINFITSHDGFTLKDLVTFNRKHNFANREQNRDGDNHNNSWNHGTEGPTKNLLINDLRKRQQRNLILSLLISKGVPMILMGDEIGRSQGGNNNSWCQNNLLGWMNWDHDQQDLELLEYSKYVIKIRKKLINIFNPSFLPNNQNQKNIPIYHWHGTKLDSPDWSSWSHTVAFSINKGKTNPLVWIGLNAYSKSIDFPLPKCKYNWLKVIDTSAPEIFEPLTINEKSVSIKSRSSLLIISEEVFGAKNNIF

SEQ ID NO: 42625 - protein, 322 aa, Pseudomonas putida GB-1
MALHPDLAAFLELVEFGRLTGRSLPMHAMDVAQARAEFAGSSQVLDPSPPGNVTVSELQVTARDGTRLGARLYRQGEASAALQPVIFYLHGGGYVVGSLDSHDSVCRRLAALGEFAVLAADYRLAPEQQFPVALHDVLDVANWLAEQAATLGLDNRRVVLAGDSVGASLAAVLAITAVEQPEALAFKPLGQLLFYPVTDISCQRASHREHAEGYLLETPTLEWFYQHYAPQPEQRLDWRVSPLLSTLRTPLAPAYLFVAEYDPLHDEGIAYRDWLLAGGTAVTFARVEGLTHDFLRMSGIVGQVDGIYRDVGEWLQQVGGQF

SEQ ID NO: 42626 - protein, 125 aa, Triticum aestivum
MAVASGPAATFSARPAAPGAGRLCSCAAAATGGARFRGADGKWWAPLLGWSGQPDYIDAQPAPLPEEERAAAGAAGARRFGVLTEEKARQLRVRMMETESFHDAMYHSAIASRLASAAPDGDAKP

SEQ ID NO: 42627 - protein, 543 aa, Mycobacterium sp. JLS
MLRTVTQVMGENVPPYLRPPVVLLDGHCPLPREVLGNKGHGLNLMRRLGLPVPPAFCLTTDVCAQFLAGDDHVLDRIWPDVLDNLRWLEHETARTFGQGPRPLLVSVRSGAAQSMPGMLDTVLDLGIDDDVESALAQEATPQFAADTRNRFRAMYQRIVLDDDESEPVPDNPFLQLRGAIAAVFRSWHSARAGAYRRHHGLGDGGGTAVVVQAMVFGNLSRDSGTGVLFTRNPMTGANEPFGEWLPRGQGEDVVSGGYDCEPLSALREQQPGVYADLMTAAETLEDLGRDVQDIEFTVEEGRLWLLQTRVAKRSAQAAVRLALTLLDEGLIEEDEALRRVTPVHVQTLLSPSLQPETRLAAPLLAKGLPACPGVASGRAYTDVDAALDAADNDEDVILVRTSTSPDDVAGMLAARAIVTQIGGATSHAAVVSREIGRPAVVGCGAGVTAALDGRLITVDGNAGEVREGVLPLTAWSEADSPDLRRLADIARRRSPLRAHRAGDYPVLPAGSDGAVRDALAAGHADVVSTTPLITMLTALRLVG

SEQ ID NO: 42628 - protein, 392 aa, Cryptococcus neoformans var. neoformans JEC21
MTIAITSIPASKYRAHYDPTKVLQHPEFQTLAEDAPELSDPDLNIACAYNPSHEIHMIKKPRFEPGPGEVTIHVRATGICGSDVHFWKHGHIGPTMIVTDECGAGHESAGEIVAIGEGVTQWQVGDRVAIEAGVPCGLASCEPCRTGRYNACPADVFFSTPPYHGTLTRYHNHPAAWCHRLADNMSYEEGSLCEPLTVALAGIDRAGVRLGDPIVICGAGPIGLVTLLAAHAAGCTPIVITDLFASRLEFAKKLLPTVKTVLIEKTAKPEEVAKQIKDVAGMQLSIALDCTGVESSIRSAIFSVKFGGKVFVIGVGPSEQSYPFGYCSAREIDLQFQYRYNNQYPKAIRLISGGLVDLKPLVTHRFTLKEAVKAFHVAADPSQGAIKVQIHD

SEQ ID NO: 42629 - protein, 403 aa, Thermobifida fusca YX
MRAVVWHGVGDIRVEDVDEPTIQDPQDAIVQLTTSAICGTDLHLLRGTIPGMRPGTIMGHEGVGVVTEVGPGVRNFRPGDRVVISPTIGCGACSYCRAGYFSQCDNANPAGRRSGTAFLGGPEANGAFHGTQAERVRVPYANVGLIGLPERVSDEEGILLADMFPTGWFGARLAEVTPGDTVAVFGCGPVGLFTILSAWQQGAGRVLAVDGVESRLEQARGLHAEVINYNVEDPVAALVELTGGIGPDRVIDAVGVDAQRPESGPAVAAEDDVHRLEKEHAATVPSARPGETAQILSDERAQVLQWAVEAVAKAGTLAIIGNYPLNARIFPIGLAMNKNLTLNAGSCHHRKYIPKLLDMITSQQLDITSVLTQEEPITGDVLRAYEAFGQHKPGWTKVALTTV

SEQ ID NO: 42630 - protein, 264 aa, Dianthus caryophyllus
MLNFGATARNGVVSTRRWKSDTCIDLGPSDVRSEAHVLAVDDSLIDRKVIERLLKTTSCKVTVVDSGMRALEFLGLDAEQRTSVVDGLKIDLIITDYCMPGMTGYELLKKIKESSTFKETPVVIMSSENVIARIDRCLEEGAEDFILKPVKLSDVKRLRDYMTNKYDKSNSRVISGTNKRKQMDGSDQSYDSSSSSSSSSSLSLSPISTQSQPLISPSSSTPSSPCGPLDSNSMPSSPSGPSDTPSRRRRMAVDVDDDQTAVMP

SEQ ID NO: 42631 - protein, 280 aa, Trichodesmium erythraeum IMS101
MKSQQQSLQTLILAIVLSLILLIGFNSFVIINPGQAGVLSVLGKAKDGALLEGIHFKPPLISEVDVYDVTVQKFEVPGQSSTKDLQQLSASFAINFRLDPLLVVKIRREQGTLQNLVAKVIAPQTQESFKIAAARRTVEEAITKREELKSDFDNALGSRLDKYGIIVLDTSVIDLTFSPEFARAVEDKQIAEQRAQRAVYIAEEAEQEAEAEINRAKGKAEAQKLLAETLKAQGGQLVLQKEAIEAWKKGGSQMPKVLVMGSEKSQGVPFIFNLSQMDEN

SEQ ID NO: 42632 - protein, 434 aa, Cenarchaeum symbiosum
MDLEREYRAKTGGSARIFARSKKYHVGGVSHNIRFYEPYPFVTRSASGKHLVDVDGNKYVDYWMGHWSLILGHAPAPVRSAVEGQLRRGWIHGTVNEQTMNLSEIIRGAVSVAEKTRYVTSGTEAVMYAARLARAHTGRKIIAKADGGWHGYASGLLKSVNWPYDVPESGGLVDEEHSISIPYNDLEGSLDVLGRAGDDLACVIIEPLLGGGGCIPADEDYLRGIQEFVHSRGALLVLDEIVTGFRFRFGCAYAAAGLDPDIVALGKIVGGGFPIGVICGKDEVMEISNTISHAKSDRAYIGGGTFSANPATMTAGAAALGELKKRKGTIYPRINSMGDDARDKLSKIFGNRVSVTGRGSLFMTHFVQDGAGRVSNAADAAACDVELLHRYHLDMITRDGIFFLPGKLGAISAAHSKADLKTMYSASERFAEGL

SEQ ID NO: 42633 - protein, 395 aa, Zea mays
MESSPLLQLPAARVEALSLSGLSAIPPEYVRPADERAGLGDAFDLARTHANDHTAPRIPVVDISPFLDSSSQQQQRDECVEAVRAAAADWGVMHIAGHGIPAELMDRLRAAGTAFFALPVQDKEAYANDPAAGRLQGYGSRLATNTCGQREWEDYLFHLVHPDGLADHALWPAYPPDYIAATRDFGRRTRDLASTLLAILSMGLLGTDRGDALEKALTTTTTRTAADDDLLLQLKINYYPRCPQPELAVGVEAHTDVSALSFILHNGVPGLQVLHGARWVTARHEPGTIIVHVGDALEILSNGRYTSVLHRGLVNREAVRISWVVFCEPPPDSVLLHPLPELVTEGHPARFTPRTFKQHLDRKLFKKKQQHKAKAEEEDGGNGDHHRHEPPPQTN

SEQ ID NO: 42634 - protein, 571 aa, Ashbya gossypii ATCC 10895
MCGIFACYRKDDIESFKPTALRLSKRVRHRGPDWSGNVIKNDTILVHERLAIVGLDSGAQPINSPDGNYVLCVNGEIYNHIHLREECSDYEFTSLSDCEPIIPLYLKYDVETPQHLDGMFAWCLYDVQRDRIVAARDPIGVTTLYMGKSSSSPRTRYFASELKCLVDECDEITAFPPGHVYDSDTDKLTRYFKPDWIDETRIPSQPVDYKAVRTTLEKAVRKRLMAEVPYGVLLSGGLDSSLIASIAARETERANREAGDVYADGKHLAGMDDRGLLHTGGWSRLHSFAIGLPNAPDLQAARKVAKFIGSIHHEHTFTLQEGLDALDDVIHHLETYDVTTIRASTPMFLLSRKIKAQGVKMVLSGEGSDEIFGGYLYFAQAPSPAEFHTETVKRVNNLHLADCLRANKSTMAWGLEARVPFLDREFLQLCMNIDPAEKMIAPQKGRIEKYILRKAFDTSDEPGVDPYLPEEILWRQKEQFSDGVGYSWIDGLKDAAERAISDEQFANPNPAWGDDIPTTKEAFWYRLKFDALFPQPTAAATVMRWVPKADWGCAEDPSGRYAKIHDQHISS

SEQ ID NO: 42635 - protein, 164 aa, Oceanicola granulosus HTCC2516
MTQIDYTRAAKYFLLQDFFQGFKLGFKYFFKPKATVNYPHEKGPLSPRFRGEHALRRYPNGEERCIACKLCEAICPAQAITIDAEPREDGSRRTTRYDIDMTKCIYCGFCQEACPVDAIVEGPNFEFSTETREELYYDKAKLLENGERWEAEIARNLEIDAPYR

SEQ ID NO: 42636 - protein, 519 aa, Ipomoea quamoclit
MATLTLILCTLLFAIFLYFLILRVKQRYPLPLPPGPKPWPVLGNLPHLGEKPHQSIAAMAQKYGPLMHLRLGFVDVVVAASAAVAAQFLKVHDANFSSRPPNSGAEHIAYNYQDLVFAPYGPRWRMLRKITSVHLFSAKALDDFSHVRQEEVATLTRSLASAGKTPVKLGQLLNVCTTNALARVMLGRKVFNDGSSKSDPKAEEFKSMVEEMMVLAGSFNLGDFIPVLGWFDLQGIVGKMKKLHARFDAFLNAILEEHKFVNNQHTTSSKDVDFLSTLLRLRDSGADMDGEEGKLTDTEIKALLLNLFTAGTDTSSSTVEWAFAELLRNPKILSQAQQELDLVVGTNRLVTESDLTQLPFLQAIVKETFRLHPSTPLSLPRIGAESCEINGYFIPKGATLLVNVWAIARDPNAWTNPLQFNPNRFLPGGEKTNVDIKGNDFEVIPFGAGRRICSGMSLGIRMVHLLIATLVHAFDWDLVNGQSVETLNMEESYGLTLQRAVPLMLHPKPRLQPHLYTLN

SEQ ID NO: 42637 - protein, 407 aa, Oryza sativa (japonica cultivar-group)
MAAVTRAARSRALLLLPRASAAAPHFSTTASSGAAAAAAAPVEAAAAGASDASAAAAAGAGEQPAPPPKRWGLLKFGAFAAVCGALGAAGYSSYAYTLEEVDQKTREFRKAMTTPRPVAEDASEFEKFQAMIYSTAMKAPVAAIEFYMDVRHTIEDHIRGFAEPTSDKLLPDLDPLNQHIFTLVLDLNETLVYSDWLRERGWRTFKRPGVDAFIEHMGKFYEVVVYSDQMPMYVDPVLERLDTKGFITGRLSRPATKYQDGKHYRDLSKLNRNPAQVIYISSHALESCLQPENCVQIKPWKLETDDTQLLDLIPFLEYVAMVRPSDIRTVLASYQGRDVAAEFIERSKEHQSNSMLRADEASPCRSTRQVVIVVVGEHHQRRRGCRCVTIPLFQTTVVEEAIELRAV

SEQ ID NO: 42638 - protein, 828 aa, Shigella flexneri 2a str. 301
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNSRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 42639 - protein, 384 aa, Cryptococcus neoformans var. neoformans JEC21
MSQALLASNLELTRLPADFTPAPGKESHGRYMLTVPWSRHTGWGTPKIGPRKDLAFDPLAGVLQYAVTCFEGMKCYKSEQGDLRLFRPEMNFDRLKRSGARLGLPHDWDNIELLSLFSSLLSLETPIVPSTDGSSLYIRPTLLETSQSFGIKEDALADEALLYVVTSLNLGLGLYGSSEREGKGLKLDACKEFIRAWPGGTGSFKLGANYGTVNISKKKGYAMSLWLHGKEDYISEAGAMNMWIIKQASDGYLEFTTMSLDNGIVLPGVTRQSIIELVEDHASGKKAFPFAEGDVEMPKKIRIVERDISMGEILEGLKDGSLKGMFGCGTGVVVVSIGGITYRNQDYTIPFNPLVKLLRDTMTGIQRGRIDEGRGWSYKIEGSA

SEQ ID NO: 42640 - protein, 160 aa, Cucumis sativus
MFPMVTGFMNYGQQTVRAARYIGQGFVITLSHANRLPVTIQYPYEKLIASERFRGRIHFEFDKCIACEVCVRVCPIDLPVVDWKLETDIRKKRLLNYSIDFGICIFCGNCVEYCPTNCLSMTEEYELSTYDRHELNYNQISLGRLPMSVVDDYTIRTILN

SEQ ID NO: 42641 - protein, 65 aa, Daucus carota
DNIQGITKPAIRRLARRGGVKRISGLIYEETRGVLKIFLENVIRDAVTYTEHARRKTVTAMDVVY

SEQ ID NO: 42642 - protein, 504 aa, Zea mays
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWSADFRASVGAMLDAVDAEFGKDDGSDKKPSASYLVPLQQCIFRFLCKAFVGADPSADWLVDNFGFTILDIWLALQILPTQKIGLVQPLEELLIHSFPLPSFLIWPGYYVLYRFIEKHGAEAVAYAEAQHGIGKKDAINNMLFVLGFNAFGGFSVFLPFLVAKVGGAPALRERLRDEVRRAMVGKGKDGEFGFATVREGMPLVRSTVYEMLRMQPPVPLQFGRARRDFVLRSHGGAAYQVSAGEVLCGYQPLAMRDPEVFERPEEFVPERFLGDDGARLLQHLFWSNGPETAQPGPGNKQCAAKEVVVDTACMLLAELFRRYDDFEVEGTSFTKLVKRQASPSVAQAAAAAGAQQ

SEQ ID NO: 42643 - protein, 444 aa, Deinococcus radiodurans
MTLSETHPTARSEALFVRARAVTPGGVNSPVRAFRSVGGVPRFIASAQGAYLTDADGARYLDYIGSWGPMILGHNHPAVRDAVAQALASGTSFGAPNEREVELAELIVELTGAERVRFVSSGTEATMSALRLARGYTGRKFIVKFRGNYHGHADGLLVEAGSGLLTNAEGDLGAAAPSSAGVPEEYAGLTLVLDYNDPEALDALMAQRGDEIAAVIFEPVVGNAGVLIPTSDFLAALHRVRDFGAVLIADEVMTGFRLSLNGATGLLSLDPDLRCWGKIVGGGLPVGAYGGRADIMDFVSPQGPVYQAGTLSGNPLAMAAGIATLRELKANPGLYRQLDEYAARLAAGLRGAAERAGVAVSINHIGSMLTVFFQDAPDGSVRDYAAAARSDTAAFAAWFQGLLARGIYWAPSQFESIFISAAHGEPELAATLEAAAQAFEGVKP

SEQ ID NO: 42644 - protein, 188 aa, Methanocaldococcus jannaschii DSM 2661
MIVILDNGGQYVHRIHRSLKYIGVSSKIVPNTTPLEEIESNKEVKGIILSGGPDIEKAKNCIDIALNAKLPILGICLGHQLIALAYGGEVGRAEAEEYALTKVYVDKENDLFKNVPREFNAWASHKDEVKKVPEGFEILAHSDICQVEAMKHKTKPIYGVQFHPEVAHTEYGNEILKNFCKVCGYKFE

SEQ ID NO: 42645 - protein, 523 aa, Haemophilus somnus 2336
MTNIHHHKILILDFGSQYTQLIARRVREIGVYCELWAWDVTEEQIREFNPTGIILSGGPESTTEANSPRATEYVFNAGVPVLGICYGMQTMAMQLGGLTETSTHREFGYAEVSLQNPTALFADLNDDLTACDPKLDVWMSHGDKVTRLPDNFQITGMTSTCPIAAMSDESRRFYCVQFHPEVTHTKCGQKLLQNFVVDICGCETNWTAENIIEDAVARIKAQVGDDEVILGLSGGVDSSVTALLLHRAIGKNLHCVFVDNGLLRLNEGDQVMEMFGDKFGLNIIRVEAEDRFLEALKGIDEPEAKRKTIGKVFVDVFDDEAKKLTDVKWLAQGTIYPDVIESAASKTGKAHVIKSHHNVGGLPDYMKLGLVEPLRELFKDEVRKIGLALGLPAEMLNRHPFPGPGLGVRVLGEIKKEYCDLLRKADAIFIEELHKADWYYKVSQAFGVFLPVKSVGVMGDGRKYDWVISLRAVETIDFMTAHWANLPYDLLGKISNRIINEVNGISRVVYDISGKPPATIEWE

SEQ ID NO: 42646 - protein, 544 aa, Listeria monocytogenes str. 4b F2365
MAYSFKLPDIGEGIHEGEIVKWFVQPGDKIEEDESLFEVQNDKSVEEITSPVSGTIKEIKVAEGTVATVGQVLVTFDGVEGHEDDAEEESAAPKAESTESTPAPAQASGKGIFEFKLPDIGEGIHEGEIVKWFIQPGDKVEEDQSIFEVQNDKSVEEITSPVDGTVKDILVSEGTVATVGQVLVTFEGDFEGEASHESTPESPAEEAELTNNDATSAPVTGGNGTPSSKKDPNGLVIAMPSVRKYAREKGVNIAEVAGSGKNNRVVKADIDAFLNGEQPAASTTTAQTEEKAAAPKAEKAAAKQPVASSDAYPETREKLTPTRRAIAKAMVNSKHTAPHVTLMDEIEVTALMAHRKRFKEVAAEKGIKLTFLPYMVKALVATLRDFPVLNTTLDDATEELVYKHYFNVGIAADTDHGLYVPVIKNADKKSVFQISDEINELAGKARDGKLTADEMRHGSATISNIGSAGGQWFTPVINYPEVAILGVGRIAQKPIVKDGEIVAAPVLALSLSFDHRVIDGATAQKAMNNIKRLLNDPELLLMEV

SEQ ID NO: 42647 - protein, 467 aa, Listeria monocytogenes str. 4b F2365
MVVGDFPEERDTIVIGAGPGGYVAAIRAAQLGQKVTIIEKEYYGGVCLNVGCIPSKALITIGHRFKEAGHSDNMGITADNVNLDFTKAQEWKGGVVNKLTSGVKGLLKKNKVEMLEGEAFFVDDHSLRVIHPDSAQTYTFNNVIIATGSRPIEIPGFKYGKRVLSSTGALALTEVPKKLVVIGGGYIGTELGGAFANLGTELTILEGGPEILPTYEKDMVSLVKRNLKSKNVEMVTKALAKSAEETENGVKVTYEANGETKTIEADYVLVTVGRRPNTDEIGLEQAGVKVTERGLVEVDKQGRSNVPNIFAIGDIVPGVPLAHKASYEAKIAAEAIAGEKAENDYTALPAVVFSDPELATVGLTEKEAKEKGFDVKAAKFPFGGNGRALSLDAPEGFVRLVTRKEDGLVIGAQVAGMNASDIISEIGLAIESGITAEDIALTIHAHPSLGELTMEAAELALGRPIHM

SEQ ID NO: 42648 - protein, 442 aa, Rhodopirellula baltica SH 1
MNTDSRPNNPSEPAKLRRDVGLFGAMMMGLGSIVGTGVFVSIGIAAGITGPSVVLAILVAGLVATFNGLSSAQLAAAHPVSGGTYEYGYRWLTPSMGFTAGWMFLCAKSASAATAALGFAGYALQLFQFDHDDWIVPLAIGAVVATTLLLLGGIRRSNWTNIAIVSMTLIALASFVIAGLPFAWREGSSNLTPFFASDSPAIATRQFLEACALMFVAYTGYGRIATLGEEVHNPRRTIPRAIIVILLVSSLLYAIVGGIAVAAAGIDVWSSTSQQTAPLQLVANHLNSPLVAKLVAIGAVTAMLGVLLNLILGLSRVVFAMGRRGDLPRGLATVSTQNSNPSGAVIAVGIGVGTLALIGDVETTWSFSAFTVLVYYALTNLAATRLTADERLFSPIVPWLGLASCLGLAFWVQPKIWIIGLSLIAVGLVFQQCMKRSDTSAS

SEQ ID NO: 42649 - protein, 295 aa, Borrelia burgdorferi
MKKDYYEILGLSKGASKDEIKKAYRKIAIKYHPDRNQGNEEAASIFKEATQAYEILIDDNKKAKYDRFGHSAFEGGGFEGFSGGFSGFSDIFEDFGDIFDSFFTGNKGQERNRKHAKGEDLGYNIEISLENAYFGYKNNINITRQMLCDSCLGKKSEKGTSPSICNMCNGSGRVVQGGGFFRVTTTCSKCYGEGKIISNPCKSCKGKGSLTKQETIQLNIPPGIDNNQQIKMKGKGNVNPDNQEYGDLYVKILIRSHKVFKRNGKDLYAMLPISFTQAALGKEVKIKTIASKEIK

SEQ ID NO: 42650 - protein, 125 aa, Gloeobacter violaceus PCC 7421
MKIIRGEHNPYPYSPAVIHGGLVYTAGQIPLVPDSGEVVTGDIEAQAHQTLTNLHNVLKLAGSDLGQVIKVTVFLIDMADFAGLNRVYQTFFTDHLPARSCVAVAALPQGVKVEIEAVAALNESN

SEQ ID NO: 42651 - protein, 759 aa, Oryza sativa (japonica cultivar-group)
MAEAATTTPLLTSHEAEPSIDDVIEAYIGATGARQLLKAMLLAFAWAFDAQQVFMSVFTDAEPPWHCTGVVDAAAAAAADSGSSCSPPAASASPCALPPGTWEWDRPAETSVVSDWALNCGPALVSLPASSFFAGNLAGGFLLATLADTHLGRRKMLLLSLVTMSVAAALTAFSPNVWVYSALRFVSGFGRSMVGTSAMVLSTELDGKRWRNTVSAAGFVFFSVGFVSLPALAYTFREASWRNMYVWTSLPSLCYAVLLYLLVQESPRWLLVRGRKQEAIEAVRQIASLNGGGGGITTSSFSMLDACAVELGDGGEGMFATLHSIWERRRALRRLAAITAASFGVGMVYYGMPLNVGSLSPSNLYLSVAYNAVAELPSSILAWLLMGRWFNRRGSVVALTTASGLCSLAACVPAVVLPDGARMAAEVASFFASCTAYDMMLMYTIELFPTSVRNSAVGLVRQAVALGGVVAPVLVALGRETTSYWSSSFGVFGLAVGCLGLLVTCLPETRGRRLSDTMEEEEAAVLSSSGASDMDNNGELADGGCGVGWEVAVWDAAATAWNAVVAAWDAETAAAWEVGCRGGGDCSVGCGGGGVEHRGGGGSGGGHVGCGGGGGMGRVGGGASAFVAASTPRLLLQAHLCAKNHPTLPPPPPSPQHPTPQPPHPEPLPPPPIPRRSRRLPCSPSEGERERDLSLHHLSSSGHDGGVWRSGVAARRSAVGRRRKGGGGGGQAETVAGGGDTGMAGSEDGGIRRWLPWIG

SEQ ID NO: 42652 - protein, 426 aa, Fulvimarina pelagi HTCC2506
MTAIIDIIGREILDSRGNPTVEVDVVLEDGSMGRAAVPSGASTGAYEAVELRDADERYMGKGVQKAVYAVNNEIAEEIVGMEAEDQLMVDAALSDLDGTDNKSRIGANAILGVSLAIAKAAAESAGLPLYRYVGGPSAHVLPVPMMNIINGGAHADNPIDFQEFMIMPVGAERFSDALRMGAETFHVLKKMLKDAGHNTNVGDEGGFAPSLGSPKEALDFIMKAVEKAGYKAGDDMFIALDCAATEFFKDGTYDLAGEGRKLSSDDMGGYLKELSDAYPIISIEDGLDEDDWDGWTKLTKTIGSKVQLVGDDLFVTNSRRLKKGIEMGAANSILVKVNQIGSLSETLDAVSVAHRAGYTAVMSHRSGETEDSTIADLAVATNCGQIKTGSLARSDRVAKYNQLLRIEEELGSQADYAGRSILRLGR

SEQ ID NO: 42653 - protein, 762 aa, Porphyromonas gingivalis W83
MEQDASAKNPDIETENKGAISEEEALIQREYSLLIQDYLNSNHRRKVEKIDKAFHLAKDAHAGAKRRSGEPYILHPIAVARIVCQEIGLGSTSICCALLHDVVEDTEYTVEDMRDMFGDKVAQIVDGLTKISGEVFSNSSAQAENFRKLILTMNDDIRVILIKIADRLHNMRTLDSMLPAKQMKIAGETQYVYAPLAHRLGLFAIKSELEDLSFKYEHPQEYEAIKEKIRITEQHRLEMFEHFAAPLKQRFAGMDMSYEMKARVKSVYSIWKKMEKKGVPFEEIYDLFAVRIIFESSPTIPDKNRCWEIYSAITDIYRNRPDRIRDWVSNPKSNGYQALHLTVMGPDGEWVEVQIRSRRMDDIAEKGFAAHWKYKGDNVEEDSELEKWLSTIQEILENPNPNALDFLDTIKLNLFSNEVMVFTPKGEIKRLPQGATALDFAYSLHSDLGDHCIGAKVNHKLVPLSYVLNSGDQVEVLSSKSQQPTEEWLRYVTTARAKSKVDTFLRRKRRELINRGEERVVSVIRTSESMVSAELLDRIAAYFGFLNRETFFYAVGTGTVSLPESFKKLLQGEHSGNFLMRAIRSALKAGKSNKTSSPSGKPAEKEDKKAYNTKKTYILQEDEFSRNYQIAECCKPIPGDDAFGFINDDNTVVVHKRSCPIAMRLKSSFGNRILSTEWSLHSRTSFEAKLALKGIDSTGILTAVTQVISEDFNVGIKHIQLTAKDGIFEGQIHLLVHSSDDLLKICHQLRQNKYIQSVGRIS

SEQ ID NO: 42654 - protein, 130 aa, Oryza sativa (japonica cultivar-group)
MVRVSVLNDALKTMYNAEKRGKRQVLIRPSSKVIIKFLIVMQKHGYIGEFEFVDDHRSGKIVVELNGRLNKCGVISPRFDVGVKEIESWTARLLPSRQFGYIVLTTSAGIMDHEEARRKNVGGKVLGFFY

SEQ ID NO: 42655 - protein, 269 aa, Fulvimarina pelagi HTCC2506
MTTPLIAGNWKMNGTLRSLTELKGIADAIKDGRTEGTDVVVCPPATMLSASRGILHNAAKVGGQDCHAEASGAHTGDVAAEMLKDVGATYVIVGHSERRADHGESDEMVRAKVEAAWRAKLTAIVCIGESQEERDEGRTLDRLGEQLAGSLPDGATADNLVVAYEPIWAIGTGRTATSDDVAEAHGFIRKTLSERFGGDTGSAIRILYGGSVKPDNAFDLLHTENVDGALVGGASLKAEDFIAICEAAARPNGRDPFEPDFSDLEMGLE

SEQ ID NO: 42656 - protein, 472 aa, Thermobifida fusca YX
MITTDRIYIDGQWIAPQTSDRMAVENPYTCQDIATIPLCGTEEVDHAVHAARRAFPAWSTTDLEERLAHLDALRRELAVRATEMSALITSEMGAPKVIADRIQVGLPLTVLGDTVATARDFAWTEKIGNSLILREPIGVVGAITPWNYPLHQIVAKIAPALAAGCTVVLKPSEIAPLSALLLAEIIDSVGFPPGVFNLVTGTGPVVGEALAAHPDVDMISFTGSTRAGSRVSEVASATVKKVALELGGKSAGVVLDDADLPTAVKAVVSDCLLNSGQTCTALTRLLVPHDRYEEAVALAVDAARSKPMGDPADPATRIGPLASADAHRRVLGHLEQARKDGAVFATGGPDADVPEQGYFVAPTVLAGLDRDAAAAREEIFGPVLTVLGYRDVDDAVELANATDYGLSGAVWSADTDRALAVARRMRTGQVAINGGRFNPSAPFGGYRKSGNGRELGRFGLEEFCEVKAVQLP

SEQ ID NO: 42657 - protein, 380 aa, Citrus x paradisi
MSGTAGQVIRCKAAVAWEAGKPLVIEEVEVAPPQKNEVRLKILFTSLCHTDVYFWEAKGQNPLFPRIFGHEAGGIVESVGEGVTDLQPGDHVLPVFTGECKECPHCHSEESNMCDLLRINTDRGVMINDGQSRFSIKGKPIYHFVGTSTFSEYTVTHVGCVAKINPLAPLDKVCVLSCGISTGFGATVNVAKPEEGPTVAIFGLGAVGLAAAEGARVSGASRIIGVDLNPSRFNEAKKFGVTEFVNPKDYDKPVQQVIAEMTNGGVDRSVECTGSVQAMISAFECVHDGWGVAVLVGVPHKDAVFKTHPMNLLNERTLKGTFFGNYKPRSDLPSVVEKYMSKELEVEKFITHTVPFSEINKAFEYMLRGEGLRCIIRMEE

SEQ ID NO: 42658 - protein, 75 aa, Glycine max
SGPICYQRNRAGAGMVAPFTVLKSMAGFPTRNTNNDITSIASIVGRVQCMHVCPPIVKKKFETLSYLSDLDYAQL

SEQ ID NO: 42659 - protein, 417 aa, Rickettsiella grylli
MPEIRNYTLNFGPQHPAAHGVLRLILELDGEVIQSADAHIGLLHRATEKLAESKPYNQSIGYMDRLDYVSMMCNEHAYVLAIEKLLGVTPPKRAQYIRVMFDEITRILNHLLWLGAHALDIGAMTVFLYCFREREDLIDCYEAVSGSRMHATYYRPGGVYRDLPDKMPQYKPSQWHNEKEIREMNANREGSLLDFIENFVTRFPQLIDEYETLLTDNRIWKQRTVGIGVLSAERALQLGCTGPILRASGVAWDLRKKQPYEVYDELDFDIPIGKHGDCYDRYLVRVEEMRQSNALIKQCVGWLRANPGPVTLKKHKIVPPTRLQMKEDMESLIHHFKLFSEGYCVPPGEVYAAIEHPKGEFGIYMVSDGANKPYRVKIRSAGFPHLAALNELVSGHMIADLVAILSSLDIVFGEIDR

SEQ ID NO: 42660 - protein, 230 aa, Rickettsiella grylli
MSDVVSQLQKLNQRFNSVIQEIAVARNEINLEISAEKLKEVGLALRDEADFKFELLVDVCVVDYAEYGVSEWTTEQSTLTGFERGVDKTGDLHPINWNKPRFAVVYHLLSLTHNQRLRLRIFAQGEPPQVPSVIKLWPAANWYEREAFDLFGVFFDGHPDLRRLLTDYGFVGHPFRKDFPLTGHVEVRYDATKGRVVYQPVTIKHRTLVPKTIRKTKNEAILTCFHKKPE

SEQ ID NO: 42661 - protein, 432 aa, Aeropyrum pernix
MDVLASGEKSRMLFERTKELFPGGVNSPVRAAVKPYPFYVKRGEGAYLYTVDGARIVDLVLAYGPLILGHKHPRVLEAVEEALARGWLYGAPGEAEVLLAEKILGYVKRGGMIRFVNSGTEATMTAIRLARGYTGRDLILKFDGCYHGSHDAVLVAAGSAAAHYGVPTSAGVPEAVARLTLVTPYNDVEALERVFAEYGDRIAGVIVEPVIANAGVIPPRREFLAALQRLSRESGALLILDEVVTGFRLGLEGAQGYFNIEGDIIVLGKIIGGGFPVGAVAGSREVMSLLTPQGKVFNAGTFNAHPITMAAGLATLKALEEEPVYSVSREAAKALEEAASEVLDRTGLPYTINRVESMMQLFIGVEEVSNAAQARKADKKFYVKLHEEMLRRGVFIAPSNLEAVFTGLPHQGEALEIAVEGLRSSLKTVLGS

SEQ ID NO: 42662 - protein, 812 aa, Photobacterium profundum SS9
MKFSESWLREWVKPAINSEELAHQITMAGLEVDEVAPVAGEFTGVKVGKVVECGQHPDADKLQVTKIDIGEEALLDIVCGASNCRLGLTVAVATVGAVLPGNFKIKKAKLRGVPSHGMLCSFSELGIDVESDGILELPEGTALGMDVRELLELNDVAIDVDLTANRADCFSIRGLAREVGVLNRADVTEPVIDAVAPSIDDTVSVEIKATDACPRYLGRVVKNINVKAESPIWMQEKLRRCGIRSIDAVVDITNYVMLEQGQPMHAFDLSKIDGGIVVRLAEQGEKLTLLDGNETELNSNTLVISDHTKALAIAGIFGGKDSGVTTETTDVLLEAAFFAPDHIRGRARAYGLHTDSSLRFERGVDSTLQAAAMERATQLLVEICGGEVAPVNGSESEADLPKANVVALRRTKLDSLLGHEIPSEDVVEILTRLGCNVSVVDDSETTDAGWTATSPAWRFDIAIEQDLIEEVGRIYGYDNIPNQAPVAALKMNDHKEANQPLKRVRDLLVDRGYHEAITYSFVEPEQQKLVVPGVEPLILPFPISADMSAMRLGLIQGLLNTVVHNQKRQQSRVRLFESGLRFIPEASAENGMRQEMMLAGVIAGTRGEEHWDIDTNTVDFFDLKGDLEAILELTANEKAYSFKALSSENKKQNPVLHPGQSAVIVVDAGLETEKEVGVIGTVHPELERKFGLNGRTIVFEIEWAAINTRVLPEAVAVSKFPANRRDIAVVVDEAAASGDIVKACIAAGGEFLTDAKLFDVYVGKGVEEGKKSLAIALSLQSVERTLEDADISGAVDSIVAVLAERFGASLRD

SEQ ID NO: 42663 - protein, 579 aa, Cryptococcus neoformans var. neoformans JEC21
MVKTHAPDREHIPPLSNFDIDLHPDTVGYVQDSQALADAIGSNGLKDVFASPIVFMAAFSACMGGLLFGFDQGILSIVLTIPQFLKVFPETDISVTSSAGLNKGVMTALLELGAFLGAMQAGFISDKISRKRTIMVGACWFVVGSALQAGSKSFAMLVIGRFIGGIGVGVLSSTAPTYISEIAPPNVRGAFLALEGSSIVIGIVIMFYITYATRHILDSWSFRLPFTVQVVPCIALGIGLWLLPYSPRWLATVGRDQDALDSLVRLRQLPSTDPRLQAEWITIRAEAIQQREVVINAHPHLQGESGFVQDFKLEMHAWIDMFKPNIIARTMIGVMLMVFQQLQGINALIYYSPTLFEQLGLDYEMQLTMSGVINVSQCVATIVAFFLLDRIGRKPPLLIGSVVNAICHFTVAGLIAKYSDNWAAHQSAAWAGVGLLITFMFFFGIGWSPVPWALPAEIHSSSRRAKGVAITTCSNWFFNFIVGLITPPMLQSIRYGTFIFFGAFAVMSGIWAWFLCPETKGLTLEAVDQLFHNHAAQEELRQKHDIISRMIGMELTTTPQPELVDDEKKIYTVQHLESV

SEQ ID NO: 42664 - protein, 705 aa, Trichodesmium erythraeum IMS101
MNLNILPGNTFPIGATVCQDPKGVNFSIYSKNATAIELLLFDEPLAAKPKQVILLDPTQHRTHHYWHIFISGIGAGQIYAYRVYGPFNPEKGHRFDGTKVLLDPYARIVVGQEKYSRKAATGNGNNCAYALKGVVVDPTTYDWEDDKPLETPYAKTVIYEMHVGGFTRHPNSGVAPEKRGTFAGLIEKIPYLKELGITAVELLPVQQFDEQDVREPLINYWGYSQIAFFAPHHSYSSRKDIFGPMDEFRDMVKALHKEGIEVILDVVFNHTAEGNENGPTVSFRGLENSTYYILEKNDRGYYSNYTGCGNTFNTNNPFVHRLIVDCLCYWVREMHVDGFRFDLASVMSRSMTGDPLEDPPVLWAIESDPVLAGTKIIAEAWDAAGLYQVGSFIGDRFAEWNGHYRDDVRQFVKSDPQIVEKLAARIMGSPDIYPKPDREPNHSINFITCHDGFTMNDLVSYNEKHNEANCEDNRDGANHNFSWNCGIEGTTDQEEIEMLRLRQIKNFFTILFFSQGTPMILMGDEVRRTQLGNNNSYCQNNKSSWFDWSQIDQQNDLLRFVKKIIHFTQELQITQLDKVLATVGAIPESSLVSTKEKTNLNKVPNISWHGIHLGIPDWNVGSRTLAFSLKHPESGEYFHIMLNAYWKPLMFELPPLERGENWYLIVNTAFTSPKDFNNLDVATKVIGVRYRLEPRAAVILMTKRD

SEQ ID NO: 42665 - protein, 410 aa, Solanum lycopersicum
MGCCKEEEPKWLWVNGPIIVGAGPSGLAVSACLKENGVPSLILERSDCIASLWQHKTYDRLKLHLPKQFCQLPLFDFPENFPKYPTKHQFISYLESYAKHFSITPKFKQSVKVAEFDGVCGFWKVQTQDFQYLSKWLIVATGENAEAVIPEIPGIDKFKGRLMHTSVYKSGTEFINQRVLVIGCGNSGMEVSLDLCRHNAIPHMVVRNSVHILPREMLGISTFSIAMALLKWMPLRIVDKLLLLVANFSLGSTDKLGLRRPKTGPLELKNATGKTPVLDVGALSQIKTGKIQIMPGVKEITKIGAKFLDGKEGEFDSIILATGYKSNVPSWFKGSDFFTEQGMPKTPFPNGWKGENGLYTVGFTRRGILGTANDAKNIARDISEQWREFKGFCKNFCTTKNLSDNQGICF

SEQ ID NO: 42666 - protein, 529 aa, Zea mays
MRIPRRKGGAGPLAVGVPSRRAQVAAVFALAALLGVSVLYDNAHIAASLRRHGGPRTYAKLSSFEGATAVPSIAKEEAAAAVARATESVPVHGADRADSPPHERQEEIEERASKPGATAGSSLQDAPLIEEVVQGGSGGHDGDGDGDGGAQAQEQPPAPGTCDLYKGRWVYDESRAPLYKESDCSFLTEQVTCMRNGRRDDDYQKWRWQPDGCDLPRFEAKLLLEKLRNKRLMFVGDSLNRNQWESMVCLVQSEAPWDKKSLVKNGSLNVFHLQEYNATVEFYWSPFLVESNSDDPDIHSISDRMIKPTSIAKHAANWEGVDYLIFNTYIWWMNTPQMKTLHGGSFSRKHVKYDEIERVEAYRKVLKTWSRWVEAHVDPKRTTVLFMSVSPVHMQSEGWGSPNAVKCFSETQPAISYNKKLEVGTDWDLFATAQRVTRSMKKVPVHFVNITALSEIRKDAHTSVHTLRQGKLLTPEQKANPRKFADCIHWCLPGVPDTWNEFVYGHIVSSTPPPQQQQQQKITEDEPHR

SEQ ID NO: 42667 - protein, 511 aa, Triticum aestivum
MEPTPLSACISLLCIALLCIALLCLLWHKSTKPPAGAPAPPRPPGPTPFLVIGNIPDLVRGGELHRALARLSVSYGPVMSMRLGMASLVVLSSPATAHEALHKKEGAVSSRWVPDSASVMGHSGISMVWLPSSSPLWKHLRTVASTLLFTSRRLGASRAIQERKARELVDHLHASSGRPVRVALPVFSAVLNMLSSVLFSEDVVELGSVTGQEFMELIADSVAETAKPNISDFFPFLSSLDLSRRRRAVAANLSRFYQFFDAVIDRRLNSAEKPGDLLESLLELPAKSQLERPVIRALLTDLFIAGSHTTTTTVEWAMAELLRNPTKMAKARAELREAFGSGNAEEGDLANLPYLQAVMKETMRLHPPAPLLLPHEVSETGVTLGGCSVPKGARVLINVWAIGRDPEVWAEPEVFMPERFLDREVDFRGRALEFIPFGSGRRACPGMPLAVTVVPMVLASLLHEFEWRLPDGMAPGDVDLSDRFGAALELAVPLRAVPVWTKGAEDLSFSS

SEQ ID NO: 42668 - protein, 141 aa, Neurospora crassa
MKGTKKEAIPITTMKAILRLVLNQANHPLLIHCNHGKHRTGCVVGIVRRTLGWDVSNILEEYRSYAEPKVRETDVNYIQGFEMAQISNLFSKDMNLQRWRFGSPKFAHSTVVAMIFLLFWYHFSGIPLPTSDAVDRKLLTQ

SEQ ID NO: 42669 - protein, 205 aa, Oryza sativa (japonica cultivar-group)
MAAEAETKAMITLRSCEGQVFEVAEAVAMESQTIRHMIEDKCADTGIPLPNVSAKILSKVIEYCSKHVEARGGAAAAADGDAPAPAAVEANKAVEDELKTFDAEFVKVDQSTLFDLILWRIFIGILSLALHVFLPLTSVHCADQTWYRAANYLNIKGLLDLTCQTVADMIKGKTPEEIRKTFNIKNDFTPEEEEEVRRENQWAFE

SEQ ID NO: 42670 - protein, 491 aa, Methanocaldococcus jannaschii DSM 2661
MRRDINNFLFGERMELFEILKQKIKEKEVITPKEMAIIDDNAEFLGIQKILLMENAGKAVYEEIKDIDAEEFIIFCGTGNNGGDGFVVARHLGKGDVILIGKESEIKTYEARENFKILKNLAEFGNIRIREIKWAEEVNDIFERLKNKKAVIIDAMIGTGVKGELREPFKTIVDKINELKQINKNIFVISVDVETGHLESDLTITFHKRKTINKDNAIVKKIGIPKEAEYIVGWGDLKALRKRDSNSHKGQNGKVLIIGGSKDFYGAPILAGLAALKIVDLVGILSVGKVIDKVNHPEFIMYRVEGDYLSSQHVDYTLEIAKKYDVVVLGNGLGANNRTKAFLNEFLAKYDGKVVIDADAIKVIDYNNFEFSENYIFTPHKREFEYMGIDLDNIENIKSTIVLKGKYDIIFNANNLKINKTGNAGLTKGGTGDVLAGLIGALFAVNEAFLSACCGAFINGYAGDLLLKEKGYYYTPLDLIEKIPNVLKIFQ

SEQ ID NO: 42671 - protein, 629 aa, Solanum tuberosum
  misc_feature (403)..(403): Xaa can be any naturally occurring amino acid
  misc_feature (406)..(406): Xaa can be any naturally occurring amino acid
  unsure (1)..(629): unsure at all Xaa locations
MVKVMEKDAVVVSLVVWLILVVHHLKLIYANMEGDALHSLRVNLQDPNNVLQSWDPTLVNPCTWFHVTCNNDNSVIRVDLGNAALSGLLVPQLGLLKNLQYLELYSNNISGLIPSDLGNLTNLVSLDLYLNNFVGPIPDSLGKLSKLRFLRLNNNSLTGNIPMSLTNISSLQVLDLSNNRLSGVVPDNGSFSLFTPISFANNLDLCGPVTGRPCPGSPPFSPPPPFVPPPPISAPGGNGATGAIAGGVAAGAALLFAAPAIAFAWWRRRKPQEYFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPSEPPLXWPXRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLQNKYVEAEVEQLIQVALLCTQSNPMDRPKMSEVVRMLEGDGLAERWDEWQKVEVLRQEVELAPHPGSDWLVDSTENLHAVELSGPR

SEQ ID NO: 42672 - protein, 519 aa, Bartonella quintana str. Toulouse
MRDTYYITTPIFYPNSTPHIGHAYSAIASDALARFQRLDGKNVFFLSGTDEHGLKMQQTATALGMTPKQLADRNSAVFKKMLAALNCSNDDFIRTTEERHYQACQEIWKKMQADGDIYLGCYKGWYSVRQEAYYEEKETEVGEDNIRREKELGSPVEWNEEESYFFRLSRYEKALLEHYEKHPDFIAPLERYNEVISFVKSGLKDISISRASFHWGICVPGNPKHVMYVWVDALTNYLSAIGFFDGNSKKRDFWPANIHIIGKDIIRFHAVYWPAFLMSAGIALPKRVFAHGFLLNRGAKMSKSIGNVVDPFEMIDHYGLDQVRYFLLREVPFGQDGSYGHDNVVNRINADLANDLGNLALRSLSMIAKNCDAKVPRPAAFLIQDEQLLKQSLQALDITRQAMSSQEMHLALSAIFSVVADANRYFANEQPWNLRKNNPERFSTVLYITVEILRRIGIMLLPFMPQSAAKLLDSLAISENDRLLYHISHSKIQEGLDLPPPEPIFPRYILKKNDIDHVY

SEQ ID NO: 42673 - protein, 629 aa, Solanum tuberosum
MVKVMEKDAVVVSLVVWLILVVHHLKLIYANMEGDALHSLRVNLQDPNNVLQSWDPTLVNPCTWFHVTCNNDNSVIRVDLGNAALSGLLVPQLGLMKNLQYLELYSNNISGLIPSDLGNLTNLVSLDLYLNNFVGPIPDSLGKLSKLRFLRLNNNSLTGNIPMSLTNISSLQVLDLSNNRLSGVVPDNGSFSLFTPISFANNLDLCGPVTGRPCPGSPPFSPPPPFVPPPPISAPGGNGATGAIAGGVAAGAALLFAAPAIAFAWWRRRKPQEYFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPSEPPLEWPKRKRIALGSARGLSYLHDHCDPKIIHRDVKAANILLDEEFEAVVGDFGLAKLMDYKDTHVTTAVRGTIGHIAPEYLSTGKSSEKTDVFGYGILLLELITGQRAFDLARLANDDDVMLLDWVKGLLKEKKLEMLVDPDLQNKYVEAEVEQLIQVALLCTQSNPMDRPKMSEVVRMLEGDGLAERWDEWQKVEVLRQEVELAPHPGSDWLVDSTENLHAVELSGPR

SEQ ID NO: 42674 - protein, 332 aa, Oceanicola granulosus HTCC2516
MSLDAAVTKPHERLAEALSDDLAAVNALIRERMQSEHAPRIPEVTAHLVEAGGKRLRPMLTLAAARLCGYDGPYHVHLAATVEFIHTATLLHDDVVDESAQRRGRPTANLLWDNQSSVLVGDYLFAKSFLLMVDTGNLDVLRILSQASATIAEGEVLQLTASRSLATDEAVYMKVIRGKTAALFSAATEVGGVIAGQGPEVCRALFDYGDALGIAFQIVDDLLDYEGTEATGKNVGDDFRERKLTLPVIKAVARADAEERAFWQRTIEKGRQEEGDLETALGLLARHGALDETRAAAIEWAARAKAALAPLPDSALTEMLADLADYVVARIS

SEQ ID NO: 42675 - protein, 1076 aa, Ehrlichia canis str. Jake
MPKRTDIESILVIGAGPIVIGQACEFDYSGTQACKVLKQEGYRIILINSNPATIMTDPEIANSTYIEPITPSIIEKIIIKEKPSAILPTVGGQTALNVAIKLCEQGILEKHNVKLIGATKEAIQKAEDRNLFRQAMDKIGVKYPKSIIIKSVDEIKHALEYIGLPAIIRPSFTLGGIGGGISYNKEEFQKNVMYGLSISPISEVQVDESIIGWKEFEMEVMRDNKDNCIVVCSIENLDPMGVHTGDSITVAPALTLRDTEYQKMRDISFSILREIGVDTGGSNVQFAVNPKNDEDLLVIEMNPRVSRSSALASKATGYPIAKVAAKLAIGYSLDEIQNDCTKAIPASFEPSIDYIVTKIPRFNFDKFRGAEKELSTSMKSVGEVMAIGRSFPESLQKALCSLESGYSGLDEHFDKNIEKDQLYNALVKLSPDRIFIIADALRHNISIEEINKITGYDPWFLIQIKNIIQFEQQIKNHGLPKEAEGLLLLKKMGFSDARLAHLSNNTIEYVENLRRSLLINPVYKHIDTCAGEFKTNASYMYSCYEGDTVNPPECESVVTDNKKVIILGSGPNRIGQGIEFDYTCVHAAHTIRQMGYESIMINCNPETVSTDYDISDKLYFSPLTRESVLDIIFKEKETNSLLGVIVQFGGQTPLKLAKVLQEKNINILGTSFDSIDLAENRMKFQQLLTQLNLKQPPNVTCNSINEVYECVQSLAFPILARPSYVLGGQSMSIIRDSNALSNYLTIHKNIFDNGSLLLDQFLTNAVEVDVDAICDGESVYITGIMEHIEEAGIHSGDSACSLPAYTLTSEITDTIAEYTKKIALALQVIGFINIQYAIQDGEIYILEVNPRASRTVPFIAKATGIPIAKIATKILLGEKLPTILERKLNYIAVKEAVFSFSRFPNIDVLLGPEMKSTGEVMGIDKSFEIAFAKAQMAAGYELPTQGTAFISVKNSDKPLIVQTAQILQDIGFTIFSTKGTSTYLNEAGITTQQVNKVREGRPHILDLLQDDKINLVINTSECIKSFSESSSIRKTALVKKIPYSTTIPGAKALASAIKTLKKQGIQVEPMQEYTKE

SEQ ID NO: 42676 - protein, 339 aa, Oryza sativa (japonica cultivar-group)
MEISSSLNKRKLGEAQHDGDRVVIKKRQSVSMDMEVLHCPVCFQILRPPVFQCDLGHLVCSPCRDNLPAGGKCPSPSCFGTPSVRCVAMERVVNSVEVACAYAEHGCPDKIAYANITEHEKTCPHAPCFCPEPGCGFAAASAAALADHFTAPRHNWPSHKLSYSQPFELRVHPGKNVLVGEEDGALFLLNVSPAAEHAVVSLFSVQPHHGASGFGRSASHFGCSVEFSCFLGHLQCSTLVTVTSSSLSDGMPEECFFSVPELQDSVDGDAGVGVDIRITIDEAVPLFSCVDGMEDDDDEDCDDDVDANNGDDDENDGDTSDDEDEDDEDGDSCCDDEED

SEQ ID NO: 42677 - protein, 532 aa, Synechocystis sp. PCC 6803
MAEAPIAPVVLVILDGWGYRPDTRANAIAQANTPIMDSLIAAYPNTLVNTSGKDVGLPKGQMGNSEVGHLNLGAGRVVPQELVRISDAIEDGTFFDNQALIEVCQRVRDRRGKLHLIGLCSDGGVHSHIDHLLGLIDLAKLQGISQLCIHAITDGRDTPTNEGAHFVQQIQAHLEKIGLGRIVSVSGRYYALDRDRRWDRVEKAYRVMTEDGVGDGRSAAQVIKDYYASDITDEFIPPTRIGAGAIASGDGVIFYNFRPDRARQLCYALVNPSFDGFPRERIQPLDFVTFTQYDPALPVVVAFEPQNLNNILGEIISRQGMKQFRTAETEKYPHVTYFFNGGLEQPFAGEDRELIQSPMVSTYDKAPQMSAKAVTDAVCRAMEKGIYSLVVVNYANPDMVGHTGKLKEAIQAIETVDLNLGRLLASAAKVGGTVLITADHGNAEYMSDESGNPWTAHTTNPVPFILVEGEGRKIPGHGGEVKLREGGKLADIAPTILDILQLPVPAEMTGKTLIDQPLVEIKANRTPVNLSR

SEQ ID NO: 42678 - protein, 261 aa, Psidium guajava
NWGFFELVNHGIPPEMMDTIERMTKGHYKKCMEQRFRELVVSKGLEYVQKEVHDLDWESTFHLKHLPESNISQISDLDDDYRKVMKEFAVKLEKLAEQLLDLLCENLGLEKGYLKKAFYGSNGPTFGTKVSNYPPCPKPDLIKGLRAHTDAGGIILLFQDDKVSGLQLLKDGQWVDVPPMHHSIVVNLGDQLEVITNGKYKSVLHRVVAQTDGNRMSIASFYNPSTDAVIYPAPALVEREEEEAGKGTYPKFVFEDYMKLR

SEQ ID NO: 42679 - protein, 864 aa, Arabidopsis thaliana
MNILGFTVNFLIRCKVLPRRSNTSSLSRNISVLASYDQEEVSPGRYSNEFSNRNLVHEILQLCARNGAVMEAKACHGKIIRIDLEGDVTLLNVLINAYSKCGFVELARQVFDGMLERSLVSWNTMIGLYTRNRMESEALDIFLEMRNEGFKFSEFTISSVLSACGVNCDALECKKLHCLSVKTCIDLNLYVGTALLDLYAKCGMIKDAVQVFESMQDKSSVTWSSMVAGYVQNKNYEEALLLYRRAQRMSLEQNQFTLSSVICACSNLAALIEGKQMHAVICKSGFGSNVFVASSAVDMYAKCGSLRESYIIFSEVQEKNLELWNTIISGFAKHARPKEVMILFEKMQQDGMHPNEVTFSSLLSVCGHTGLVEEGRRFFKLMRTTYGLSPNVVHYSCMVDILGRAGLLSEAYELIKSIPFDPTASIWGSLLASCRVYKNLELAEVAAEKLFELEPENAGNHVLLSNIYAANKQWEEIAKSRKLLRDCDVKKVRGKSWIDIKDKVHTFSVGESGHPRIREICSTLDNLVIKFRKFGYKPSVEHELHDVEIGKKEELLMQHSEKLALVFGLMCLPESSPVRIMKNLRICVDCHEFMKAASMATRRFIIVRDVNRQNEEHNKAALREAKIKELKALIGQLSGRSSLYCSDACLKRYLEARNWNVGKAKKMFEETLKWRSSEGEAGKVYKAGFHDRHGRTNTKSLYLIANAILNLPEDQEQMSWLIDFTGWSMSTSVPIKSARETINILQNHYPERLAVAFLYNPPRLFEAFWKEHAKTFVKVKFVYPKNQESVELMSTFFDEENLPTEFGGKALLQYNYEEFSKQMNQDDVKTANFWGLCNSNNNQLHASNGFSGAEIAPEPVQTHP

SEQ ID NO: 42680 - protein, 416 aa, Methanococcoides burtonii DSM 6242
MAEQNPFENARKQLQKCADILELDEGIHDILKNPMREMHVSLPIRMDDGSIKVFQGFRVQYNDAKGPTKGGIRFHPDETVDTVKALAAWMTWKCAVMDIPLGGGKGGVICNPKEMSQSELERLSRKYISSISMIVGPDKDVPAPDVYTNPQMMAWMMDEFSKFAGKNQFGVITGKPLSVGGSLGRGDATARGGLYAVREAAAEIGLELKDATVAIQGYGNAGYFAGTLCEELFGCKVVAVSDSRGGAVNMNGISAEAAQEHKKATGSVVGLAGTEPISNEDILELDVDILIPAALEHVITHENADNIKAKIVAELANGPTTPEADEMLFQKGVHLIPDFLCNGGGVTVSYFEMVQNFYMYRWSIERVHNRLDAKMTNAYHAVLEASKQYNVNMRTAAYVVAVNRVVEAMADRGWLY

SEQ ID NO: 42681 - protein, 433 aa, Synechocystis sp. PCC 6803
MIYDIFMPALSSTMTEGKIVSWTKSPGDKVEKGETVLVVESDKADMDVESFNEGYLAAILVPAGEEAPVGATLGLVVETEAEIAEAQAKAGSGGGSSAAPTATPAPQQPEPVAIASATAIETTPAPSSNGNGKGSGRIIASPRAKKLAKELKVDLATIAGTGPHGRIVAADIESAAGKPVTASIAAPSAPAPKTSPAPTPRVTSTPSVPVGQTVPLTTFQKALVQNMVAAMAAPTFRVGYTITTDGLDQLYKQIKGKGVTMTALLAKAVALALKKHPIVNASYTDQGIIYHKDVNIALAVAMPDGGLITPVLQNADQVDIYSLSRRWKELVERARAKQLQPEEYSTGTFTISNLGMFGVDRFDAILPPGQGGILAVGASRPQVVANEEGLIGTKRQMAVNVTCDHRVIYGAHAAAFLKDLAVIIEENAQSLTM

SEQ ID NO: 42682 - protein, 442 aa, Methanococcoides burtonii DSM 6242
MNINTKEDVLKAIENNNVKFIRLQFTDIQGVVKDVEIPVTQIEKALSVGISFDGSSIEGFVRINESDMVLKPDTSSFAILPWNQKKGVVARMICDIYLPDGTPFEGDPRYTLKKVMKEAKEMGFSLNVGPELEFFLFERHDGKATTIPHDFGRYFEFAPADLAEDIRRDIVLTLMDLGFEIEASHHEVAFGQHEIDFKYGDALTTADNVTTFKYVTRTIAKLNGLHATFMPKPIFGENGSGMHVNLSLSKNGENIFYDADGDMQISDEARYFIGGLLKHVKAITAISNPLINSYKRLVPGYEAPVYIAWSGANRSSLIRIPAARGKGTRVELRSPDPSCNPYITFAAVLAAGLDGIRNKIDPGDNREENIFELTDKGLRDFGIETLPSTLNDSAKYLADDELLKEALGAHVHNSVLSLAKAEWDSYRIQVHDWEIERYLNTV

SEQ ID NO: 42683 - protein, 420 aa, Zea mays
HRCRVVPAGRFYEITRNKGVGLTFAAMGMTSFCDGPADGSNLTGVGEIRLVPDMPTLVRLPWSRHEEMVMADMQIRPGEGWEYCPRNTLRKVTKVLLDEFNVTMKAGFENEFFLRRKLVSNGVEMWVPYDNTNYCSTSAFDGASSILQEVYSSLKDSGIVVEQLHAEAGKGQFEIALKYILCTVAADKLIYARETIKSIARKHGLVATFLPKPDLDDFGSGSHVHLSLWENDQNVFMGSSKDNFHGMSKTGEQFLAGVYHHLPSILAFTAPHPNSYDRIQPDTWSGAYLCWGKENREAPLRTACPPGVPLDLVSNFEIKSFDGCANPHLGLAAIVAAGIDGLRRHLKLPEPIESNPSDHSSKLKRLPQNLQESVESLSADKVLHELIGDKLVTTAIAIRKAEINHFAKNPGALKDLIHRY

SEQ ID NO: 42684 - protein, 559 aa, Azoarcus sp. EbN1
MEVANNSKHSVFIAVTEPFTPPHRLSAWSTLENHAARLRTMRIAELFEHDAARFATLSFGHRGLLLDLSKQSIDAPALAALVDLAGQARLPDGIEALFAGEHLNFTEDRAVLHMALRGACAAPLEDAATLAQSQQRMRAFTVALRSGTMTGATGKPIRLVVNLGIGGSDLGPRMAAQALVPTGLRATPEVRFVANIDRRELDEALADADPASTLFVVSSKSFATAETLANAQAARAWLQAGLGAGCDPALHFTAVSNATDAAAAFGIPAERVFPLPEWVGGRYSVWSTIGLPLMIAIGASEFDAFLAGARAMDEHFRTAPPGENLPVLMGLAGLWNTDFLGIESLALLPYAHGLRSFAAWLQQLEMESNGKRCLRDGSGSVIHTSPIVWGGVGTVGQHAFHQLFYQGTRRVALDFIVPVAAADDVSQRSLVENAFAQSAALMSGRDLDTALASLRAKGLAESEAAVLAPHLVCPGNQPSTTVLLPALDAFSLGQLMALYEHKVFVQGWIWGINSFDQYGVELGKEMARSLSAGSGENHDASTAGLMAAAEAMRRTPDRS

SEQ ID NO: 42685 - protein, 410 aa, Solanum lycopersicum
MGCCKEEEPKWLWVNGPIIVGAGPSGLAVSACLKENGVPSLILERSDCIASLWQHKTYDRLKLHLPKQFCQLPLFDFPENFPKYPTKHQFISYLESYAKHFSITPKFKQSVKVAEFDGVCGFWKVQTQDFQYLSKWLIVATGENAEAVIPEIPGIDKFKGRVMHTSVYKSGTEFINQRVLVIGCGNSGMEVSLDLCRHNAIPHMVVRNSVHILPREMLGISTFSIAMALLKWMPLRIVDKLLLLVANLTLGSTDKLGLRRPKTGPLELKNATGKTPVLDVGALSQIKTGKIQIMPGVKEITKIGAKFLDGKEGEFDSIILATGYKSNVPSWFKGSDFFTEQGMPKTPFPNGWKGENGLYTVGFTRRGILGTANDAKNIARDISEQWREFKGFCKNFCTTKNLSDNQGICF

SEQ ID NO: 42686 - protein, 376 aa, Bacillus cereus ATCC 14579
MAQKQKCVAMLLAGGKGSRLSALTKNLAKPAVPFGGKYRIIDFTLSNCANSGIETVGILTQYQPLELHNYIGIGNAWDLDRVSGGVTVLPPYAESSGVKWYTGTASAIYQNLNYLSQYEPEYVLILSGDHIYKMDYSKMLDYHIEKESDVSISVIEVPWDEASRFGIMNTNEEMEIVEFEEKPQFPRSNLASMGIYIFNWSILKEYLEMDARNPESSNDFGKDVLPLLLDEGKKLMAYPFEGYWKDVGTVKSLWEANMDLLRDETSLNLNDRNWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAEGK

SEQ ID NO: 42687 - protein, 502 aa, Arabidopsis thaliana
MMHSVSRLARRFCATLATATAEISGEAAASVPTKAKKHRSIYKKLSSLGTRGGGKMEETLNQFVMEGVPVKKHDLIRYAKDLRKFRQPQRALEIFEWMERKEIAFTGSDHAIRLNLIAKSKGLEAAETYFNSLDDSIKNQSTYGSLLNCYCVEKEEVKAKAHFENMVDLNHVSNSLPFNNLMAMYMGLGQPEKVPALVVAMKEKSITPCDITYSMWIQSCGSLKDLDGVEKVLDEMKAEGEGIFSWNTFANLAAIYIKVGLYGKAEEALKSLENNMNPDVRDCYHFLINLYTGIANASEVYRVWDLLKKRYPNVNNSSYLTMLRALSKLDDIDGVKKVFAEWESTCWTYDMRMANVAISSYLKQNMYEEAEAVFNGAMKKCKGQFSKARQLLMMHLLKNDQADLALKHFEAAVLDQDKNWTWSSELISSFFLHFEEAKDVDGAEEFCKTLTKWSPLSSETYTLLMKTYLAAGKACPDMKKRLEEQGILVDEEQECLLSKICP

SEQ ID NO: 42688 - protein, 347 aa, Methanocaldococcus jannaschii DSM 2661
MMKVCVIEGDGIGKEVIPEAIKILNELGEFEIIKGEAGLECLKKYGNALPEDTIEKAKEADIILFGAITSPKPGEVQNYKSPIITLRKMFHLYANVRPINNFGIGQLIGKIADYEFLNAKNIDIVIIRENTEDLYVGRERLENDTAIAERVITRKGSERIIRFAFEYAIKNNRKKVSCIHKANVLRITDGLFLEVFNEIKKHYNIEADDYLVDSTAMNLIKHPEKFDVIVTTNMFGDILSDEASALIGGLGLAPSANIGDDKALFEPVHGSAPDIAGKGIANPMASILSIAMLFDYIGEKEKGDLIREAVKYCLINKKVTPDLGGDLKTKDVGDEILNYIRKKLKGY

SEQ ID NO: 42689 - protein, 310 aa, Zea mays
MAGSLHLPVVDLALPDLRAAAESIRQACVEHGFFYVTNHGVDRGLLEAVFAESKRFFDLPMEDKMALLRGANHRGYTPPYAEKLDASSQFVGDLKESFYIGPLDDGDMHNDVNQWPSEERLPSWKETMKLYFAAVLDTGTRILSLVALGLDLDADFFHKIGALKCPSTFLRLLHYPGEVHESDSGNYGASAHSDYGMITLLVTDGTPGLQICREKDRNPQLWEDVHHIDGALIINIGDLLERWTNCAFRSTLHRVVAIGKERYSVAFFLDPNPDTLVQCLESCCSEACPPRFPPIKSWDYIAGRLNSTYK

SEQ ID NO: 42690 - protein, 359 aa, Salmonella typhimurium
MSKNYHIAVLPGDGIGPEVMAQALKVMDAVRVLICVYHSHYDVGGIAIDSSGIPLPKATVEGCEQADAILFGSVGGPKMGKFAPGKPAGARRLLPLRKHFKLFSNLRPAKLYQGLEAFCPLRADIAANGFDILCVRELTGGIYFGQPKGREGSGQYEKAFDTEVYHRFEIERIARIAFESARKRRCKVTSIDKANVLQSSILWREIVNDVAKTYPDVELAHMYIDNATMQLIKDPSQFDVLLCSNLFGDILSDECAMITGSMGMLPSASLNEQGFGLYEPAGGSAPDIAGKNIANPIAQILSLALLLRTADANDAATAIEQAINRALEEGVRTGDLARGAAVSTDEMGDIIARYVAEGV

SEQ ID NO: 42691 - protein, 129 aa, Triticum aestivum
MAVSWTRVLKSGVIPRDATQLVGTRGFAVVAKGKKDGKGGAADAKPVPSKEMKSTRVFGVNILKEGSDPNIQPDSECPGWLWHMIDKHLVLSELRRKDAKTLPYEDQKRFVKLDNRTRIKENNALTAKN

SEQ ID NO: 42692 - protein, 425 aa, Porphyromonas gingivalis W83
MEIAKIIGREILDSRGNPTVEVDVHLACGIIGRAAVPSGASTGENEAIELRDQDKARYCGKGVLKAVKNVNEVIDPALCGMSVLEQTAIDRKLIELDGTKTKSNLGANAMLGVSLAVAKAAAAYLDIPLYRYIGGSNTYVLPVPMMNIINGGSHSDAPIAFQEFMIRPVGACCFREGLRMGAEVFHALKKVLHDRGLSTAVGDEGGFAPALNGTEDAIESILKAVEAAGYVPGKDITIAMDCASSEFFKDGIYDYTKFEGEKGKKRSIDEQVAYLTELVGKYPIDSIEDGMSENDWEGWKKLTVALGDKVQLVGDDLFVTNVEFLRRGIAEKCGNSILIKVNQIGTLTETLNAIEMAHRHGFTSVTSHRSGETEDTTIADIAVATNSGQIKTGSLSRTDRMAKYNQLLRIEEELGPCAVYGYKKV

SEQ ID NO: 42693 - protein, 369 aa, Triticum aestivum
  misc_feature (151)..(151): Xaa can be any naturally occurring amino acid
  unsure (1)..(369): unsure at all Xaa locations
GVLIVGVLAVVIGAAFCGIFAFSYYRRQKQKIGSSLEVSDSRLSTDHFQQKEACRRSASPLISVEYSNGWDTMSGGGCGSSGEVGDSFRFNLEEVECATQYFSEVNLLGKSGFAATFKGILRDGSVVAVKSLNKTSCKQEESDFLRGLKTXTMLRHENLVGLRGFCCSRGRGECFLVYDFMVNGCLSHYLDVKEGSEASVLDWPTRVSIIRGIAKGIEYLHSKKSNKPSLVHQNISAEKILLDHHFAPRLSVPGLHKLLADDVVFSALKASAAMGYLAPEYANTGRFTEKSDVFAFGIVVLQVITGRRAVSQVKVGTASSDLEGLIDPYLGGIFSTTEAARLAEVAVHCTSEAASQRPTMEAVVQQLSG

SEQ ID NO: 42694 - protein, 226 aa, Methanocaldococcus jannaschii DSM 2661
MSNEDLKLKVAKEAVKLVKDGMVIGLGTGSTAALFIRELGNRIREEELTVFGIPTSFEAKMLAMQYEIPLVTLDEYDVDIAFDGADEVEETTLFLIKGGGGCHTQEKIVDYNANEFVVLVDESKLVKKLGEKFPIPVEVIPSAYRVVIRALSEMGGEAVIRLGDRKRGPVITDNGNMIIDVFMNIDDAIELEKEINNIPGVVENGIFTKVDKVLVGTKKGVKTLKK

SEQ ID NO: 42695 - protein, 139 aa, Flavobacteria bacterium BBFL7
MATNRTFTMIKPDGVENGHIGAILEKITASGFRIVALKKTQMTKADAESFYAVHNERPFFGELVEFMTRGPIVAAILEKENAVVDFRTLIGATNPADAAEGTIRQLYATSMGENAVHGSDSDENAAIEGAFHFSGREMF

SEQ ID NO: 42696 - protein, 197 aa, Triticum aestivum
  misc_feature (50)..(50): Xaa can be any naturally occurring amino acid
  misc_feature (53)..(53): Xaa can be any naturally occurring amino acid
  misc_feature (62)..(62): Xaa can be any naturally occurring amino acid
  misc_feature (103)..(103): Xaa can be any naturally occurring amino acid
  unsure (1)..(197): unsure at all Xaa locations
MPLNAPVRTKEIILHQQVDESLVFVLLLLIYGKKNRIHQQVSFPDRSDMXPVXLMEQPFSLXRETSMTSIFSMLLTLKFSDGCGCSSSSIECHVNFQKQKESXVRDRSLVLQELKCTAERQSRAGQQSILERESLPRAETSIYAFVTNIIRYDAADLKVADPKGSWMNSGSSTSSNLAKRLVEGASGYSASTKKLKC

SEQ ID NO: 42697 - protein, 297 aa, Symbiobacterium thermophilum IAM 14863
MEILQAIQTIQSPLLDRVLGLITNLHHEAVYILVLPLIYWLYDKRFGRYMFSVFVIGFWSNDFLKEVFRTPRPDPAQVRVILAETGGGYAFPSGHAQTPLVFWGAIADHVRRRWFTWAAGILVFLIGFSRLYIGVHWPLDVIGGWAIGLVVLWLMVRSRRFWTGEGQSLGLQALLAFLLPGAALGLLALLGPVDEIAWMVMGTWSGLLLGSALEEQWVRFDPRAGTPLQHLLKIIVGIVLVLAAKEGLKLVLPDSGVGDMVRYGLVAFTATLVAPWLFARFIARPPAVQLEQKTHHL

SEQ ID NO: 42698 - protein, 214 aa, Medicago truncatula
MNSLQEFESSTNNKDMMNTNPMINITNPSSSMTMTIPSSSTTSASSSSTATTSPPSTTSTTTPSRYENQKRRDWNTFGQYLRNHRPPLSLSRCSGAHVLEFLRYLDQFGKTKVHTLICPFYGHPNPPASCPCPLRQAWGSLDALIGRLRAAFEENGGKPEANPFGARAVRLYLREVRDSQAKARGISYEKKKRKRPPQPPPPPPSNNATITDLH

SEQ ID NO: 42699 - protein, 213 aa, Glycine max
  misc_feature (100)..(100): Xaa can be any naturally occurring amino acid
  misc_feature (208)..(208): Xaa can be any naturally occurring amino acid
  unsure (1)..(213): unsure at all Xaa locations
MDRLLSSPSPPSFTFLTRFESATARFIFTRSHSHLKRVTSICCQHANPSPFTPFLASSNHPNTFPSISSPSVRSTPESHSLNQIKTGAFQKPKANNRLGXLVILSALAMILIQPAIAPAAFATFQTAAKTGGPAAAVGPDHLAALAPLSIGRTRMESAAVGALWGCGHDAGQVLFGLIFLILKDQLHIEIIRTWGTRVVGLTLLIIGXFGIKE

SEQ ID NO: 42700 - protein, 425 aa, Oryza sativa
  misc_feature (292)..(292): Xaa can be any naturally occurring amino acid
  unsure (1)..(425): unsure at all Xaa locations
MGRSKREVAPPPPPSPSQASPGSFASGMMLPGSLGSGAWQGPAPPQPPHPLLYAYGAAASAFPMAQMKQGLDRSAIDLSDLQERGMDFHPPGGFLSYFQDPSILQNHRPFVPPNYYPAEQVAPCSKLRPGAQQPVNIDSGDEEAHTVRTEKRLTWSTEEDIRLVSAWLNNSNDSISGNFKKNDRYWGDVTAEYNSTTPKNRTRQEKQIKDRFHKIKKNVGRFCCVYKEVKFIYVSGQNDMQLREKAEAAYQADYKEGPFSFLHCWNILRDQPKWHSYLEELEKPNKPKMDDXVEVMEQMSTPNSPEDIKRPIGTKTAKAQRNGKGRRKRKAKVYLSDTDDEIDKLKEVQEMANKGRDELLETQRRVASDNLESKKLAHLAAMEHKEAVMLETYRSLMLQDTKDIPDDVRSEHLMALKCMREKLFP

SEQ ID NO: 42701 - protein, 387 aa, Zea mays
  misc_feature (283)..(283): Xaa can be any naturally occurring amino acid
  unsure (1)..(387): unsure at all Xaa locations
MAPAISKPLLTDLVAQIGKVPSSHIRPVGDRPDLANVDNESGAGIPLIDLKKLNGPERRKVVEAIGKACESDGFFMVTNHGIPAAVVEGMLRVAREFFHLPESERLKCYSDDPNKAIRLSTSFNVRTEKVSNWRDFLRLHCYPLQSFVDQWPSNPPSFRQVVGTYATEARALALRLLEAISESLGLERSHMVAAMGRHAQHMAVNYYPPCPQPELTYGLPGHKDPNAITLLLQDGVSGLQVQRGSRWVAVNPVPNALVINIGDQMQVTRMHFQSQLRFLLSSXSGLAEQSRRLLYPMHAWMQALSNDRYKSVLHRVIVNSESERISVPTFYCPSPDAVIAPADALVDDGHPLAYRPFTYQEYYDAFWNMGLQSASCLDRFRPGGSLE

SEQ ID NO: 42702 - protein, 214 aa, Brassica napus
MTSFSAFSEMLGSEYESPVTLGGEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKEIQKAAAEAALAFLAEINNTTTDHGLDMEETIVEAIFTEENNDVFYMDEESMLEMPALLASMAEGMLLPPPSVHFGHNYDFDGDADVSLWSY

SEQ ID NO: 42703 - protein, 571 aa, Ashbya gossypii ATCC 10895
MAQLKWGAGRADDGQDGREVDIEERWHGGAKPDSADGSRRIQIQAVNDEDDTSELITFNQDVSWFIVMLTFVASLSGFLFGYDTGYISSALQSVGTDLGHQLTYRDKEYITSATSLGALIAALGAGICADLFGRRKCIMFSNILFVVGTVLQVAAFNFWQMVVGRLVMGFGIGFGSLISPLFISEIAPKMIRGRLTVINSLWLTGGQLIAYACGAGFQHVKHGWRILVGISMLPAVLQFVSFIFLPDTPRFYVMKGRLEDAANVLERTYVGAERALIDRKIEELVLLNKTIPGRTVFHRVWNTIVAIHTVPANLRALIIACGLQGIQQFCGWNSLMYFSGDIFSLVGFKDPVAVSIVVAATNFIFTLVAFFAIDKIGRRIILLIGLPGMTTAMTVCAIAFHYIKTEVDGEKLKPVGESNAWGIVVVIFIIVYAAFYALGIGTVPWQQSELFPQPVRGVGTSFATATNWAGSMVIASTFLTMFKNITPTATFGFFAGISVISLVAVYLCYPELSGLELEEVQFVLKDGFNIKASKALAKKRKFQMAESRKQARELDLESLHKAKPSDEFTES

SEQ ID NO: 42704 - protein, 380 aa, Gibberella zeae PH-1
MTAFPPPPVNTIDWSNVGFKVREVNGHVESTYSKITGKWTPLRFVADPFMRIHGMAPALNYGQQAYEGLKAFRTPNDEAITVFRPDRNAKRLQHSAEVVSMPPVPEDLFLSAVRAAVALNAEYVPPHDTGAALYIRPQLYGSSAQLGLSPPDEYIFAVFVIPTGVYHGAHPVKALILEDFDRAAPHGTGNAKVGGNYAPVLRWSDKARDEGYGITLHLDSVRHEEIDEFSTSGFIGVKVNGDDVTLSVPDSKNVIDSVTSDSIQELGRSYGWKVEKRAIKYGELKEFSEVFAAGTAAALVPIRSITRRVDGKEDIATYIKEGSEEPGPLFEKLLKHLKDIQLGRAEDSFSWRFPVGVKDKEIQGASTGGNGDATTVDQMD

SEQ ID NO: 42705 - protein, 126 aa, Porphyromonas gingivalis W83
MKKVINTKNAPAAIGPYSQAILMGNMLYASGQLGLDPTTGNFVPGGVTEQTEQVFKNIRAILEEAGLTIANVVKTTCFLADMSDFAAMNAVYEKQFTGDFPARSAVAVKTLPKNGLVEIEIIAIKD

SEQ ID NO: 42706 - protein, 269 aa, Methanococcoides burtonii DSM 6242
MKKIFAVLGDPIEHSLSPIMHNSAFEALDMDCTYHAFRVEKNDLENALQGAKAMGFGGLNLTVPLKETALKFVDADSLAAKIGAINTIDFKDGIKGYNTDGIGAKRTIEDEGVDIKDKNVLILGAGGAARAIAFTFAEAGANVNIANRTPERAMQLAAEIGDAKGYGLDIVDNGLEDIDILINTTTVGLGNSNGTLVTAEQMHSDLAVFDIVYNPLMTKLLQEAETAGARPITGIMMLVYQGAEAFRIWTGKEPPINVMKKTVMETLDI

SEQ ID NO: 42707 - protein, 395 aa, Citrus x paradisi
FGTRSKLSSSSSLSTNILKPLTNSFFLHRPISTDTTPLTIETSVPFTSHQCEAPSRSVETTPKELLSFFRQMATMRRMEIAADSLYKAKLVRGFCHLYDGQEAVAIGMEAGITKKDSIITAYRDHCTFLGRGGTLLEVFSELMGRKDGCSHGKGGSMHFYKKDSRLYGGHGIVGAQIPLGCGLAFAQKYSKDETVTFALYGDGAANQGQLFEALNIAALWDLPAILVCENNHYGMGTAEWRAAKSPSYYKRGDYVPGLKVDGMDALAVKQACKFAKEHALKNGPMILEMDTYRYHGHSMSDPGSTYRTRDEISGVRQERDPIERIRKLILAHDLATEKELKDIEKEVRKEVDEAIAKAKESPMPEPSELFTNVYVKGYGVEVFGADRKEVRSVLP

SEQ ID NO: 42708 - protein, 233 aa, Methanococcoides burtonii DSM 6242
MLKIGTFDLEERPAIVAAISNEPLQQCKTAAEHGADILEIRFDLLGITTSKEAANLLRMLKGTTSLPCIATNRLQSQGGNWEGTEENRIALLEDIMHLTDAVDIELETDEQLRDRIVKKAKEESKTTIISSHDFERTPDKETLKSILDHSHDAGADIAKLAVMPENMQDVLNLLEVTLEVDDVCTISMGKLGKHTRIIAPLYGSKLTYASVSDAVAPGQLKVEDLKKAMEMME

SEQ ID NO: 42709 - protein, 189 aa, Methanococcoides burtonii DSM 6242
MKELKIIVINNYGQFCHLIHRTVRDLDMDTKIVANTTSVEDILDEEPDGIILSGGPSMERVGSCQEYVESIDIPILGICLGHQLIAQTFGGHTGAGKLGGYAAIDVEVIEEDDILKGLGPRTSVWASHADEVTVLPDEFIHLARSDVCEIEAMRHEERPIYGVQWHPEVAHTDKGEELFMNFFKVCEDY

SEQ ID NO: 42710 - protein, 374 aa, Wolinella succinogenes DSM 1740
MEEFDYYEILEIERSASGEEIKKAYRKMAMKYHPDRNEGSSEAEEMFKRVNEAYQVLSDEGKRQLYDRYGKQGLESQGYSGFSGRGFEDVFDDLGSIFDSVFGGGFSSSSRKRSGPKYNLDLAMELDLSFKEAIFGCKKEIKIRYKDACPDCKGTGAKEGKIETCPDCGGRGQVFIRQGFMTFAQTCPKCGGSGERIKEKCPKCNGKGHENKEENLEVSIPEGVDTDNRIRVSRKGHVGKNGERGDLYLVVRVEEDEHFMRHGNDIYLHVPLFFSTVPLGTTLKIPSLRGELELKIPPNTKDKEQFVFKNEGVKDVHSAKKGNLIAQVKIVYPAKINDEQRELLEKLSRSFGVEGTPHEKGFEGVFEKIKGWFS

SEQ ID NO: 42711 - protein, 146 aa, Nicotiana tabacum
MAFINLLILIILTLSSTPITTMSIPETNRRNATTNSYTDVALSARKGAFPPPRKLGEYSTNSTDYNLICKTCKRLSERNTCCFNYSCVDVSTNRFNCGSCGLVCNLGTRCCGGICVDIQKDNGNCGKCSNVCSPGQKCSFGFCDYA

SEQ ID NO: 42712 - protein, 135 aa, Coix lacryma-jobi
MRKQRIVPLVAALLVLLALAVSSTRNAREEESMADDAGMLAGGIKDVPANENDLHLQELARFAVDEHNKKANALLGYEKLVKAKTQVVAGTMYYLTIEVKDGEVKKLYEAKVWEKPWENFKELLEFKPVEEDASA

SEQ ID NO: 42713 - protein, 466 aa, Staphylococcus aureus subsp. aureus Mu50
MTKSVAIIGAGITGLSSAYFLKQQDPNIDVTIFEASNRPGGKIQSYRKDGYMIELGPESYLGRKTIMTELAKDIGLEQDIVTNTTGQSYIFAKNKLYPIPGGSIMGIPTDIKPFVTTKLISPLGKLRAGLDLIKKPIQMQDGDISVGAFFRARLGNEVLENLIEPLMGGIYGTDIDKLSLMSTFPNFKEKEEAFGSLIKGMKDEKNKRLKQRQLYPGAPKGQFKQFKHGLSSFIEALEQDVKNKGVTIRYNTSVDDIITSQKQYKIVYSNQQEDVFDGVLVTTPHQVFLNWFGQDPAFDYFKTMDSTTVATVVLAFDEKDIENTYDGTGFVIARTSDTDITACTWTSKKWPFTTPEGKVLIRAYVGKPGDTVVDDHTDNELVSIVRRDLSQMMTFKGDPEFTIVNRLPKSMPQYHVGHIQQIRQIQAHIKQTYPRLRVTGASFEAVGLPDCITQGKVAAEEVIAEL

SEQ ID NO: 42714 - protein, 89 aa, Brassica napus
  misc_feature (85)..(85): Xaa can be any naturally occurring amino acid
  unsure (1)..(89): unsure at all Xaa locations
MKNGMAECSVCRSRSIKAIARAYDNRKIRVSSKQRALNVFLVVGDCMLVGLQPVLVYMSKVDGKFNFSPISVNFLTEIAKVMFAXVMLL

SEQ ID NO: 42715 - protein, 142 aa, Oryza sativa
TKVLFPMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 42716 - protein, 163 aa, Triticum aestivum
AYLGDTIEQVCTKKQAGTGPEFPGYRRPPPPPVGNDRAGPSDVQSFSDSLKLRLNAVSSKYKESITKSTRGWKERLFSRNSSVSDLGSEVRREVNNGIASVSRMMERLETRGSGRPSYSPTTSTSEVCLTTEPSNERVTESNSNTTTSTSNTSTPCVTMSGSN

SEQ ID NO: 42717 - protein, 943 aa, Ashbya gossypii ATCC 10895
MELPLNEAHDALFSDRVRRFQEFLDSHDAYADEIRAILVHNGLNAERGDGAWDKKSGPAGASLPRRLTVSLDDIREFDRAYWTGLLVQPAYFLPAAERAVTDLAAVLEDTRVARAAGPSSEWRLSFRGAFGAHALSPRTLMATHLNQLVSIEGIVTRTSIVRPKLLRSVHLSKNTGAHYYRDYRDATTTLVTEVPTPAIYPEADPEGNPLNTEYGYSTYMDHQRVTVQEMPEKAPPGQLPRSVDVILDDDLVDKTKPGDRVNIVGVFKSIGAGGMSGGSSSDHGNNGLAGFKTLIIGNTVYPLHARSTGVAASERLSDTDIRNINKLAKSADVFDLLAQSLAPSIYGHEHIKKAVLLMLMGGVEKNLENGSHLRGDINILMVGDPSTAKSQMLRFVLNTAALAIATTGRGSSGVGLTAAVTMDRETGERRLEAGAMVLADRGIVCIDEFDKMSDVDRVAIHEVMEQQTVTIAKAGIHTTLNARCSVIAAANPVFGQYDVNKDPHKNIALPDSLLSRFDLLFVVTDDINDVRDRAISEHVLRTHRYLPPGYMEGEPIREAINLSLSVGTDGVSIDPDADDDTTDKVFEKYDPLLHAGAKLAKNRGDHRGAELPKVVSIPFIRKYVQYAKERIVPVLTQDAVNIIVKTYCDLRNDQNTKKSPITARTLETLIRLSNAHAKVRLSKLVEARDANVAAQLLRFALLGEDLSSTASDSALQHSPRKRQRTRMYTEEEPAPALQQSHSGADADATSSSIVATPIRARNLPRDIDPDASDAEDDGDAVYLPDSITSLTPMTRLPHDEELDLQRRMERGLRVSPRLASRRILSDSENLPAHPPTSAASMRQHLQQAAHSPSRAPDESATVEHIEPGSISPGRLSIISGIIARLMQTDLFEDEHYPIIALLEKVNEELPEEDKFSMEEYLAGLNIMSDRNNLMIAEDKVWRV

SEQ ID NO: 42718 - protein, 266 aa, Arabidopsis thaliana
MENKVEKEITWVIKNFSSLQSATIYSDIFVVGGCRWRCQAFPKGYNKADYLSLYLDTQQWFDKNAPDWGFTEMISLTELHAEEGLLRNGELTVVAKVEVLEVVGKLDVSEESSPVIETIDVNGFQVLPSQVEYAKSLFERHLDIASKFRPKNPYLKTAYMNVLLSLTQTICQSPQELSNDDLSDAGAALAYLREAGFELDWLEKKLNEVKEKKKKEEACLAEIQDMDEHVKPLKKKYLDLEAQIDKKKAELLAARAPLSLNDDNVV

SEQ ID NO: 42719 - protein, 413 aa, Ashbya gossypii ATCC 10895
MNITIHFKDFKKERLPLQLSPSATIAEAKQMLARAKQCDESQLKMIFSGKVLQDGNTLEGCKLKDGDQVIFMISKKKAETRVSEPEPASEPSGGPQSEASTGLETVTTPGVSAAVDPESTGAAVGSGASFVTGSARSQTVERIMEMGYDRAQVEMALRAAFNNPDRAVEYLLTGIPEHLQNSSAFSARQSASVAASGVPETGATAQTGTETETGTGTGTASEVNDEHVHEDDLFAQAAAVGSENPTTGADATTTGTVSQDSSPLQTIGLTFEDLVQLRGVINGDPEALPPLLESLSERYPELREQIMSNPEMFISMLLQAVGGALPSEALDDASAYQADSEAIAEGDGSTASANQDTAADAQNELLSLSEEDLTTIERLCELGFERDLVIQIYVACDKNEEVTANMLFTNYTD

SEQ ID NO: 42720 - protein, 874 aa, Ehrlichia canis str. Jake
MSEKLIYYFSKTKCDGNLTLKHLLGGKGANLAEMCNIGVDVPPGFTLSTNLCNYYYQNNKLPDQVFSLVENAIEFLNNEVNLKFGDKDNPLLLSVRSGSVSSMPGMLDTILNVGLNDETVIGLTKKSGELFAYDSYRRLIQMYAHTVLQVENSLFEEVIYKKKRMYNIPINSQISDPNILKEIIAEFKKIVTFHTNTNFPQNVHKQLYNSIDAVFRSWMNKRAVAYRKIHNIPDNLGTAVNVQSMVFGNMSHNSATGVVFTRNPSTGAQEIFGEFLVNAQGEDVVSGTHSPLPLDKMKELMPQPYNDLEQVCKKLELHYRDMQDIEFTIENGKLWILQARTGKRSIQSSVKIAVDMVKENLISKEEAILRIDHKSFSKLFHPILENNTNINTIARGLPASPGAATGYVVFTPNDAEQFRKDGRNAILVRQETNPEDINGMNSAAGIITLRGGMTSHAAVVARGMGKPCICSATGIFIDKSEEFFYTSTGLKVHKGDSITINGCNGEVILGTIKTVIPKLSESFYTLMQWVDGIRTLKVMANADTPEDTDIAMSFQADGIGLCRTEHMFFSHNRISIVQEMIVSDNKEERIAALEKLEVMQKEDFKKIFKSTLNKQVTIRLLDPPLHEFLPDNNNAISEISARTGKSLEKLKNKILYLSEKNPMLGHRGCRLAISYPEIYEMQVRAIFLAVKELQEETGITCIVPEIMIPLVMAEKEIIIIKELINNIAQQFGNTQYSIGTMIELPKAALIADKIAKHVQFFSFGTNDLTQTTLGVSRDDSANFIGIYQNLEIVKQDPFETLDIEGVGKLISIAVDLGRKSYPNIKIGICGEHGGNFESIQFFSKLNLDYISCSAYRIPTARLIAAQSAIINQNT

SEQ ID NO: 42721 - protein, 520 aa, Symbiobacterium thermophilum IAM 14863
MKVVSGEQMRAIEARLFDQYGFTSAILMELAGRQVALIARRMMQGRSGPIVVVCGKGNNGGDGLVAARWLRHWGFPVSAVVWASLDDLPADAAAALYSARMAGVNILMPAQAYEALQGADLIIDAVLGTGAVGSARGQAAEAIKLINAAKRMVLAVDIPSGIGTNTGRVDGPAVRADVTVTFGLPKLGLFLFPGADLVGRIVVADIGLDEKAIEAENIQVELTRPAMVKSWLPTYSRDAHKGTRGRVYVAAGSHGMVGAGALAAVGALRAGAGLVTVAAPERSQPVLAAMRPECMTMALPESEAGGFRAESAEDFLQRAARADALAVGPGLGTDADAQLFTRRVVAGATAPLVLDADAIKAFAGRPELLAECPMPLVITPHPGEMAHLLGASVESVQADRFAAVRRAAELTKAVVLLKGAYTLIAEPGGQVFINPTGSRILGTAGSGDVLTGIIAGLMAQGMGAPEAAAAGAFLHGLAGDRLARRLGLDGVLAGEIAAEVPAAQQAVREGLPDLIEEFVG

SEQ ID NO: 42722 - protein, 519 aa, Glycine max
MPAVGGISNGGGKEYPGSLTPFVTVTCIVAAMGGLIFGYDIGISGGVTSMDPFLLKFFPSVFRKKNSDKTVNQYCQYDSQTLTMFTSSLYLAALLSSLVASTVTRRFGRKLSMLFGGLLFLVGALINGFAQHVWMLIVGRILLGFGIGFANQSVPLYLSEMAPYKYRGALNIGFQLSITVGILVANVLNYFFAKIHGGWGWRLSLGGAMVPALIITIGSLVLPDTPNSMIERGDREKAKAQLRRVRGIDDVEEEFNDLVAASESSRKVEHPWRNLLQRKYRPHLTMAVLIPFFQQLTGINVIMFYAPVLFSSIGFKDDSALMSAVITGVVNVVATCVSIYGVDKWGRRALFLEGGVQMVICQAVVAAAIGAKFGIDGNPGDLPKWYAVVVVLFICIYVSAFAWSWGPLGWLVPSEIFPLEIRSAAQSINVSVNMFFTFLIAQVFLTMLCHMKFGLFIFFAFFVLIMTFFIYFFLPETKGIPIEEMNQVWKAHPFWSRFVENDDYGNGVEMGRGTAIKEV

SEQ ID NO: 42723 - protein, 928 aa, Neurospora crassa
MATLSVYGSDFLTTTKKKAIEDAKKMQTVVAEECNKSGKEAPPYQLEELIGKGSFGRVYKATDNKSNAVVAVKIIDIEESDRENPRLADTYSEFMKETSALKLLSNSGAKNINLILDVLPVGQSMWLITEYCAGGSVATLMKPTAPGGLQEKWIIPILREVAEAIFWVHKEGIIHRDIKCANVLVTETGAVQLCDFGVAGIVETKFDKRSTFIGTPHWMAPELFEPTPSYSTPVDIWAFGSMVYEIASGLPPNVMSGFNIPQLGNYIKSHAPRLEGDQYSDNLKDLVAFCLVEDPAKRPTIEQVQRHPYIFNTSSEYPTASLSNLVRGYKVWEAQGGIRKSLFAPVGAQGPSDYASTALSNDEWNFSTTVDFDRMAMDSDAQAVYDVYGHNVDFDFDEEQTRRPKPKGRRRPPPPKLLALKAPLEKLFDPNTISGYNENSRAYYGLGPTSTSEAASAPEPPKDSDLNLRQYEPSSQAALRESLIDLDASFDGNDLSQFVDMETIKAGPRGSIDYAAFNPNPDFSKPPLSDPADMPMNINRRTQDWKFPSMAAPPASAHPEMSRFPWNEERSNDSHNDNFVRPPLIHHPTDPLGFQSTGYDSMPPKPPVDNRVSVGSLIDLDESLPMPTNDFTNREYTRPSTANSDAASVSGSEIGGANPFDLERHASLYQPLPVVRSSSVREPSIYVSDDSDYARVAQAPSEEHFIGTNGRGTPDYASSVNGGGSIGNGSIGGGSIGGGSIGSRTSSRAHSRADSYSYATDDDVGGYSAGEYAESEYLGGSMDPMAMSGEGRNRSRRRPSGMRPDPDSHHPPRGYGMGGSMNGNNGTGSHGGGHHGHQVHHGHGHGQYHGHGHGHSNSQGSTDMMHMPHVPEPPRVRVMQGMANREEVRDDVMRLLASFSEHLGFANAHVNTLPVRQGRRGSEVDTSV

SEQ ID NO: 42724 - protein, 433 aa, Rickettsiella grylli
MLLGSIFSQELLVNFTEFNFNTQILSGIQTQGYRTATPIQIKAIPAILQGRDVVGLAQTGTGKTAAYALPLLQQLTEGPPGQLRALILSPTRDLADQICVAMNHFGRQTHLRCATIYGGKINYTRQYQLLTGGVDIIVACPGRLLDLLQGKKNNFLQQVKHLVLDEADHLFDHGFRDAIYHILKHLPPRRQNLLFSATMSADIRLLIDKVLHRPVRIQIGEPKPAVTITQTLFPVSETLKVNLLETILQNHSIHSAIIFTRTKHRAQCLAEHLRDLGYKATSFQGNLSQSRRKTALGKFRQGELKFLVATDVAARGIDIDHLSHVINFDMPNTAIEYTHRIGRTGRADKLGMAFSLITKNDRRKIQSIEHLQKKRLEECIIAEFDYHAKINPSMEPLNAYRRKPLSYPHSPSTSRKKIASPRHSTLRSKKKNS

SEQ ID NO: 42725 - protein, 774 aa, Oryza sativa
MSQASLSPSSSGDEEEEDEGVEGYRKGGYHAVRPGDQFAAGRYVAQRKLGWGNFSTVWLAFDVHTQMLDKFFWLVMAGSFKCCDKKFVALKIQKSAPEFAQAAFHEIEFLSEITKRDPSNCKCIIQLIDHFKHAGPNGQHICLVFEFLGDSLLKLVQYNRYNGIGFGPVREICRSILIGLDYLHRELGIIHSDLKLENILLISTIDPSKDPIRSGLKPNLERPEGNPNGEVMLNPIEKKLKMRARRVLAKLAEKKKSAAEYARAERSLDGIDMTCKIVDFGNACWADKQFTDFIQTRQYRAPEVILGSGYSFPVDMWSFACIAFELATGEMLFTPKEGQGYSEDEDHLALMMEILGKIPKKIATMGTKSKEYFDRHGDLKRIRRLKFSSIERVLVDKYKISESDAREFAEFLCPLFDFAPEKRPTAAQCLQHKWLQYSDGKNYGTLNISDVKNASVTCSPGTTASSDSKSIDVTRNIGDKPDSYAERADAKCNTSKKSIINSNSENSNVQPNTASVGNRNSKIDDVNSNTGSITNKDSKNTVIKPSIGSFVNRNAETVDVKPNIGSITSRGDSSSDTKSNIGSVASKDAKTIDAKPSTSSITSQDSKIGDGRSNIDGIANRDAKTADVKHNIRSVVNTYLRNFDVKHNTGNIVDGGVKHSDLKPGTVSAANVDSKSISAKPSTGSFENSDAKSISAKTSTGSFDNSDARNIMKANTGIVANNDIKDTDVQTNTESVTSGDDLNDIDRKPNIGRVAASIQRLESSIGKVQSGKYR

SEQ ID NO: 42726 - protein, 291 aa, Rickettsiella grylli
MNFIDDSQRIKVGLAEMLKGGVIMDVTTVEQAKIAESAGACAVMALERVPADIRKMGGIARMASPQIIYDIMQAVSIPVMAKVRIGHFVEAQLLQALNVDFIDESEVLSIADEECFIDKHRFEVPFVCGCRNLSEALRRIAEGAAMIRTKGEAGSGNILEAVKHMRAITREINALTVLKQEELYTQAKNLNAPLELVRWVAQHAKLPVPQFSAGGVATPADAALLRQLGAESVFVGSGIFKSADPEKRACAIVQATTHFNNPEIVLHVSQDLAEGMSGFRLKAEETLTMAD

SEQ ID NO: 42727 - protein, 403 aa, Bacillus cereus ATCC 14579
MVKTPKIVVLGAGYGGMITTVRLQKALSVNEAEITLVNNNSYHYQATWLHESAAGTLQDEKICLDIQDVIDTNKVNFVQDTVVEIKAAEKRIILKDGELEYDYLVIGLGFESETFGITGLKEHAFSIANINATREIREHMEASFSKYATEQRDELVTIVVGGAGFTGIEYVGELANRVPELCKEYNVPREKARIICVEAAPTALPGFDPALVEYAVKQLEKKGVEFRIGTAIKEATEEGIIVANGDDTELIKSETVVWAAGVRGNGIVEESGFEAMRGRVKVDEYMHAPGYEDVFMVGDAALIINEEINRPYPPTAQIAIQQGYNIAHNLTVLVRGKGEMKKFAFDNKGSVCSLGHDDAMGVVMGKKLTGWKASFMKKVIDNRYLFLLGGPLLVLKKGKLKFF

SEQ ID NO: 42728 - protein, 467 aa, Hyphomonas neptunium ATCC 15444
MAETYDVVIIGGGPGGYNCAIRAGQLGLKVACIEMRGKLGGTCLNVGCIPSKALLHTSHLFSAAQNEFATLGIKTGKVELDLAQMMGQKDEAVEGLTKGVEFLLKKNKAEYIKGKGKILGKGKVEVALADGGTRVLETKNIVIATGSEPATLPGIEIDEERVVSNTGALSLKAVPKKLVLIGAGVIGLEMGSVWARLGSEVTVVEYLDRILPPADAEVAKEAERTFKKQGLAFKLGTKVTGIEKTKTKLKVAVEPAKGGAAETLDADIVIVAIGRKPYTEGLGLEAVGGKTDKRGVIEVTDHFKVADGVWAVGDCIPGPMLAHKAEDDGTAVAELIAGKAGHVNYDLVPSVVYTNPEIAWVGKNEEELKAAGVEYVKGKFPFMANSRARTNHETVGFVKILAEKGTDKILGAHMIGVGVGEMIAEVCVAMEFGASSEDIARTSHAHPTLSEAVRQAAMGVEGWTMQM

SEQ ID NO: 42729 - protein, 234 aa, Lactuca sativa
MDHAADAFRTDLMTITRFVLNEQSKHPESRGDFSILLSHIVLGCKFVCSAVNKAGLAKLIGLAGETNVQGEEQKKLDVLSNEVFVKALVSSGRTCILVSEEDEDAIIVEPSKRGRYCVVFDPLDGSSNIDCGVSIGTIFGIYMIKDGDEAILEDVLQPGKNMVAAGYCMYGSSCTLVLSTGSGVNGFTLDPSLGEFILTHADIKIPKKGKIYSVNEGNAKNWDGPTAKFVEKCK

SEQ ID NO: 42730 - protein, 240 aa, Ashbya gossypii ATCC 10895
MSRNVDKANSVLARYQELVAENTSGYKDYSRFKRPTAVHRISNLEEAQRWRAEVVKDIGNKVTQIHDPSLNEMQIEDINNELNRLFQEKMRWESHIRRNLRGPDYRRMKQGLNTTGGTVINGTRYFGRALELPHVQELLQQQQQQRVKQQNQKQREQELRAKVRQWEEELGPDYYGEDVPPGMQEYEAQRSRELQDILRSAAGRAPQVQIPLFERLPTQEEVEGWLVERRRKRLQERLDL

SEQ ID NO: 42731 - protein, 323 aa, Gibberella zeae PH-1
MSVQQITSSPTGDSLQTSQVSQLERHGYLFGKKLTASLSPFLHDVIYKALGYNWGQVRLDSADIDGFLQLAQHPDFYGASVTMPNKVAIIPYLDELTEECRDVGACNTLYLRERDGRRIFCGANTDVIGIRDSFYQNIESPDVVFHNKPALVVGGGGAARSAIYALRKKMQATTIYLVNRDEAEVEAVIADCVSRGYGEGLLHVKTVAQASSLEAPGAIVACVPDFEPVTEEEIMARAVTEAFLDKPQKGAILEMCYNPTPFTKLGAIAEDKGWKVILGTEALIYQGLEQDKYWTGKTLEEMPIEKVHIAIAEKVAQRAEAKL

SEQ ID NO: 42732 - protein, 174 aa, Vibrio parahaemolyticus RIMD 2210633
MAGSSVIVMGVCASGKSTIGEHLAKKLGRKFIDGDDLHPRANIQKMASGQPLNDDDRKPWLERIRDAAYSLESKNEHGIIVCSALKKIYRDQIREGNDNVTFLFLDGDMELILNRMRMRKGHFMKENMVKSQFETLERPDNEPQTLIISIDGDISDVVERSAAELIKMQAIEVA

SEQ ID NO: 42733 - protein, 161 aa, Hordeum vulgare subsp. vulgare
MADVEYRCFVGGLRWATDDQSLQNAFSKYGDVIDSKIITDRETGRSRGFGFVTFASDEAMRQAIEAMNGQDLDGRNITVNEAQSRRSDGGGGFGGGGGGYGGQRREGGGGGYGGGGGGYGGGRSGGGGGYGSRDGGGGGYGGGGGGYGGSRGGSGGGNWRE

SEQ ID NO: 42734 - protein, 785 aa, Oryza sativa (indica cultivar-group)
MSRSHLISCPRFRVSQRTADADGRVDGGQHMNPNDEAGERMHPCVQVQRTYNGFGSGYLLKLSLLGFVAAPLCRGASVQDVLCRLMIAAVTSLSHPSTASSAKFDGRRSEERRKKGLIVAAASSALTSIPLSLLAMSRNLESPVQTQMAVSALNRALSSEYPSKSRSEGRASGWKRIFVQTDTGCVLAVQLDRGDNAHTVKRKLQLALNVPTEESSLTFGDRVLKNDLSTIRNDSPLLLTKTFMHRSSSTPCLSPTGKDIQQQRDRGGPIELLVCPSRCSRTKQLVKDVARAIRNGVDPIPVNSGLGGAYYFRNSKGENAAIVKPNDEEPFAPNNPKGFTGKALGQPGLKRSVRVGETGFREVAAYLLDYDNSANVPPTVLVKISHPVFNVNECVSSANMKASKDYPGAVSKIASFQQFIPHDFDASDHGTSSFPVSAVHRIGILDIRIFNTDRHAGNLLVRKLTGPGKFGNQTELIPIDHGLCLPECLEDPYFEWIHWPQASIPFSDDELDYIANLDPMKDADMLRMELPMIREACLRVLILSTIFLKEATSFGLCLAEIGEMMSREFTGMEDQPSELEVVCMEARRLAIEREESSTEIDSGDEDATQFELDCEDDHEMLKAQPAYHFELKGGSSRNPLSKLDEAIEEEEDDIEEEESNAEKLGYPKAINKWLPNISKLSTSLNGVRLGDKIQCQLPAAPKIMDPVKIFEGNSNHSGSQVGNWRSANEQLPTSASFVKLADMGSETWALFLEKFQELLPEAFRSRKCGAAGQRARQRLGTSCQF

SEQ ID NO: 42735 - protein, 545 aa, Gibberella zeae PH-1
MGILTLKEDRPTPKAVYNWRVYACAAIASMAACTIGYDSAFIGTTLALPSFVQEFNFESYDPAALALTKQNIVSVYQAGAFFGSLFAYVSSYFLGRRWSLIIFSAVFMVGAGMMLGANGDRGLGLIIGGRVLAGIGVGGCSNMTPIYISELAPPAIRGRLVGLYELGWQAGGLVGFWINYGINQHLPYSPGQNENVWLIPFAVQLIPAGLLMVGAVFIPESPRWLFSKGKREQAIKNLCWMRNLSQDDVYIVEEINFIDAEIDRYHSAVGAGFWKPFAALKNRKVQWRFLLGGLLFVFQNGSGINAINYYSPTVFKSIGITGTNTSFLTTGIFGVVKTTLTFVWLMVLIDHMGRRNLLMIGAAGGAFSMYFIGAYIKIANTEAKLASGQDVSLSSGGIAAVFFFYLYTAFYTPSWNGTPWVLNSEMFDQNTRSLGQANAAANNWFWNFIIARFTEQMFRAWGFGVYIFFASLMILSIFFVFFCIPETKGVPLEAMDKLFATKPIWKANKIVMEDLRLQEEEFRHNADGVDMREEKAKAEQIEGAA

SEQ ID NO: 42736 - protein, 268 aa, Synechocystis sp. PCC 6803
MSPFESMEKFPHLLVLDFDGVLCDGLQEYFQTSCQVCRQIWPDLPREKLDRQRDNFYFLRPVIETGWEMPLLLKALATGVEPAAIEAAWPAVAQTLQRQEQIGKSQLAPVLDQVRDNYIHNDLAYWLGLHHFYPGVIGQLNHWLQSPYPQWLYVVTTKEGRFVQQLLKNQKVDFPLGQIIGKEIKQPKFKTLEQLRVKHQCDGDRLWFVEDMLTTLETVANQPALEQTSLFLADWGYNTPDSRGLAKQKKRFHLLSLQQFSAPFSEWF

SEQ ID NO: 42737 - protein, 469 aa, Xanthomonas axonopodis pv. citri str. 306
MSVENVEKLIKDNKVEFVDLRFVDMRGVQQHITFPVNIIEPALFEEGKMFDGSSIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGEKYDGGNSGYRPGVKGGYFPVPPTDSLHDLRAEMIKTLEQVGIETEVHHHEVATAGQCEIGTKFSSLVQKADELLTMKYIIKNVAYRNGKTATFMPKPIVGDNGSGMHVHQSLAKGGVNLFTGDGYGGLSQLALWYIGGIFKHARAINAFANSGTNSYKRLVPGFEAPVMLAYSARNRSASCRIPWVTNPKARRIEMRFPDPLQSGYLTFTALMMAGLDGIKNQIDPGAPSDKDLYDLPPEEEKLIPQVCSSLDQALEALDKDREFLKAGGVMSDDFIDGYIALKMQEVTKFRAATHPLEYQLYYGN

SEQ ID NO: 42738 - protein, 246 aa, Gibberella zeae PH-1
MSGLWAQVVTQYGTFKVEIIGSLAIQVLFWWVPSAGFVLLDRLAPSFAAKHKIQPAPKQPTSSEIFDAVLISFRNQLIITGLQVTPAILSTRSSAFQITPSLPSTKDFILHFLICLIAREILFYYAHRLLHLPYLYRRIHKIHHKFTAPVSFASQYAHPVEHIVANTIPIVLPPVLLQTHILTMWAFVSWQLIETATVHSGYDFFGGAAYRHDRHHERFNVHFGGMPWLDRLHGTDEIEGLVKKHN

SEQ ID NO: 42739 - protein, 445 aa, Arabidopsis thaliana
MGKKAKWFSSVKKAFSPDSKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWVPRKNKSNSNNDNAASVKGSINRNEAAKSLTRNGSTQPNTPSSARGTPRNKNSFFSPPTPSRLNQSSRKSNDDDSKSTISVLSERNRRHSIAGSSVRDDESLAGSPALPSYMVPTKSARARLKPQSPLGGTTQENEGFTDKASAKKRLSYPTSPALPKPRRFSAPPKVESGGVTVTNGAGS

SEQ ID NO: 42740 - protein, 174 aa, Oryza sativa (japonica cultivar-group)
MAKQGVKKTRDANKKRMDLILRLILAANVIYIVVRMAVMHSSFTWKHWIGLAVTSAAYFLPYKQLANMSEPEYSENGELINAGYDLNAGGMSEYLQDVIYITLFVQLMSIFSDKFWWTYLVIPAYGGYKISGLLRGAFFGGSSEGEEEDEKTRKKREKMEKKASRGKIIKTRTR

SEQ ID NO: 42741 - protein, 300 aa, Arabidopsis thaliana
MARNEEKAQSMLNRFITQKESEKKKPKERRPYLASECRDLAEADKWRQQILREIGSKVAEIQNEGLGEHRLRDLNDEINKLLRERYHWERRIVELGGHNYSKHSAKMTDLEGNIIDVPNPSGRGPGYRYFGAAKKLPGVRELFEKPPELRKRKTRYDIYKRIDASYYGYRDDEDGILEKLERKSEGGMRKRSVEEWRRLDEVRKEARKGASEVVSVGAAAAAAREVLFEEEEDVVEEERMEREKEEEKEREFVVHVPLPDEKEIEKMVLEKKKMDLLSKYASEDLVEQQTEAKSMLNIHR

SEQ ID NO: 42742 - protein, 252 aa, Photobacterium profundum SS9
MVNFLLSEELTSNIAASVCWGNKMRAICFDFDGTLVDSEVFHAENWSGFLKTLDIDFSMGAFLEQYAGVTWDKVAIDLFTRFSISMPIEHMLQQMEAITEKALILDNIPAKSGVSTLLHELSGKVPLAVVTGAPRIYVEGILQRHGWLELFDHVFCGEDVASNKPAPDIYQLACATLGFNPHEVLAIEDSVTGIKSSLSAGLKTVLVNDTDIMHPSKYSVEYGQLALDYSFDSMNQAHPTVLNLATGSIRHT

SEQ ID NO: 42743 - protein, 175 aa, Glycine max
  misc_feature (112)..(112): Xaa can be any naturally occurring amino acid
  misc_feature (122)..(122): Xaa can be any naturally occurring amino acid
  misc_feature (125)..(126): Xaa can be any naturally occurring amino acid
  unsure (1)..(175): unsure at all Xaa locations
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLKFELKHSFVYQEHNXSPKYYDRHYXTIXXLAMFRYTNTSQVWKELQETKTTYANNFMHIIKFYNIRQIHYINFIGYEP

SEQ ID NO: 42744 - protein, 181 aa, Lactuca sativa
MASISSSAVATVNRSTPAQASLAAPFTGLKSNVAFPVTKKANNDFSSLPSNGGRVQCMKVWPPIGLKKYETLSYLPPLSDEALSKEIDYLIRNKWVPCLEFELEHGFVYREHHHSPGYYDGRYWTMWKLPMFGCTDSAQVMKEVGECKKEYPNAFIRVIGFDSVRQVQCISFIVSKPPGVL

SEQ ID NO: 42745 - protein, 339 aa, Photobacterium profundum SS9
MNKGKNMTIKVGINGFGRIGRLALRAAFDWEELEFVQINDVAGDAKTLGHLLEFDSIQGRWNHAVTVEGDQLLIGDASITCTQERDIDAVDWSGCDVVLEATGVHRKTSLLQKYLDQGVKRVVVSAPVKEEGVLNVVVGVNDHLFDPERHHIVTASSCTTNCIAPIVKVIHEKIGIDQASFTTIHNLTNTQTILDAPHKDLRRARSCGSSLIPTTTGSATAIVEIFPELKGKINGHAVRVPLANASLTDIIFDVSRNTTAEEINALLKEASETEMIGVLGFEDRPLVSIDYKGDQRSTIVDALSTMVVNHRMVKIYAWYDNEMGYATRTSELIRQVGSA

SEQ ID NO: 42746 - protein, 144 aa, Zea mays
  misc_feature (35)..(35): Xaa can be any naturally occurring amino acid
  misc_feature (72)..(72): Xaa can be any naturally occurring amino acid
  misc_feature (91)..(91): Xaa can be any naturally occurring amino acid
  misc_feature (101)..(101): Xaa can be any naturally occurring amino acid
  misc_feature (123)..(123): Xaa can be any naturally occurring amino acid
  unsure (1)..(144): unsure at all Xaa locations
MVSLAAVSVKPGGMKGLVGSSIAGRKLGGARAAAXSIRRPRESAAQTKYRDKSGYFDLHDIGNTTEQWDLYXGSDTSSPYNPTELVLRDAXLDPFTKRGLXLKILLLVADSLLAYVSDVSSPXDLLPIWKGPQEPPHPSQREKI

SEQ ID NO: 42747 - protein, 483 aa, Cupriavidus necator
MELQHTALLRTHCLIDGEWTGAQSGAELAVCNPATGERIGSVPLAGAAEAEQAVRAAERALPAWRAQTGKAVPPVLRRWADLMLAHQEDLARLMTAEQGKPLPDARGEVAYAASFLEWFGEEAKRVDGEVLASPRSSQKMLVLREPVGVCAAITPWNFPAAMITRKVGPALAAGCTIIVKPAEQTPLTALALAVLGEQAGVPRGVLQVVTGDAVQIGGVLCASPVVRKLSFTGSTAIGKLLMAQCAGTVKKLSLELGGNAPLIIFDDADMDSAVEGIIASKFRNTRQTCVCANRIYVHDRVYDEVARRLVSAVEQLLPGHGVDSGVTQGPLIDADAVAKVEAHIADALAQGATVLTGGQRHALGGTFFAPTVLANATASMRVAREETFGPLAPLFRFTSEAEVVAMANDTESGLAAYFFSRDMAKIWRVAQGLEYGMVGINTGLISNEVAPFGGVKQSGLGREGSRHGIDEYLETKYLCMEVE

SEQ ID NO: 42748 - protein, 627 aa, Cytophaga hutchinsonii ATCC 33406
MENRIYIVMGVSGCGKTTIGTLLAETLGINFYDGDAFHPISNIEKMAAGIPLTDEDRYNWLLDINKQAKESLSEGHSVVFACSALKESYRKLLAQQIEDTIVWIYLKGDLDTIHLRVKNRTGHFMSPALLQSQFNILEEPSSAMHIDTALDTDTIIHTIVKKLTKSAFGLVGLGVMGKSLARNFAANGVALSLYNRFVKGSEEQVAEKCIAEYPELQSAKGFEDLKTFAASLEQPRKIFLMIKAGEETDTFIEELVPYLNAGDVLIDGGNSYYGDTKRRIEFLARKGIYFIGTGVSGGEQGALKGPSIMPSGDPDAYALVEKYLTLIAAKDKQGESCCTYIGKDGSGHFVKMIHNGIEYAEMQLIAEVYAYLRYAIKIEPTEIAALFTEWNSGELNSYLLGITAALLIKKEGDAWLIDLILDKAGNKGTGNWATIAASELGQPATLITSALFARYVSTIKEHILVNTQPASVYHFNTAALSEIKDAYMLARIVNHQQGFMLIHEASQKYGWDLNFAEIARIWTNGCIIRSAFMEELIPALKKDSNIFTHPAILKQLKDLKPALKAFAVNALQYDLSVPSHLAALDYLNVLSGNYATANIIQAQRDFFGAHTYQKIGDSSGKYYHTEW

SEQ ID NO: 42749 - protein, 455 aa, Vibrio parahaemolyticus RIMD 2210633
MEKVMATHFDYICIGGGSGGIASANRAAMYGAKVALIEAQDLGGTCVNVGCVPKKVMWHGAQIAEAMNLYAEDYGFDVDVKGFDWSKLVESRQAYIGRIHQSYDRVLGNNKVNVIKGFAKFVDEKTVEVNGEHYTADHILIAVGGRPTIPNIPGAEYGIDSNGFFDLAEQPKRVAVVGAGYIAVEIAGVLHALGTETHLFVRKESPLRSFDPMIIDTLVEVMEAEGPTLHTHSVPKEVVKEADGSLTLHLENGESQNVDQLIWAIGRHPATDAINLASTGVATNEKGYIKVDEYQETNVKGIYCVGDIMEGGIELTPVAVKAGRQLSERLFNNKPNAKMDYDLVPTVVFSHPPIGTIGLTTQEAEEKYGKDNIKVYTSGFTAMYTAVTKHRQPCKMKLVCAGEEETVVGLHGIGFTVDEMIQGFGVAMKMGATKADFDSVVAIHPTGSEEFVTMR

SEQ ID NO: 42750 - protein, 589 aa, Ostreococcus tauri
AMTLSAIARFGAMRLAPAGASRLNTRARTASSTSGRAVHARQYVQAAIADEVEEEARVTAATPGKKRVVVLGSGWGAISFVKSLEQSAPYDVTLVSPRNYFLYTPWLPGPPTGAVEDRSIVESIRRPIASKGYRYFEANALSVDPVRKTVRCRGSDHTFQDEDDLAKSQAWKEFDLEYDYLVTAVGAVPNTFGVPGVQEHCMFFKEIEHAARFRREVNERFECATLPGVPRERIQQLLKFVVIGAGPTGVELAAELYDYVYQDVAKTFPSRLLKDVSIEIIDLQEKILSTYDRRIAEYATEFFQRANIKCILGAAVKEVKDGAVVIADKDGSNQREVPFGIAVWCTGIKLNPFCEKLMDSLPEGAQENKRSLATDKNLRVKGSNGTIFALGDCATIERPRSLAKAEDLYREAARCTPDGDCEIDLSKEGVKKALRLGFDEFPHLEEICARIDEEFPKFTQGSDRMMYPEFRNMLEEVDKGLRALPATAQVAKQQGQYLASFFNESAADDERLQRGVARFDYVHKGSLAYVGKDAAVADIPGFGILKGIAAGLIWKSFETISQVSPRNVLLVAADMLRTKIFGRDISRLS

SEQ ID NO: 42751 - protein, 454 aa, Bradyrhizobium japonicum USDA 110
MPLLSRQQRSAAVTLHQIPNTIKTDSFWMPFTANRQFKKAPRLFSSAEGMHYTTVDGRKVIDGSAGLWCVNAGHGRKQIAAAVERQLMTLDFAPTFQMGHPLAFDFAERLAEIAPKGLDRIFFTNSGSESVDTALKIALAYHRATGQSSRTRLIGRERGYHGVGFGGTSVGGMVANRRAFATLLPGVDHIRHTHDLSRNAFAKDQPEHGAELADDLERLVGLHGAETIAAVIVEPVPGSTAVLPPPKGYLQRLREICDKHGILLIFDEVITGFGRLGTPFAANFFGVTPDLMTTAKGITNGTIPCGAVFASRKVHDGMMVGPENQMELFHGYTYSAHPTACAAGIATLDIYKDEGLLTRGASIAEYWRDALHSLKGLPNVVDIRNCGLMGAVELAPRAGVVGARGYDVMVDCFNTGLYLRMSGDSFAMSPPLIVEKSHIDQMVSILGDAIKKVA

SEQ ID NO: 42752 - protein, 464 aa, Bartonella quintana str. Toulouse
MVSSELKRGMSKRQVIFLALGSAIGTGLFYGSAQAIKLAGPSVLIAYCVAGLAIFMVMRALGEMIIHNPLPGSFARYAANYISPLAGFLTGWTYVFEMVLVGLADITAFATYMGFWYPDVAPWIWALSITLIITGINLAAVEVYGELEFWLSSIKIIAIIAIIVLGIAIIFCGWSISTVSSTVSIHNLWKNGGIFPHGWFGFLACFSVVIFAFGGIEIIGMAVMEVQDPTQTVSKAINSTPIRILLFYIMTLTILMSLYPWNEIGFMESPFVSIFERLGISSAAHILNIVVVTAAISAMNSGMYGAGRMIYGLSQEGYASKKFQYLSKNGIPIFVILLIFAIFLFGVVLNYFYHDRLFFLIAAMATFATVFVWMMILLSQVFMRLKMPKEVQCSLKFPIPFWPIGSIFSVLFIVFIFVLLWFFDDTRPVLIVGVSWISWLVICFYALQFYNSKKNKMHPYTNKD

SEQ ID NO: 42753 - protein, 162 aa, Prochlorococcus marinus str. MIT 9211
MSRLGQTIRGALLMDFWGAFGLGLRYFFRKKATLNYPFEKGPLSPRFRGQHALRRYANGEERCIACKLCEAICPAQAITIEAEPREDGSRRTTRYDIDMTKCIYCGYCQEACPVDAIVEGPNFEFAAETREELFYDKAKLLENGDRWEREIAKNLELDAPYR

SEQ ID NO: 42754 - protein, 374 aa, Tripterygium regelii
ALSIAGAVQSQKLAVLAISQLQSLQGGDIKLLCDTVVESVRDLTGYDRVMVYKFHEDEHGEVVAESKRPDLEPYIGLHYPATDIPQASRFLFKQNRVRTIVDCHALPVRVIQDDGLMQPLCLVGSTLRAPHGCHAQYMKNMGSMASLAMAVVINGNDEEVIGERNTTRLWALVVCHHTSARCIPFPFRYACEFLMQAFGLQLNMELQLAAQLMEKHVLKTRTLLCDMLLRDPPTGIVTQSPSIMDLVKCDGAALHYQGNYYPLGVTPTEAQIKDIVGWLLDFHGDSTGLSTDSLADAGYPEAALLGDAVCGMAVAYITNRDFLFWFRSHTAKEIKWGGAKHHPEDKDDGQRMHPRSSFKAFLEVVKSRSLPWEN

SEQ ID NO: 42755 - protein, 155 aa, Synechocystis sp. PCC 6803
MSRTVGEVMTPNPITVKPDTPLQDAIRLLAENRISGMPVLDDQEKLVGVISDTDLMWQESGVDTPPYVMLLDSIIYLQNPARHERELHKALGQTVGEVMNDVPISILPTQTLREAAHLMNEKKIRRLPVLNVESRQLIGILTQGDIIRAMARGEA

SEQ ID NO: 42756 - protein, 427 aa, Pasteurella multocida subsp. multocida str. Pm70
MTTSLSLFQRAQHRIPGGVNSPVRAFKGVGGTPIFIEKAQGAYLYDTEGNQYIDYVGSWGPMILGHNHPTILDAVISTAQNGLSFGAPTALEIELAELVCSLVPSIDMVRMVSSGTEATMSAIRLARGYTKRDKIIKFEGCYHGHADSLLVKAGSGALTLGQPSSPGVPADFAKHTLTCTYNDLDSVKHAFEQYPNEIACLIVEPVAGNMNCIPPQEGFLQGLRALCDQYGAVFIIDEVMTGFRVALGGAQTYYGVTPDLTCLGKVIGGGMPVGAFGGKKAIMQHIAPLGPVYQAGTLSGNPIAMAAGLACLTELKKAGNAQRLAQQTEKLALGLKALADKHHVPFVVNYVGGMFGIFFTEQKTVSSYQAVMACDTEKFNRFFHAMLAQGIYLAPSAFEAGFMSLAHSDQDIERTLQAADQVFSQLA

SEQ ID NO: 42757 - protein, 371 aa, Tripterygium regelii
ALSIAGAVQSQKLAVLAISQLQSLQGGDIKLLCDTVVESVRDLTGYDRVMVYKFHEDEHGEVVAESKRPDLEPYIGLHYPATDIPQASRFLFKQNRVRTIVDCHALPVRVIQDDGLMQPLCLVGSTLRAPHGCHAQYMENMGSMASLAMAVVINGNDEKVIGGRNTTRLWGLVVCHHTSARCIPFPLRYACEFLMQAFGLQLNMELQLAAQLMEKHVLKTRTLLCDMLLRDSPTGIVTQSPSIMDLVKCDGAALHYQGNYYPLGVTPTEAQIKDIVGWLLDFHGDSTGLSTDSLADAGYPEAALLGDAVCGMAVAYITNRDFLFWFRSHTAKEIKWGGAKHHPEDKDDGQRMHPRSSFKAFLEVVKSRSLP

SEQ ID NO: 42758 - protein, 382 aa, Gibberella zeae PH-1
MSQIKTFRILVLPGDHVGPEIMTEALKVLDVIEASRPDIHFERDVDICGGCSIDKYGTPITESVLEKAVASDAVLFGSIGGPEWAGAEPTPESGLLRLRQRLDAFANLRPCEILVPSLVSASPIKPELVAGTKFIVVRENCGGAYFGKKEESEDEASDLWIYSRSEVERLARVSAAVARILHAGSEKANNGSKPVVWSADKANVLASGRLWRRATTNIFNRELTDIDLKHQLADSLAMLMVLDPKRFNNSVIHTDNTFGDVLSDISGGITGTLGVLPSASLAGVPGEGSCKGIYEPVHGSAPDISGKNLANPVAQILSLAMMLRYSFLLEKEADAIEQAVAKVLDTKDGGGLEIRTKDLGGSAMCSEVGDAVCKVLGDMLET

SEQ ID NO: 42759 - protein, 374 aa, Tripterygium regelii
ALSIAGAVQSQKLAVLAISQLQSLQGGDIKLLCDTVVESVRDLTGYDRVMVYKFHEDEHGEVVAESKRPDLEPYIELHYPATDIPQASRFLFKQNRVRTIVDCHALPVRVIQDDGLMQPLCLVGSTLRAPHGCHAQYMENMGSMASLAMAVVINGNDEEVIGGRNTTRLWGLVVCHHTSARCIPFPLRYACEFLMQAFGLQLNMELQLAAQLMEKHVLKTRTLLCDMLLRDSPTGIVTQSPSIMDLVKCDGAALHYQGNYYPLGVTPTEAQIKDIVGWLLDFHGDSTGLSTDSLADAGYPEAALLGDAVCGMAVAYITNRDFLFWFRSHTAKEIKWGGAKHHPGDKDDGQRMHPRSSFKAFLEVVKSRSLPWEN

SEQ ID NO: 42760 - protein, 499 aa, Gibberella zeae PH-1
MANPFQRPFQLENESLFHCTSLINGDFVSAKEGKTFNVVDPGSGKTWASCPDCTASDVDSAVASSYETFKTYSKTTPRFRAQTLMKWHNLILAAREDLARILVHETGKTLVEARGEIDYALTFVWWFSGEADRAHGTSMSCAIPGRRAVTIKQPIGVAAALVPWNFPIALALRKAAAALAAGCTMVVKPSPETPLTCVSIAHLALEAGFPRGALNVVTTSLENTPTVAEALCLDARVKKVSFTGSTRVGKIIASFCAPNLKKTTFELGGNCPFIVFDDADVGQAVSQLMPLKWRHAGQACITSNRVFVHSSIYDTFVEKVVQETRGLKLGHGMEEGSTMGALTTPRGLDKAEELYQDAISKGAKTVLGTGKREEGQGYFMAPTILTEMEDDMLMTHEEIFAPVLGFYRFESEEEVVQRANDTPLGLASYIFTKNVDRLWRLFENLDAGMIGLNAGNSSSAEAPFGGIKDSGHGKESGKDVAIDEFLITKTATLTIDGHY

SEQ ID NO: 42761 - protein, 311 aa, Clostridium thermocellum ATCC 27405
MNPYKRIALKALSHWGRNLKKNYRVYRRFTNVVSVCTGHGCRIADLEVAAGDRNIPVRLFHPDDPALGVLIFFHGGGWVTGNVDSYTHVCSNMANQTKNIVVSVDYRLAPEHPFPSGLEDCYDATREFFKNPGLLNCKADDITLIGDSAGGNLAAAVSLMARDRGEFLPKRQILIYPSTYNDHSENSPFPSIRENGTGYLLTSEEIQNYMDMYAPNIEDRQSPYLAPLLARDLSNQPDTLIITAEYDPLRDEGEAYGMRLKEYGNNVKMYRIKGALHGFFSIPWKSQHVSRSFEIINWFLNSYNGQSEELL

SEQ ID NO: 42762 - protein, 320 aa, Oryza sativa (indica cultivar-group)
MFYAGYGYHGSNFEQTYRCYPASFFDKPHLEGGDKVIMPPSALDRLASLHIEYPMLFELHNDATQRISHCGVLEFVAEEGMIIMPYWMMQNMLLQEGDTVRVKNTTLPKGTYVKLQPHTTDFLDISNPKAILEKTLRNFSCLTTGDSIMVAYNNKQYYIDIVETKPASAVSIIETDCEVDFAPPLDYKEPENPQQPSVPASEATAEDENAKVGDELKFRPFTGSGKRLDGKASKLQATEVPSASRSSPSDSNKRVNQETLAPASSGASNSTRQKSGKLVFGSSANNNKEPQKASVKDDESPKKDEPKFQAFSGKSYSLKR

SEQ ID NO: 42763 - protein, 943 aa, Wolinella succinogenes DSM 1740
  misc_feature (188)..(188): Xaa can be any naturally occurring amino acid
  unsure (1)..(943): unsure at all Xaa locations
MSENIVQTLSPLKVGRRSFLKMAALAGAMGASSAVASEGVVRSATTQELKEAHPGAKKIKTICTACSVGCGIVAEVKNDVWVRQEVAQDHPISLGGHCSKGAGMIDVLRSPKRVKYPMKKENGKWKRISWDQAMDEISAKMLQLRTDFGPDAVQFFGSAKVSTEQAYYIRKFAAFWGTNNVDHQARVXHSSTVAGVANTFGYGAMTNHLADIQKSKAIIIFGANPAVNHPVGFQHFLKAKEINGSKLIVVEPRFTRTAAKADMFAQIRPGTDIPFMYGMINLILKNGWEDKKFVAERTFGFEEIAKEAAKYTPEVVEDITGVPAQQLIDITRVYAQTKPGTLIWAMGLTQHTIGTSNTRLAPILQLILGNMGKPGGGTNILRGHDNVQGASDMGCLAENLPGYFPNAEPSFKHWANVWQVDFEWLKARFAPDMMFKNGFSLSRWWQGVLEEETIHNGPAGKLRAMVCMGNGLISVAQTEKVKQALDKLELFVMIDIFPHDAIAYTDRKDGVYLLPAASQYETSGTVTATNRSGQWRYQVVNPIYESKADQDILFAFAKKFGFYNEYVRALGDGKGNFVWPEDATREIAKGVKTIGLSGWLPERLKAHTDNWHMFDELTLEGKGPMKGEYYGLPWPCWSDKHPGTPNLYDNSLPVMKGGMGFRNNFGLKQELNGVEYDMLASEGSVPPGGTQKGGYPAITAANIEALAGITLTEEEKAKVAGKAWHTDLSMILVNKALEAGLCPYGNARARMFVKEWADQIPRHREPLHSPRTDMVAKYPSFKDKPNHFRVDTKYESIQMQKDWAKEFPLNLITGRLVTHNGQGIESRISPALSEIYPEMFIEIHPDRALKLGIKDGDMVWVHSPEGTKGYMKAKYSYSIKEDCVFAPFHWAGIHQGKDLSKNYPEGLVPYSVGESINTVTNYGYDIVTQIPETKGGLCRIEKA

SEQ ID NO: 42764 - protein, 115 aa, marine gamma proteobacterium HTCC2143
MDIMDTIKSQLESNPIILYMKGSPNQPQCGFSARTVQSVMSCGERFAFVDILSNPDVRSNLPIYANWPTFPQLWVGGELIGGCDIVCEMFEKGELQTLLTETAALSADSKEDVSE

SEQ ID NO: 42765 - protein, 393 aa, marine gamma proteobacterium HTCC2143
MSMAAVMNTYGRLPVSFTHGKGVYLYDEEGNQYIDAISGIGVNALGHAHPAVSDAIKKQADLLIHTSNLYGVENQKQLAEALCAVSGMDNVFFGNSGAEANEAAIKIARLYGHNKGVDQPHIVVMENAFHGRTMATLTASGSRKIQAGFEPLVNGFVRAPYGDIDALTNIAKNNPNIVAVLMEPLQGEGGVNCLPENHLAEIRALCDKNDWLMMLDEVQTGNGRTGCYFAYQHHHILPDVVTTAKGLGNGLPIGACLAHGKAATVLGPGNHGSTYGGNPLVCAAALVVVNTINQQQLCKNAQQMGALLLDKFNRAFEHNEAVTDIRGQGLMIGIELVRPCGELVDRARAKGVLINVTAGSVVRLLPPLIINPSQTEQLATVVIDIINDFIGNS

SEQ ID NO: 42766 - protein, 467 aa, Rhodopseudomonas palustris CGA009
MATYDLVVIGTGPGGYVCAIRAAQLGLKVAVVEKNATLGGTCLNVGCMPSKALLHASELFEEAGHSFAKMGIGVSAPKLDLPAMMNFKQQGIDGNVKGVEYLMKKNKIDVLVGKGKILGTGKVEVTGADGKATSVEAKSIVIASGSAVAQLKGIEIDEKRVVSSTGALSLDKVPGKLIVVGAGVIGLELGSVWRRLGAEVTVVEFLDRILPGMDGEVVKQFQRILEKQGFAFKLGAKVTGVDTSGAKLAVKVEAAAGGNPETLEADVVLVAIGRVPYTEGLGLKEAGVALDERGRVVIDDHFATSLKGVYAIGDVVRGPMLAHKAEDEGVAVAELIAGKAGHVNYDVIPGVVYTTPEVSSVGKTEEDLKQAGVAYTVGKFPFTANGRSKVNQTTDGFVKILADAKTDRVLGVHIIGREAGEMIHEAAVLMEFGGSAEDLARTCHAHPTRSEAIKEAALTVGKRAIHM

SEQ ID NO: 42767 - protein, 243 aa, Oryza sativa (indica cultivar-group)
MVVLAKGELEQIPPAGGAPAASRLAFCVNRDRWFSLVCLFCSRCRELLSEYSAAVRRVACGVLELMAEGLGVGPADALARLVAREDSDSILRVNHYPPRPDQLGGGGGPNLTGFGEHTDPQIISVLRSNGAPGLEISLRDGAWASVPHDGDGDSFFVNVGDTLQVLTNGRFRSVKHRVVVNSEKSRVSMVFFGGPPPGERLAPLPALLGDVGRSRYREFTWKEYKGSGCKGRLADDRLCRFEN

SEQ ID NO: 42768 - protein, 417 aa, Rhodopseudomonas palustris CGA009
MTEIRVPTLGESVTEATIGRWFKKPGEAVAVDEPLVELETDKVTIEVPAPSAGTLGEIVAKDGETVAVGALLGQITDGAAPAKPAAAAPAKAAAPAAAPAPAAPAPAAAPAAKAPPSDAPLAPSVRRLSTESGVDASTVPGSGKDGRVTKGDMLAAIEKAASAPTPVNQPAAAVQVRGPSPADDAAREERVKMTRLRQTIARRLKEVQNTAAMLTTFNEVDMTNVMALRAQYKDVFEKKHGAKLGFMGFFTKACVQALKDIPAVNAEMDGTDLIYKNYYHIGVAVGTDKGLVVPVVRDCDEKSIADIEKSIVDYGKRARDGQLKIEEMQGGTFTITNGGIYGSLMSTPILNAPQSGILGMHKIQERPVVIGGKIEVRPMMYLALSYDHRVIDGKEAVTFLVRVKESLEDPARLVLDL

SEQ ID NO: 42769 - protein, 429 aa, Staphylococcus aureus subsp. aureus Mu50
MNFSESERLQQLSNEYILGGVNSPSRSYKAVGGGAPVVMKEGHGAYLYDVDGNKFIDYLQAYGPIIAGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHNNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIQQTLKAADYAFSQMK

SEQ ID NO: 42770 - protein, 463 aa, Bartonella quintana str. Toulouse
MGSFDFDLFVIGSGSGGVRAARLAGGLGKRVGIAEEYRIGGTCVIRGCVPKKLYVYASQYAQEFKKSVGFGWEYADPIFSWKKLVAAKNKEISRLEELYRKGLQNNNVHIYESRAVFVDEHTLELSVTGERISAEKILIATGAKIVPNTAIKGSDLCLTSNEIFDLEKLPKSIIIVGGGYIGVEFANIFHELGVKTTLLHRGNLILRNFDYDLRQLLNDAMIEKGISILYGASISQVQAIGSSYNIVLSSGQMISADQVMFATGRVPNTTGLGLEQAGVKLNEFGAVIVDERMTTNIPHIGAVGDVTGHIQLTPVAIHDAMCFVKTVFENTPTKPDYDLITTAVFSQPEIGTVGLSEEDAARRYKHLEIYRTVFRPMRNVLAGSSEKMFMKLVVDSESRIVVGAHILGENAGEMAQLIGISLKGKLTKDIFDETMAVHPTMAEELVTMYKPSYLYENGEKVEK

SEQ ID NO: 42771 - protein, 234 aa, Bartonella quintana str. Toulouse
MNVQQLKKRAAAKALEFVQDDMRLGIGTGSTANEFIRLLGERVADGLRVTGVATSQYSEQLCRKFGVPVTTLEQMPELDLDIDGADEIGPEMTLIKGGGGALWREKIVAAASRAMLVIADETKVVKTLGAFALPIEVNPFGMPATRRLIEKVADDLGLSGEIILRMNGENPFKTDGGHFIFDAFWGCILQPRLLSEALLAIPGVVEHGLFWGLASRAIVAMADGQIKVLESSDF

SEQ ID NO: 42772 - protein, 371 aa, Tripterygium regelii
ALSIAGAVQSQKLAVLAISQLQSLQGGDIKLLCDTVVESVRDLTGYDRVMVYKFHEDEHGEVVAESKRPDLEPYIGLHYPATDIPQASRFLFKQNRVRTIVDCHALPVRVIQDDGLMQPLCLVGSTLRAPHGCHAQYMENMGSMASLAMAVVINGNDEEVIGGRNTTRLWGLVVCHHTSARCIPFPLRYACEFLMQAFGLQLNMELQLAAQLMEKHVLKTRTLLCDMLLRDSPTGIVTQSPSIMDLVKCDGAALHYQGNYYPLGVTPTEAQIKDIVGWLLDFHGDSTGLSTDSLADAGYPEAALLGDAVCGMAVAYITNRDFLFWFRSHTAKEIKWGGAKHHPEDKDDGQRMHPRSSFKAFLEVVKSRSLP

SEQ ID NO: 42773 - protein, 1032 aa, Yarrowia lipolytica CLIB122
MRKVRVKRHNLHLPEEHNGRVPFPGRAHGLAGHIHIDRGAGGSDSIPLLEEQDESLAGPSHDPIDDSFSISAEDPYNSYHSTPSDFLNNYNDYPDEPGIPLLPMEKDHTHEKGHSDEHVIIDTAEVLEDTCFYVAYKLGIATVDDEPFPESVSYIALKVDEMGDEEALAILKRHVEYHKDDRNIPESSMLLWRSLIRHSEEYAQGNISESGEANPSLSAKKNTESTVDRVATRATYEDGSADLDPANMSPNELSLAIRYHAAIFHYWSPYIEVRSVTDPFDDPNLPVETIRAYLAGIIWLIVGAGVNQFFSVRMPAISISTMVCQLLLYPTGKALEYILPDKGFTFRGTRHSLNPGPWNNKEQMLATMFISVAIGGTYITSYNLFVQILPMYYGVDYARQFGYTLTLTLASQFMGFGFAGLLRKFVVYPTKAMWPTLMPTLALNRALLVKQKREKVHSWTISPYKFFFVVVACAFVYFWFPSYIFQALSTFNWITWIAPDNLNINIVTGAQGMGVNPWPTFDTNNMFALFDPLVLPQFTVLNTYAGMILGASVILGLYYTNTKGTAHLPINSNRIFDNTGKSYNVSRVLTDGTFDDTKYRTYSPPFYTAANLMVYSSFFAIYTLGFVYIGLSEWFTMVESFRDVKQAFIDIFMTTKFYIMRITNRKATRHDMDSSQFTNRQDEPFSRMIAAYPEVQNWVFIGLLVVSFVLAVIAIRVWPTDTPIWGLFFCLGINLVFLIPLTLILAYTGFGFGLNVLVQLIVGYALPGHPQAMMILKAIGYQVDGQAQNFITDQKVSYYTHMPPRALMRSQLIGTLVGAFVCLGVLYYQLEIEGICTPEQATTTKFTCVSQNTFFSASVIWGALGPAKMFQIYPAMKYMFLLGAVVGLIFWAVQYPLPTFLAKKFPQHRERILSLQSTLKLFNPVIFVGGVLNFAPYNLSYATGGLYVSLLFSWIKRRYSAWWRKYTYVLDAGLITGIAFSAIIIFFAVQYKGVELEWWGNTVSYDNLDFKGAILKPLAAGETFGPSPENFP

SEQ ID NO: 42774 - protein, 103 aa, Oryza sativa (indica cultivar-group)
MWPQSNASPPTGNGPGLRPAEQGVEEEAGRPLPKFGEWDVNDPASADGFTVIFNKARDEKKGGNGQDTDSPCKETRTERVESYAPKTNSKKWFCCVTSSPTQS

SEQ ID NO: 42775 - protein, 462 aa, Lupinus albus
MKMGYSSFVAIALLMSVVVVCNGGKTSTYVRNLIEKPVDMPLDSDAFAIPPGYNAPQQVHITQGDLVGQAMIISWVTVDEPGSNQVIYWSDSSLQNFTAEGEVFTYTYYNYTSGFIHHTTITNLEFDTTYYYEVGIGNTTRQFWFITPPEVGLDVPYTFGIIGDLGQTFDSNTTLTHYQNSNGTALLYVGDLSYADDYPYHDNVRWDTWGRFTERSAAYQPWIWTAGNHEIDFDLQIGETQPFKPFSTRYHTPYEASQSTEPFYYSIKRGPAHVIVLATYSAFGYSTLQYKWLTAELPKVNRSETSWLIVLMHAPWYNSYNNHYMEGEPMRVIYESLFLKYKVDVVFAGHVHAYERSERVSNNKYNITNGICTPVKDITAPIYITNGDGGNLEGLATMKQPQPSYSAYREASFGHGIFAIKNRTHAHYSWNRNQDGYAVEADKLWLFNRYWNPLNDSTIHIP

SEQ ID NO: 42776 - protein, 318 aa, Oryza sativa (japonica cultivar-group)
MATDGTGVVTVYGSGTNGAALLEPSNHKSATFSVKVGLAQMLRGGVIMDVVTPEQARIAEEAGACAVMALERVPADIRAQGGVARMSDPGLIRDIKRAVTIPVMAKARIGHFVEAQILEAIGVDYVDESEVLTLADDAHHINKHNFRVPFVCGCRDLGEALRRIREGAAMIRTKGEAGTGNVVEAVRHVRSVMGDIRALRNMDDDEVFSYAKRIAAPYDLVMQTKQLGRLPVVQFAAGGVATPADAALMMQLGCDGVFVGSGIFKSGDPARRARAIVQAVTHYSDPKILAEVSSGLGEAMVGINLSDPKVERFAARSE

SEQ ID NO: 42777 - protein, 374 aa, Wimmeria concolor
ALSIAGAVQSQKLAVRAISQLQSLPGGDIKLLCDTVVESVRHLTGYDRVMVYKFHEDEHGEVVAERKRPDLEPYIGLHYPATDIPQASRFLFKQNRVRTIVDCHASPVRVIQDDGLMQPLCLVGSTLRAPHGCHAQYMENMGSIASLAMAVIINGNDEEVIGVRNATRLWGLVVCHHTSARCIPFPLRYAWEFLMQAFGLQLNMELQLAAQLSEKHVWKTRTLLCDMLLRDSPTGIVTQSPSIMDLVKCDGAALYYQGNYYPLGVTPTEAQITDIVGWLLDFHGDSTGLSTDSLADAGYPGAALLGDAVCGMAVAYITNRDFLFWFRSHTAKEIKWGGAKHHPEDRDDGQRMHPRSSFQAFLEVVKSRSLPWEN

SEQ ID NO: 42778 - protein, 374 aa, Zinowiewia concinna
ALSIAGAVQSQKLAVRAISQLQSLPGGDIKLLCDTVVETVRVLTGYDRVMVYKFHEDEHGEVVAESKRPDLEPYIGLHYPATDIPQASRFLFKQNRVRMIVDCHATPVSVIQDAGLMQPLCLVGSTLRAPHGCHAQYMENMGSIASLAMAVIINGNDEEGIGGRNTTRLWGLVVCHHTTARCIPFPLRYACEFLLQALGLQLNMELQLAAQLSEKHVLRTQTLLCDMLLRDSHTGIVTQSPSIMDLVKCDGAALYYQGKYYPLEVTPTEAQIKDIVEWVLAFHGDSTGLSTDSLADAGYPGAASLGDAVCGMAVAYITDRDFLFWFRSNTAKEIKWGGAKHHPEDKDDGQRMHPRSSFKAFLEVVKSRSLPWEN

SEQ ID NO: 42779 - protein, 460 aa, Frankia sp. EAN1pec
MADTAAGPVDLVVLGGGSGGYAAALRAAELGLRVVLVEKDKLGGTCLHRGCIPTKALLHAAEVVDTVAASESFGIRATLDGIDMAGVRAYRDSVVDGLYKGLSGLVRARGIEVVTGTGRLVSPTAVAVGDRVVEARHVLLATGSAARTLPGLDLDHRTVIDSGDALALEHVPGSVVVLGGGAIGCEFASVWRSFGAEVTIVEALGHLVPAEDEASSKLLERAFRARGIALRLGVPLAGAKTTDRGVTVVLEDGSTVDAELLLVAVGRGPVSAGLGLDEVGVSTDRGHVLVDTHLRTNIPTVSALGDVRPGPQLAHVAFAEGILSAELLAGLDPVPVDYDNVPRVTYSHPEVASVGLTAAAARERHGEINTATYHLAGNGKARILRSAGAVTVVSAADGPVVGVHMVGDRVGELIAEAQLITNWEAYPADVAQLLHPHPTLSEALGEAHLALAGKPLHVHS

SEQ ID NO: 42780 - protein, 374 aa, Zinowiewia concinna
ALSIAGAVQSQKLAVRAISQLQSLPGGDIKLLCDTVVETVRVLTGYDRVMVYKFHEDEHGEVVAESKRPDLEPYIGLHYPATDIPQASRFLFKQNRVRMIVDCHATPVSVIQDAGLMQPLCLVGSTLRAPHGCHAQYMENMGSIASLAMAVIINGNDEEGIGGRNTTRLWGLVVCHHTTARCIPFPLRYACEFLLQALGLQLNMELQLAAQLSEKHVLRTQTLLCDMLLRDSHTGIVTQSPSIMDLVKCDGAALYYQGKYYPLEVTPTEAQIKDIVEWLLAFHGDSTGLSTDSLADAGYPGAASLGDAVCGMAVAYITDRDFLFWFRSNTAKEIKWGGAKHHPEDKDDGQRMHPRSSFKAFLEVVKSRSLPWEN

SEQ ID NO: 42781 - protein, 323 aa, Arabidopsis thaliana
MAVSLPTKYPLRPITNIPKSHRPSLLRVRVTCSVTTTKPQPNREKLLVEQRTVNLPLSNDQSLQSTKPRPNREKLVVEQRLASPPLSNDPTLKSTWTHRLWVAAGCTTLFVSLAKSVIGGFDSHLCLEPALAGYAGYILADLGSGVYHWAIDNYGDESTPVVGTQIEAFQGHHKWPWTITRRQFANNLHALAQVITFTVLPLDLAFNDPVFHGFVCTFAFCILFSQQFHAWAHGTKSKLPPLVVALQDMGLLVSRRQHAEHHRAPYNNNYCIVSGAWNNVLDESKVFEALEMVFYFQLGVRPRSWSEPNSDWIEETEISNNQA

SEQ ID NO: 42782 - protein, 580 aa, Zea mays
MRPPAPKVPSAASSSSHSQREPRPENPLLLLPSSRFTKLSLGCPLLDRLLCGGLPAASVTEIAGESASGKTQLCLQLALLAPLSPLSASSLFLHSDLPFPLHRLRRLAPKSRPDILDHVLVAAAHSPTDLLSLLARAQRLLANPGRSPHRLPIRLILLDSIASLFRGDFDASPADLRRRSALFFQISAKLKELAYRHQCVVVVTNQVVDVVEGDAGNTVAWSSGRRLSPALGIAWANCVNTRLFLTREVEGNGTSGSARRWMKVAFAPHLPEQSCEFVIRRDGVFGVEPESPDSNFHVIHKFQFHNLWRDTLVMSLEVKNSLTGRIEVSAQNVWIGKGGAYTGEISAEQLVDIGCQWVILGHSERRHIIGENDEFIGKKAAYALSQNVKVIACIGELLEEREAGKTFDVCFRQKKAFADSISNWADVVIAYESVWAIVTGKVATPEQAQEVHAAALFKDKKPVKVIKKNSAAVTKFLDELAKIDFPGAKVVSEAVAKSGTSPLLPAITFILDKVAPFIPKEEPKAEPAAEATSREVAVEEKKEEARASCSDGGGTGAGRDTVGGGGGRGEEGRREEGRGG

SEQ ID NO: 42783 - protein, 468 aa, Rickettsiella grylli
MAELEIKKTELLVLGSGPGGYSAAFRAADLDKKVILVERESTLGGVCLNIGCIPSKALLHAAKVIDDAKAMAKWGLDFGKPTIDLKKLRDFKSNVVKKLTQGLSLLAKQRNVEWIKGEGKFIGKNKLIVGKQKIVFDAAIIAAGSQPIRLPFLPDDPRIMDSTGALELKEIPDKLLILGGGIIGMEMATVYRALGSEITVVETGDMIINGPDKEIVTPLYKRLQKEYTFLLKTKVTQVDAKKDGLWVTFEGEGISKPQRFDQILSAVGRKPNGKNIGAEALGLSITEQGFIPVDKQLRTNIPHIYAIGDIVGHPMLAHKASAEGRVAAEVIAGKKHFFEPQCIPAVAYTDPEIAWVGLTVNAAKEKNVAYEKAVFPWLASGRSLGQGRDEGLTQLLFDPKTHRILGGGIVGPNAGELIAEITLAIEMGCTAEDIALTIHPHPTLSETVMLASEIFEGTITDLYMPKKK

SEQ ID NO: 42784 - protein, 591 aa, Triticum aestivum
  misc_feature (324)..(324): Xaa can be any naturally occurring amino acid
  unsure (1)..(591): unsure at all Xaa locations
MCGILAVLGVGDVSLAKRSRIIELSRRLRHRGPDWSGIHSFEDCYLAHQRLAIVDPTSGDQPLYNEDKTVVVTVNGEIYNHEELKAKLKSHQFQTGSDCEVIAHLYEEYGEEFVDMLDGMFSFVLLDTRDKSFIAARDAIGICPLYMGWGLDGSVWFSSEMKALSDDCERFISFPPGHLYSSKTGGLRRWYNPPWFSESIPSAPYDPLLIRESFEKAVIKRLMTDVPFGVLLSGGLDSSLVASVVSRHLAETKVARQWGNKLHTFCIGLKGSPDLKAAKEVADYLGTVHHELHFTVQEGIDALEEVIYHIETYDVTTIRASTPXFLMSRKIKSLGVKMVLSGEGSDEIFGGYLYFHKAPNKKELHEETCRKIKALHLYDCLRANKATSAWGLEARVPFLDKNFINVAMDLDPECKMIRRDLGRIEKWVLRNAFDDEKKPYLPKHILYRQKEQFSDGVGYSWIDGLKDHANAHVSDSMMTNASFVYPENTPTTKEAYYYRTVFEKFYPKNAARLTVPGGPSVACSTAKAVEWDAAWSKLLDPSGRAALGVHDAAYEEEKAPASVDPVLENAFHPPAHGESTLVKSAVPAAAV

SEQ ID NO: 42785 - protein, 61 aa, Glycine max
EDKPHPQEEVIATEFQKVTVSDQGENKHSLLEKLHRSDSSSSASSEEEGQDGEKRNRTTKE

SEQ ID NO: 42786 - protein, 888 aa, Rickettsiella grylli
MTQQTPYRDKDPIETQEWIAALLSVLKCEGADRAQFLIQQLVNKARQRGCELTIGMNTPYVNTIPPEREPVFPGNEKLERRIAALIRWNAVMMVLQAGKVSSELGGHIATYASAATLYEVGFNHFFHAENAHHGGDLVYIQGHSSPGIYARAFLEGRLSKKQLTYFRQEIGGQGLSSYPHPWLMPEFWQFPTVSMGLGPMQAIYQARFLKYLQNRGLLDTQNRKVWMFCGDGEMDEPESLGALCIAAREKLDNLIFVINCNLQRLDGPVRGNGKIVQELEGVFRGSGWNVIKVLWGSAWDPLFKKDKQGLLSQLMMETLDGEYQNYRAKDGAYIREHFFAKYPELKTLVAEMSDEELWLLKRGGHDIKKVYAAYKSAVQHKDQPTVILAKTIKGYGMGTAGEGQNITHQQKKMTYDQLRAFRDRFQLSLSDRDIENLSFYCPDEKSPEISYLKEQRKKLGGYLPARRTQAEESLNIPPLNDFKKILDGSNGREISTTMVFVELLRHLLKEKTLGPRIVPIVPDESRTFGMEGLFRQIGIYSPVGQLYDPVDAGQLMYYREDKKGQLLEEGINEGGAFCSWMAAATSYSTNNLMMVPFYIYYSMFGYQRVGDFVWAAGDMQARGFILGATAGRTTLVGEGLQHQDGHNLLFFSVVPNCVAYDPCFGYELAVIIQDGLHRMMNNQENVFYYLTVMNENYVHPPFNEKHKKGIIKGMYLLSETKPSKRHVQLLGSGTLLNEVIAAKELLKTDFDVTADVWSVTSFSELRKEALHAERYNMLHPNEPEKKSYVAHCLQDRIGPVIAASDYIRLNADQIREFIKAPYRVLGTDGYGRSDTREQLRQFFEVNRYYIVIACLYSLLTENLVTKIEIEHAFKKYHIDSTKPNPFTV

SEQ ID NO: 42787 - protein, 211 aa, Ostreococcus tauri
MATTSNERSIAERVREAKCEVILGSGSSTRRAVLSSMGIDHVVVKPDIDEKAIRRDDPKALVRALAIAKADAAKEKLGTSDFGTRRLLITCDQVVVHRGEIREKPSSEDEARAFIRGYGVDPPSTVGSTMVTDLSTGKSALAVDVNTVVFDAIPDDVVDAIVEEGECMHCAGGLMVEHELVQPYLRRIDGSLDGVMGLDAKTVERLLDELI

SEQ ID NO: 42788 - protein, 438 aa, Bartonella quintana str. Toulouse
MSENKAHITVNNKKIELSVRKGTLGPGVIEIASLYKETDTFTYDPGFTSTASCESKITYIDGDKGILLYCGYPIDQLAEKGDFLESCYLLLYGELPTKQEKIDFDRCIMQHMMVHEQFTRFFHGFRRDSHPMAVMVACLGAMSAFYHDSIDIKDAQQRMIAAIRLISKVPTLAAMAYKYSIGQAFVYPRNDLSYAANFLHMCFSVPCEEYKINPVLSRAMDRIFTLHADHEQNASTSTVRLVGSSGANPFACIAAGVACLWGPAHGGANEACLKMLQKIGSVERIPEFIARAKDKNDPFRLMGFGHRVYKNYDPRAKIMQQTCHEVLKELNIQDDPLLDIAIALENTALNDEYFIEKKLYPNVDFYSGITLKALGFPTEMFTVLFALARSIGWVAQWKEMIEDPAQKIGRPRQLYTGYAAREYVSIDKRISKNKMTTQ

SEQ ID NO: 42789 - protein, 1045 aa, Rickettsiella grylli
MSIPLISVKKNPFRHAIENAYYADETTCVKQLMQEAFLPAQTLEKIEQCATQLIEKIRAERLSKGGLDAFLYEYDLSSEEGIALMCLAEALLRIPDAKTVDALLEDKITHADWASHLGQSPSLFVNASTWGLVLTGKLFQSEKSEGLGQVLGRFIRRTSAPVIRKAIKQAMQQLGRQFVMGETIDEALKRAKTYEAKGYCFSYDMLGEAARTEKDAERYFKAYQTAIAVIGKNAPTQSLYQAPGISVKLSALHPRYEFAKKEEVVPFLTKRLKQLTLAAKDNNMTLTVDAEEADRLDMSLDIIEAVFCDQDLAHWEGLGLAVQAYQKRAPYVIDWLIDLAKKQHKRWMVRLIKGAYWDTEIKNAQIKGVLTYPVFTRKAATDVCFVACAKKLLAHTAEVYPQFATHNAYTFATLLELAGKNRDFEMQCLHGMGYTLYDSIVGSQQFNIPCRVYAPVGEHEDLLAYLVRRLLENGANTSFVNRIVDESIPIETMLEDPVRKLASLNEIPHPKIPLPPAIYAPDRKNSRGIDFSDSETWEPLAHQIEIAFKKSYRAGPILKGGLVEGEKRQAVRNPSNPEEIVGHVSLASEKQLDQALSNAYAMNFTWTNTPLETRAASLERAADRFEQRFGEFMALVIKEGGKTLPDAVAEVREAIDFCRYYALRARKDLIPQHLPGPTGEENWLRFPGRGVIACISPWNFPLAIFIGQVTAALVAGNTVIAKPASQTPCVATEAVKLLHEVGIPVDALQLLPARGSVIGPKITDDPRIKGIIFTGSTETAREINQRLAHREGGILPFIAETGGQNAMIVDTSALKEQVVVDVLISAFGSAGQRCSALRVLYLQEEMAESFIEMLIGAMATLKVGDPSLLFTDVGPVIDSAAKKTLQEHFDRMCKEAKLLYQCTIPRELDQTHFFAPCLFELKRLDSLTREVFGPILHVIRYSMNDREKVINEINNTGYGLTLGIQSRIQHTVESISRSVHAGNQYVNRSMVGAVVGVQPFGGEGLSGTGPKAGGPHYLPRLCLERSLSINTTAAGGNASLLCLED

SEQ ID NO: 42790 - protein, 479 aa, Solanum lycopersicum
IPIMNPAPLSTPAPVTLPVRSIPGSYGLPLVGPIADRLDYFWFQKPENFFTKRMEKHKSTVFRTNVPPCFPFFGSVNPNVVAVLDVKSFSHLFDMEIVEKANVLVGDFMPSVVYTGDMRVCAYLDTSEPKHAQIKNFSQDILKRGSKTWVPTLLKELDTMFTTFEADLSKSNTASLLPALQKFLFNFFSLTILGADPSVSPEIANSGYIFLDSWLAIQLAPTVSIGVLQPLEEILVHSFAYPFFLVKGNYEKLVQFVKNEAKEVLSRAQTEFQLTEQEAIHNLWFILGFNAFGGFSIFLPTLLGNLGDEKNADMQEKLRKEVRDKVGVNPENLSFESVKEMELVQSFVYETLRLSPPVPSQYARARKDFKLSSHDSVYEIKKGELLRGYQPLVMKDPKVFDEPEKFVLERFTKEKGKELLNYLFWSNGPQTGRPTESNKQCAAKDMVTLTASLIVAYIFQKYDSVSFSSGSLTSVKKAS

SEQ ID NO: 42791 - protein, 755 aa, Haemophilus somnus 2336
MDAQLRQAALDFHEFPKPGKIEVTPTKSLGTQRDLALAYSPGVAVPCLEIQADPASAYRYTSKGNLVAVISNGTAVLGLGNIGALAGKPVMEGKGVLFKKFAGVDVFDIEVDEQDPDKLVEIIAALEPTFGGINLEDIKAPECFYIEQKLRERLKIPVFHDDQHGTAIISAAAIINGLRIVNKKIEDVRLVTSGAGAASIACLNLLVSLGMKRENITVCDSKGVIYKGRDEKMDDTKKLYAIDDNGQRSLADAIPDSDIFLGCSAAGALTQEMVKTMGPNPLILALANPEPEILPPLAKAVRPDAIVCTGRSDYPNQVNNVLCFPFIFRGALDVSATTINEEMKLAAVYAIADLALAEQSEVVSSAYGESGVSFGPDYIIPKPFDPRLIVKIAPAVAKAAMDSGVATRPIEDFEAYIEKLTQFVYKTNLFMKPVFAQAKEDKKRVILTDGEEKRVLHAIQEIATLGIAYPVLLGRTHIIEESIKKLGLQLQVGRDFEIIDIENNPYYEECCDTYYNKLKRQGMTPTGAKRKMLHNPTALGAVLLELGKVDAMICGLVGPFAAHLATVKEVVGEKEHEIPATVNGLVLPTGNLFIADTFVNSSPTAEELAEITIMSAKEVRRFGIEPQVALVSHSNYGSINDPSAVKMRQVLELVREKAPDLIIDGEMHCDIALSENLRKEVMPDSPIKGAANLLIMPNMETARISLNLLQGTATPITIGPILMGVEKPAHILTSASSVRRIINMVAVAAVKAQNR

SEQ ID NO: 42792 - protein, 748 aa, Vibrio vulnificus YJ016
MLSQLREIVEKVSRVEDVHQALNTLVRETCTALSTECCTIYLANEERQRLELMATQGLTFHGDSIHIQFEEGLVGLVKRSAEPLNLAEASKHPAFKYFPQLGEETYHSFLGAPIIHRKKVLGVLVIQQKTPRLFSEMEESFLVTLSAQLAVIIAHAQSLGHWSLASKPAAVQGIAASSGVAIGEFWYDNSQPILSEVCPASTLDKEREQEWLAVAIEAALADFRRMRKKFDSEINKDALAIFDLFTHLLNDPMLRTDLKKHVERGDRADWALRQVVESYSSRFARMSDVYLRERAHDIRELGQRLLFFLHNSEQEQPRIERPVILVANELTASLLASVPKKYLLAVVALEGAANSHAAILSRALGVPAVMGANLNLEEVHGKQGIVDGYSGEIYIQPNRQILREYRSLVTEESELFAMVNKELALPAKTQDNVDVEVLLNAGLSADSNIAINAGVDGVGLYRTEIAFLLQHRFPSEDEQYQQYRAILSSYPQQRVVMRTLDIGGDKPLPYLPIEEDNPFLGWRGIRFTLDHPDIFLIQLRAMLRASAEHGNLSILLPMISGVGELDDAIRLIQQAYHEVVLLDERVVMPQIGVMIEVPSMVYLIPSIAQRVDFVSVGTNDLTQYLLAVDRNNARVSDVYESLHPAVLQALQQIYQQCGQYHLPVCICGELAGDPFGALLLLGLGYRSLSMNTSNVARIKYLIRHSQLSDLQALSQQALSLSYGKDIHQLMRDYFINHDFAGFIRAGKK

SEQ ID NO: 42793 - protein, 343 aa, Thermus thermophilus HB27
MRALAKLAPEEGLTLVDRPVPEPGPGEILVRVEAASICGTDLHIWKWDAWARGRIRPPLVTGHEFSGVVEAVGPGVKRPQVGDHVSLESHVVCHACPACRTGNYHVCLNTKILGVDRDGGFAEYVVVPAENAWVNPKDLPFEVAAILEPFGNAVHTVYAGSGVSGKSVLITGAGPIGLMAAMVARASGAGPILVSDPNPYRLAFARPYADRLVNPLEEDLLEVVRRVTGSGVEVLLEFSGNEAAIHQGLMALIPGGEARILGIPSDPIRFDLAGELVMRGITAFGIAGRRLWQTWMQGTALVYSGRVDLSPLITHRLPLSRYREAFGLLASGQAVKVILDPKA

SEQ ID NO: 42794 - protein, 524 aa, Oryza sativa (indica cultivar-group)
MAAVVDFLDLRAAAPFVVAALAFYFLVEQLSYHRKKGPLPGPPLVVPFVGSVAHMIRDPTGFWDAQAARARKSGAGLAADFLIGRFVVFIRDSELSHRVFANVRPDAFHLIGHPFGKKLFGDHNLIYMFGEDHKDLRRRIAPNFTPRALSTYAAIQQRVILSHLRRWLDRSAANGGKAEPIRVPCRDMNLETSQTVFAGPYLTKEAREKFERDYNFFNVGLMALPVDLPGFAFRSARLGVARLVRTLGECARASKARMRAGGEPECLVDFWMQETVREIDEAKAAGKPPPAHTDDEELGGFLFDFLFAAQDASTSSLCWAVSALDSHPDVLAGVRAEVASLWSPESGEPITAEKIAEMKYTQAVAREVVRHRPPATLVPHIAGEEFQLTEWYTIPKGTIVFPSVYESSFQGSPSRTRSTRSASSRRHGGRTWCTSATSSRSAPGRTSASGSGFDVWSIQLFLLVIGFSWGLDSALGPSRLGDDTNTTSGVVGHMCGSSGLVGWHVSGNWWYLEWICSIVLATKM

SEQ ID NO: 42795 - protein, 423 aa, Oryza sativa (indica cultivar-group)
MDRASENRRLAAVGKPVPGIGEMGNRRPLRDINNLVGAPPHPSAIAKKPMLEKSGKEEQKPALVVSHRPMTRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLAAAAVYTAQCALTRCQQWTKTCELHSRYTGEQLLECSRMMVDFHQKAGAGKLTGVHRKYSTFKFGCAAKTEPALFLLESGAGGYNLQKHLQQAC

SEQ ID NO: 42796 - protein, 545 aa, Neurospora crassa
MSPRAFALAHQRDRGSFVGCSRIADYEVLGKLGEGTFGEVHRARSRKTGALVALKKIIMHNERDGFPITALREIKLLKLLSHKNVLRLEEMAIEHPPRTDKRTRPIVYMVTPYMDHDLSGLLDNPSVRFTEPQVKCYLLQLLEGLKYLHANHILHRDMKAANLLINNKGVLQIADFGLARHYEGDIPQPGKGSGEGKRDYTSLVVTRWYRPPELLMHLKRYTTAIDMWGVGCVFAEMLEGKPVLQGESDLHQLELVWDLCGTPSEETMPGWRTLPGGQAFSSKPRPGNLARRFEKHGPVVISLLKELFKLDWRSRINAIDALNHPYFRTAPLPALPGDLPTFEESHEFDRRKFQDRKAALPPAPKGGTVGRGAVVNSQGPDTGFSGRDGYGGGGRNGANGGRYPPYHRGPPPGDERVPSWHSARGLPPRPPMPADYHGSGPMDHTDGYRDRPPRRGPGGPPGGGGGPSNVDTYIPSYDRDGPAPRREDWRRRDDWDDRRGGVDRDRRRPEYDVRSRDSRTRSRTRSRSPVRDRDRGRDRDAYARR

SEQ ID NO: 42797 - protein, 86 aa, Ostreococcus tauri
MKRATTVEEQRRRAKEMVTYFKDRRYDDALEESQVFGWTAKNEINNGRWTMFGLLVGMMTEYGTGVDFVDQIKLLVSVLGIADVYD

SEQ ID NO: 42798 - protein, 169 aa, Methanosarcina mazei Go1
MTDKNKEWNLFWGSPMKVKDVMNPDVVFCKPENTVREAAKILKENNISGAPVLEDGKLVGIVSEADLLELLVIPEKGNLWLPSPFEIIEVPIRELLSWEETKKMLSDVGSTKLEEMMTKSVHTISSEASVEEASELMVRHRINRLPVIENGYVVGIVTRGDIIEGLAKL

SEQ ID NO: 42799 - protein, 452 aa, Yarrowia lipolytica CLIB122
MLRVGRIGTKTLASSSLRFVAGARPKSTLTEAVLETTGLLKTTPQNPEWSGAVKQASRLVETDTPIRDPFSIVSQEMSTLANNIGSLIGSGHPTLNKVATYYFQSEGKHVRPLIVLLLSRALSAIPESERDRGTFDASDVTENVGELNPEPSINDPLSPIEILHGINPDIVLNPLSRPSDPLPYESNGILPKQRRLAEIVEMIHTASLLHDDVIDNSATRRGSPTGNVAFGNKMAILAGDFLLGRASVAIARLRNAEVIELLSTTIANLVEGEFMQLKNTIVDNSEIANKATFEYYIHKTYLKTASLMSKSCRAAAVLSGARNPIVDASYKFGKNLGLCFQVVDDMLDYSEGESHLGKPAGADLKLGLATAPVLFAWEKYPELGDMIKRKFDGPGDVERARFLVQQADGLSRTRELAQKYCDEAVANLDLLPYSESREALRNLTMKMMNRSK

SEQ ID NO: 42800 - protein, 279 aa, Bradyrhizobium japonicum USDA 110
MSQDGFGLAGVMGMPVAHSRSPIIHNYWLKAHGIRGSYVPLAVKPERLEDALDGLIALGFRGCNVTMPHKQTAMPLLTRVNETAKRIGAVNTIVVEADGTLSGFNNDGNGFVQSLRDAKADWRGDAGPILLLGAGGASRAVVVALLENGAREIRIANRTAEKAQALARDFGSAVSTIAWDDRGAALGDVALLVNCTDRGMVGKAALEIDLSRLRPETLTADLIYTPLETPFLAEARARGCVTVNGLGLLLNQARLAFKAWFGVMPDVTPELIKAIEATF

SEQ ID NO: 42801 - protein, 307 aa, Colwellia psychrerythraea 34H
MTKIPLNNDFAQVTSITLNQESGEERFEGLNISHAYCQAKVSLYGGQVLSFKPSGHRDVLWLSEQASYQMGKAIRGGIPLCWPWFGANDKQSQYLTENPNTALKPVNHGFARQLPWHITSINADESGVTLVLVLSGDKQHPLWPNAYTLTQTLFFGKNLKQTLTMSNDSLEDAQYSAALHSYFTVSNPGNVSIDALTGVRYSDKLTGNSSTQQEAVSCVGEIDREYHSSEKMTVIDNHWQRKIDIISSNCQQWVLWNPGTELANTMADIHPQGEQEYVCLEAANTSWQIIPAGETVVISQEITVTNC

SEQ ID NO: 42802 - protein, 203 aa, Prochlorococcus marinus str. AS9601
MSSKLRVGVAGPVGSGKTALVETLCLSMNKNYEIAVVTNDIYTKEDANFLINKKVLEEGRIIGVETGGCPHTAIREDCSLNKNAVLDLENKYNPLDFVFVESGGDNLASSFSPELVDLSIYVIDVSAGDKIPRKGGPGITRSDLLLINKIDLADKVGADLNIMKSDTEFMRKGKPWFFTNLSSGMGVEEIIQFLESHIPNNRN

SEQ ID NO: 42803 - protein, 2271 aa, Cryptococcus neoformans var. grubii
MPMFRRSASSHSTSDAAAPPTITNVTEGSPVSSGSITRQKRSRSHGGGGSPASTFSSRFGISRHLSHQFQQPHEQEQGQVPPPEKPATREVPVSLEPEIYGSEAGEDSNFGQEPAGEQLIPETRSSSRQSRRSSRELSVQTIEPSSDDEIRSPEKRRVSPLMKRLGEEPPFMLPHPSLSDSTYQAYPGVVIGSFAGGGPDTLFGNGMQLEGTVDDILDPNAARQEDRGNQVPAGANIAPWLMDDGPPSRSENPSPALSETQERPVKGPAAALREKDPRKTSTVLNHFSSVPSLPKIRRHGRAATTTPDQTPRGSTHSQSNLASSSSSLNNESRESRAGSDDSIQTTLTQKGRRQSPGEWGQASAVPPPSKGTRPGRFGSTASIISGTGSVGEKKKSLFGGLLKRKTNPNLSLNPISHDFTTSEHRGSAGSIPLSASSSKLSSCSLSSLPSKSPPFTSPPEAFSRQFLPANYVHEGAVSPLQEISESPFHLDMNLDDMEGIIDPAKAGLPSTVAYRPSASSEVTTDSSASESMRLEEALNQTSSFGTSVSGASRGSDGTKMPGRIVLGEAERLPTPFTGTDPFQQHRESASTTGSDGKPFSPPSPHTLSPKHHLPSSSANQPRRPSALRNVETGQVDETPQLSASEGSIQPISPSWAGGSGITVFNDPFSTSRQRQEQPPNSAGLSPSTTAYPSAVTQPGPSTARFLITAGSTTPSAAWAAPESWGVEADEAPAEEITSSDEDDWAGLGVEEVASASPTSDTLPSPPTSPRASSLPSPKRAPPFGFKSQQRAKPGTSGTTDSTTSAAGRRKGKRVGSSGRPATGRPGTSGSAYNPSSLHWIRIYRADKSYMLYNLPLNTSTGELLALLAAQAEQGMVRGKNVAINMKLYICERGQNRMLLPSEKPLTIQHRRLLQLGHTEADHLDELGKNDMAVLCRFIYQAPILPIMDPEEESSYDSFEFIDIASRDLQTIPIFLHLHAHDIIILNISKNPMTDIPLDFIQACTSLKELRMSNMALKRVPISIRASTTLARLDVSCNRIADLESVALHEVETLVSLKVQNNKLTSMPSYFAQMKSLKYLNISNNKFETFPSVVCEMSNLVDLDVSFNNIAELPAKMSDLKSLEKLGLYSNDISKFPESFCTLANLRILDVRRNKITDLSAVYALPNLATLQADNNNIVTLDAQLGANVRQFSVPHNSVTRFTLAPPPNMAVVTYMLTNLDLSHGKISTLADEAFSGLTNLVTLNLNFNQFTKLPATLGRLTSLEVFSCTDNMLNLVPAGFGKLQRLRMINLHNNNLKSLPEDLWACGALEVFNASSNLLDSFIPPPADIESVVGRVGSGTSQTSNGRKKYSVPPIGLSIRKLFLADNRLNDDVFHWISLMPSLRIINLSFNDIYEVPPFTLCKCERLEALYLSGNKLTNLPSEDLEKLQSLKVLHLNGNKLQTLPSELGAIKTLQHLDVGSNVLKYNIANWPYDWNWNWNTSLRYLNLSGNKRLEIKPTSAHEMSHASSFRKELSDFTALTQLRVLGLMDVTLRIPSLPDESEEKRVRTSFSDINNMAYGISDMLGSIDNLAMFDLVVPHFRGKENECLFGMFGRVTTTLQGGKIAKYVQEIFAETLTAHLHQLEPGEEPSEALRRTFLLGDRKAFEFFSDKLQLEKERKPSWTSFASFDSMFRGWTPGVNSVLRTGASGAVVYLVDKVLHVGSIGDTLVVLSRKGDAELLSKRHDPTDREESARIRKAEAWVSTKGFVNDDKDLDISRAFGYWHECPAVNAAPEIRTRRLQESDEFVIIGNHALWQFCSYQTAVDIARTERDDPMMAAQKLRDFAISYGAEGNVMVMVVNVSDLFLAKGGRARGPSKQTATDANADVEGYAVAKRQVRRRYDEVGDRTLNRLQQEIEPPVGQVAIVFTDIVNSTHLWETNPAMPTAIKMHHNLMRRQLRLDGGYEVKTEGDSFMVSFQSVASALLWSFNCQIGLLQQEWPRELLEAHDGKVVYDSNGTIVQRGLRVRMGVHWGAPECEKDPITRRMDYYGPMVNRAARINASADGGQLMASQDVLNEIAPLMEYLNSSDEQVLNDLQGDLKREVMELRRIGLEVRDMGDRKLKGLEVPERLHLLYPKTLAGRLEISNEIRAEVEVNDARKSAERQRSVDIDQVYQLSDIALRLEAVCCYNPTPSSPGDTPTAGVMRLHPPASYLGPSIREDMNDEELWTIIESLVGRIENVMSTLYLKNFGEFSAVLAALESATKIDQKLIVHALALMNEAMGKDEENAI

SEQ ID NO: 42804 - protein, 568 aa, Oryza sativa
MLLYKSSLSRCRGTFDICTPNRIRSRQYNATPTRQRRPLLYGDRRRSANRGEADEMESEVCWLLCAALAAAMVYYYYYYLACTTSRRAQRRRLPPGPTPLPVIGNVLSLSGDMHHELARLAREQYGPVMTLKLGLFTAVVVSSPDAAREAFTKHDRRLAARTVPDISRARGLTGRSMIWLPSSDPRWKTLRSAVATHFFSPRSLAAARGVRERKVRDIVNYFAGHAAEVIDVGEAVYGGVINIVSNAFFSADVVDVGKESAHGLRETLEDIILAIAKPNVSDLFPFLRRLDLQGWRRWAEKRYDKVFGILDDKINSRLADADADASTKKHGDFLDSLLELMSAGKIACDDVTTVMFDAFGAGTDTISNTVVWAMAELLRNPSIMAKVRAEMEDVLAGKKTIEENDTEKLPYLRAVIKEAMRLHPVAPILLPHRAAEDGVEIGGYAVPKGSTVIFNVWTIMRDPAAWERPEEFMPERFLQRAEVDFRGKDFEFIPFGAGRRLCPGLPMTERVVPFILASLLHAFEWRLPVGVAAETLDLSEKFTTVNVLVTPLKAIPILASSASELQAS

SEQ ID NO: 42805 - protein, 149 aa, delta proteobacterium MLMS-1
MKSAREIMTREVVSVKPEMPVEELAALLWEKRISGVPVVDDDGKLVGVATESDLIDQAKKFHIPTAITILEAVIFLDRGKKVEKEVSKMAGSRVRDICTSEPVTVGPETPLDELATIMAEKHLHTLPVLEDGQLVGVIGKADIIRTLCT

SEQ ID NO: 42806 - protein, 560 aa, delta proteobacterium MLMS-1
MKLANAQQMRQADRLAMESWGIAGLVLMENAGRLAAELVARRFGSPVGREIVLVAGPGNNGGDALVAARYLHLAGARPWVLLLVEPERLTGDAAANLVPLRALAVPLSVAADEQALAALEPRLRQSWLAVDGIFGTGLSRPPEGRFLAAIQFLNRFPGPVLALDAPSGVNGDDGSILGEAVGAAATITFALAKPGLVLSPGREAAGELEVADIGIPPEIHRQLDIRLELLEAPRLAPWLPRRRRADHKGDFGHLLLLAGSLGKTGAALLAARGALRGGVGLLSAGVPLPLLHIFATALPELMTIPLPASDRAAAMADLELIRTSLADKTAVVLGPGLGTRPETVDLVRTLYRELPQPLVVDADALNILAMRPQALGEAAGPRLLTPHPGEMARLLNLSSGEVQEQRLQLAAALACQYQVWVVLKGADTVVAAPDGRLALNPTGNPGMATGGMGDVLAGLLGALLCQGLEPWRAACLGVYLHGLAADLQAAEYGINFGFTASEVAEAIPAAGCRLLAEAGQGKHKNRKRSPGPMSADLTGRKRSAVPHITASSQAPRTPCT

SEQ ID NO: 42807 - protein, 327 aa, Chlamydophila pneumoniae CWL029
MSNQFDQLKKLSTIVCDSGDPELVKASGSQDATTNPSLILKVAQEPKFQELLNEAVVWGIRQNGDDLQTLSFILDKIQVNFALEIIKNIPGRISLEIDARLSFNVEAMVQRAVFLSQLFEAMGGDKKRLLVKIPGTWEGIRAVEFLEAKGIACNVTLIFNLVQAIAAAKAKATLISPFVGRIYDWWIAAYGDEGYSIDADPGVASVSNIYAYYKKFGIPTQIMAASFRTKEQVLALAGCDLLTISPKLLDELKKSQHPVKKELDPAEAKKLDVQPIELTESFFRFLMNEDAMATEKLAEGIRIFAGDTQILETAITEFIKQIAAEGA

SEQ ID NO: 42808 - protein, 772 aa, Mycobacterium smegmatis str. MC2 155
MDIMSDRYVRTLDILTIADAEEAGGKGANLGELVAADLPVPHGFVVMRSAYLDSVRMGGVEAELAALHTEALTHAADTARLSELCRRMQSLVNKAGLSPSVRDATLAAYRALGTDVVVAVRSSATGEDGRDASFAGMNRTITNVMGEVALLDAVTQCWMSLFSPRVITYRASRGFTAAPAMAVVVQQMLSADRAGVAFTSDPSTGDADHIVIEAAFGQGEVVVSGKVEPDTYVIDKRTLEVRDVRIGFKAIKIVRGDDGADSMVQLERSQAEARVLDDDALRKIATLAVATETHNGCPQDIEWVIADGAVWLVQARPITTLGSAGSTAGDEPSVLIRGLPAAPGVASGRVRVLLAPDDGDKLTDGEILVAPTTNPDWLPTIRRAAALVTETGGMTCHAAIVARELGVPCVVGARSATVALAVGSMVTVDGTRGEVTTGRLPETVRTTTTPQEPAPHITGEATGTKVYVNLAMPDSAEAVAAQDVDGVGLLRAEFMLTEALAGRHPRDLITKGEQDTLVDAMAAAVTRIGTAFAPRPVIYRAMDFRTNEFRGLAGGEQFEPVEHNPMIGYRGCYRYIKEPDLFALELSALARAREHTPNIHLMIPFVRTRWELEECLALVDASPLRRHRNLHRWVMAEVPSVVHWLPEYVGMGIDGVSIGSNDLTQLMLGVDRDSETCAELFDESDAAVLDAISRIISTANRLGITSSLCGQAPSTRPEFAEHLVRMGITSVSVNPDAAGAARRAVAAAERRLLLDSVRHPRHAPTASPRNPL

SEQ ID NO: 42809 - protein, 399 aa, Polaromonas sp. JS666
MIFFDAAIDWLAHGLVAASWWQIVLYTLVTTHITIASVTIYLHRHQAHRAMDLHALPAHFFRFWLWLGTGQVTKEWVSVHRKHHAKCETMEDPHSPQAHGIETVFWKGAELYRAETKNKETLTKYGHGTPNDWLERNVYTRYSWQGVGLMMILNLALFGAAGLAVWAVQMVWIPVTAAGIINGIGHYWGYRNFEAPDASTNVSPWGIMIGGEELHNNHHTYPTSAKFSVKPYEFDIGWVYIRALEKVGLASVKKVPPKLQLGAIQPVADEKTLEALIAHRYEVMAGFARELRRAGKAEIEVLKARKADVSVLRTANRWLHRDDDKVPAAAKPQLAQARAEHPVLDKMVTMREELRQMWLSTSASREQLATDLQAWCHRAEESGIAALREFSMKLRAARA

SEQ ID NO: 42810 - protein, 255 aa, Hordeum vulgare subsp. vulgare
MEDERSTQSYQGAEADQVEVTDRGLLGNLLGKKKEEEDKKKEEELVTGMEKVSVEEPEVKEDGEKKETLFSKLHRSSSSSSSSSDEEEEEEVIDENGEVIKRKKKKGLKEKLKEKLPGHKDNEAEHVTGLPAPTAPASVQTHHDTDVVVEKIDGDAKAEATPAVPEEEKKGFLEKIKEKLPGGHKKPEDAAAVPVTHAAPAPVHAPAPAAEEVSSPDAKEKKGLLGKIMDKLPGYHKTGEEDKAAAPSGEHKPRA

SEQ ID NO: 42811 - protein, 219 aa, Vibrio parahaemolyticus RIMD 2210633
MSVKIHYQNTHFITSAPDIRHLPEDEGVEIAFAGRSNAGKSSALNRLTNQKSLAKTSKTPGRTQLINLFKVEEGCHIVDLPGYGFAQVPVEMKNKWQKSLGEYLQKRECLKGLVVLMDIRHPMKDLDQQMIFWAIDSRIPVQVLLTKADKLKSGARKQTLLKIRKQVETFGGDVSVDVFSSLKGLGVDQLRAKLDTWFAPALAHLIEEDDLEMPESNEE

SEQ ID NO: 42812 - protein, 417 aa, Polaromonas sp. JS666
MHPKALLDSCSELLKQVLKFEHPADMVVSRYFREMRLGPRERATVAETIYGVLRKKNLYAYLAQHGSGPPERRLAILGFAAERDFLLSALTEQEKDWLARCDQVKPSDLMELHRHNLPQWLVEPLKAQLGDDFWPLVESLNAPAGLDLRVNTLKEKRAEVQKELGKHAIKTVATPYSPWGLRLVDKPQLGKLDAFTRGAIEVQDEGSQLLALLLDAKRGEMVVDFCAGAGGKTLAIGATMRNTGRLYAFDTSGHRLDALKPRLARSGLSNVHPVAIAHERDDRIKRLAGKIDRVLVDAPCSGLGTLRRNPDLKWRQNPKAIEELTAKQAAILQSAARLLKPGGRLVYATCSILREENEAIAEAFSAANKEFNALEVAPLLTHLGVEGAERLCRGPYLRLWPYLHQTDGFFAAVWQKL

SEQ ID NO: 42813 - protein, 487 aa, Arabidopsis thaliana
MEKIRFPVTKPALNWAEIGLKPIYEDQQHKSRKRSVVGFVCAVPHSPLFRVATESSMGRIGSPLGKNEFSWVIKDFSSLGVRAIYSDEFVIGGCKWRLIAYPMGNRIKKYMSLYVEVADSKHLPSGWSINTELRMEVTPSWGYKTMIRHSKLSGEEGFLVSGEVTIVVKIDVYRVFGKVAAIEISEEGSKEGYEYESEEVYKKESEEGYKYESEEDYEKRPIERFEYESEAESKKDYEERTRGGFEYESEPVSKKDYEERPRESFEYESEAESKKDSEEGSRERYEYESEEESKKDSENDCGEESEKDSEEGSRPLKKIKRNDDGVKSNDSVNKTQQVKETMDINGFQVLPSQVTLVSRILKKYPDIALGFNAKNRHLRTACMNVLISLIETLCQSPQELSDEDMDEADNALVYVQDAGFKVDWLDKKLKEVKEKKVVEQTGKTRIQELEEELKEFKQKCLDREALLEKEKAKVLAARASLTLDDFV

SEQ ID NO: 42814 - protein, 416 aa, Methanosarcina mazei Go1
MLRVMTSRNFLTIDDFDIRGKTILLRVDMNSPMDTQGHILDDMRIRSHIATLKDLESAKVVVLAHQSRPGKKDFTTMKPHAHLLSRYLGRQVTYVDDIFGTFAKTQIASMEDGDVIMLENVRFYSEESLERTTAEQANTFMVKKLAPFVDIFLNDAFAVSHRSHLSVVGFTEVLPSGAGRVMEKELISLEKGVKSGERPSVFVLGGAKVDDSLRVTENVLTNGGADRVLLTGVVANVALAASGVNIGKANLDFIKSQGYEDQIERARGLLAKFEDKIGLPKDVALNDNKKRVEAPISELNSDSLPINDIGLETIVDYTNEIQNAKTVVLNGPAGVSEIEDFALGTHEIIKAAIKSDFSIIGGGHISVEVAHLGLEHRFSHISTGGGACIDFLAGEKLPGVEALKAAYNKYQEAKKL

SEQ ID NO: 42815 - protein, 165 aa, Glycine max
MAVLVARQGRELQRYSTSTGGRIVVGCIPYRMRDGGDSDGEGELEVLVISSQKGHGMMFPKGGWELDESMDDAARREALEEAGVRGEMGKVLGCWHYQSRRYQTTYEGIMYPLRVTDELQQWPEMASRKRTWATVQQVMEGCQHCWMREALEELVARHAKPQSAL

SEQ ID NO: 42816 - protein, 223 aa, Zea mays
  misc_feature (211)..(211): Xaa can be any naturally occurring amino acid
  unsure (1)..(223): unsure at all Xaa locations
METMSALARTAPPLAGTIRRPSCALRPTASLSFAAASTTPRGRLGLGLSTAPAGSGRAARARAVPQRIVASSEVERSYIMIKPDGVQRGLVGEIISRFEKKGFLLKGLKLFQCPKDLAQEHYKDLKDKPFFPKLIDYITSGPVVCMAWEGAGVVASARKLIGATNPLQAEPGTIRGDLAVQTGRNVVHGSDSPDNGKREIELWFKEGELCXKWESVQAPWLIE

SEQ ID NO: 42817 - protein, 387 aa, Gossypium hirsutum
MVHCLPKVFVIQDKPMLPSTAAVAKDEHRPLAFDASILGSESNIPSQFIWPDDEKPCLDAPALVIPTIDLGAFLLGDSLAVSKAAEVVNEACKKHGFFLVVNHGVDSGLIDKAHQYMDRFFSLQLSEKQKAKRKVGESYGYASSFVGRFSSKLPWKETLSFRYCPHTQNIVQHYMVNWMGEDFRDFGRLYQEYCEAMNKVSQEIMGLLGISLGLDQAYFKDFFEQNDSILRLNHYPPCQKPELTLGTGPHTDPTSLTILHQDQVGGLQVFADEKWHSVAPIPGAFVVNVGDTFMALTNGFYKSCLHRAVVNTETVRKSLAFFLCPKLERPVTPAAGLVTAENPRKYPDFTWAALLKFTQNHYRADMKTLVAFSKWVQEQESNYKLIP

SEQ ID NO: 42818 - protein, 314 aa, Prochlorococcus marinus str. AS9601
MKDLDFNFPLDKFEKLIIDIGWESLDDWFNFWNNKRNILSIDQYWNNKVNEDWIWGLALPLLSQAYRFHNDFSTRKIIGISALPGTGKTTLGNWLEAISLNLNFKIAVISIDDFYLPSDEMKLAINNNPWNVSRGFPGSHSVKLMYEKLLYWKINGELNVPVFDKSLRNGLGDRSHWRFDNPDLVILEGWFLGIEPCSIDVKDQHIQSAVLSPNESSYTLKIQNKLNEYLDVWSLIDNIWHLKPLKIEYMNMWKTNQEKEMFLQKGNSLKDEKLSNFLRMLNVSIPHNSFDFIKSYALLLIDQERNLVEVGLNL

SEQ ID NO: 42819 - protein, 212 aa, Arabidopsis thaliana
MKIRLSITIILLSYTVATVAGQQCGRQGGGRTCPGNICCSQYGYCGTTADYCSPTNNCQSNCWGSGPSGPGESASNVRATYHFYNPAQNNWDLRAVSAYCSTWDADKPYAWRSKYGWTAFCGPAGPRGQASCGKCLRVKNTRTNAAVTVRIVDQCSNGGLDLDVAMFNQIDTDGFGYQQGHLIVDYQFVDCGNELIGQPDSRNMLVSAIDRV

SEQ ID NO: 42820 - protein, 383 aa, Arabidopsis thaliana
MAENLACGETASHGSLTTTMMISTMAADFTNEIDYNHQLFAKDDNFGGNGSIPMMGSSSSSLSEDRIKEMLVREIEFCPGTDYVKRLLSGDLDLSVRNQALDWILKVCAHYHFGHLCICLSMNYLDRFLTSYELPKDKDWAAQLLAVSCLSLASKMEETDVPHIVDLQVEDPKFVFEAKTIKRMELLVVTTLNWRLQALTPFSFIDYFVDKISGHVSENLIYRSSRFILNTTKAIEFLDFRPSEIAAAAAVSVSISGETECIDEEKALSSLIYVKQERVKRCLNLMRSLTGEENVRGTSLSQEQARVAVRAVPASPVGVLEATCLSYRSEERTVESCTNSSQSSPDNNNNNNNSKQEEEKTMRENKRVIHCLLQPKTTSTHDI

SEQ ID NO: 42821 - protein, 387 aa, Arabidopsis thaliana
METQGKVITCKAAVAWGAGEPLVMEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTDKCLWNEGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 42822 - protein, 232 aa, Gibberella zeae PH-1
MLTYNSTSTMPIKAPTKPVSIALSPTTSSPMTAATPSLNSAAINGHKTQGQQHIWLVTGPAGCGKTTVAEYLAKSLGMPYVEGDAFHPTANIEKMANGIPLTDEDRWDWLTALREESINRLNAGSCGVVLTCSALKRKYRDVIRVAGYYDRRIQIHFVFLDAPEELLLARVTQRQNHYMGANMVHSQFDILERPLADEKDVITIDVSRPIEVVEQEALSNVLETMAKSQDKL

SEQ ID NO: 42823 - protein, 217 aa, Nitrosospira sp. NpAV
MQKSSNPLRVGIGGPVGSGKTALCEVLSKKMRDRYEMAVITNDIYTKEDMEILLRAEALPAERLMGVETGGCPHTAIREDASINLEAIARMTADFPNLDLILVESGGDNLASTFSPELSDLTIYVIDVAAGEKIPRKGGPGITRSALLVINKIDLAPYVGANLEVMARDAKRMRGERPFVFTNLHTGEGVEQIIEFIVKQGLLDEVKAQQSHSRASA

SEQ ID NO: 42824 - protein, 209 aa, Triticum aestivum
  misc_feature (75)..(75): Xaa can be any naturally occurring amino acid
  misc_feature (129)..(129): Xaa can be any naturally occurring amino acid
  misc_feature (137)..(137): Xaa can be any naturally occurring amino acid
  misc_feature (148)..(148): Xaa can be any naturally occurring amino acid
  misc_feature (163)..(163): Xaa can be any naturally occurring amino acid
  unsure (1)..(209): unsure at all Xaa locations
MEGVVVRRVIPSDNSCLFNAVGYVMEHNKNKASELRQVIAAAVASDPEKYNEAFLGKPNEAYCAWIMDPEKWGGXIELSILSEYYGREIAAYDIQTTRCDLYGQGKNYNERAMLIYDGLHYDALAMSPXEGAPEEFXQTIYVVDQNRXSIGPVEGLALNLAKXAHRKRSYTDTANFTLRCGVCQIGVIGQKEAVEHAQATGHVNFQEYK

SEQ ID NO: 42825 - protein, 613 aa, Campylobacter coli RM2228
MVQKANSGHPGAPLGMADILTVLSYHLSHNPKNPTWLNRDRLVFSGGHASALLYSFLHLSGYDLSLDDIKNFRQLHSKTPGHPEISTQGVEIATGPLGQGIANAVGFAMAAKKAQNLLGKELINHKVYCLCGDGDLQEGISYEACSLAGLHKLDNLIIIYDSNEISIEGDVSLAFNEDVKMRFESQGFEVLSIDGHDYEAIDKALKQAKKANKPCLIIAKTTIAKGAGELEGSHKSHGAPLGEEVIKKAKEKAGFDPNLNFYIPKAAKIRFESAVELGDLEEAKWKDKLEKSEKKELLEKLLNPDFSKINYPDFKGKDLATRDSNGEILNALAKDLEGFLGGSADLAPSNKTELYGMGDFAEGKNIHFGIREHAMAAINNAFARYGIFLPFSATFFIFSEYLKPAARIAALMKVKHFFIFTHDSIGVGEDGPTHQPIEQLSTFRAMPNFLTFRPADGVENVKAWQIALNADIPSAFVLSRQKLKALNEPVFGDVKNGAYLLKESKDAKFTLLASGSEVSLCLESANELEKQGFACNVISMPCFELFEKQDKAYKDRLLQGEVIGVEAAHSNELYKFCDRVYGIESFGESGKDKDVFEHFGFSVPQILNFILDK

SEQ ID NO: 42826 - protein, 302 aa, Saccharomyces cerevisiae
MNRFKQLEKLGNGTYATVYKGLNKTTGVYVALKEVKLDSEEGTPSTAIREISLMKELKHENIVRLYDVIHTENKLTLVFEFMDNDLKKYMDSRTVANTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 42827 - protein, 218 aa, Gibberella zeae PH-1
MSTPSGTGSWTSLIQQARQLEKQFAAAPNIPPKPTEKERETEKKLEELLEKREDVISKLVRLLDSEAALTSSAMKQNNLALFQKKLASHRKDLIRLRSNLQEARNRANLLTNVRSDIDQYRQNNPEAAEADYMLQERNRIDNSNSMADNVLSQAYAVNDNFNLQRETLASINRRITHAASQVPGINTLIGRISAKKRRDGIIMGGFVAFCFIVFFLFS

SEQ ID NO: 42828 - protein, 260 aa, Pisum sativum
MAAAHTPREENVYMAKLAEQAERYEEMVEFMEKVSANADSEELTVEERNLLSVAYKNVIGARRASWRIISSIEQKEESRGNEDHVDVIRDYRSKIESELSNICDGILKLLDTRLIPSASSGDSKVFYLKMKGDYHRYLAEFKTGAERKEAAESTLAAYKSAQDIANAELPPTHPIRLGLALNFSVFYYEILNSPDRACNLAKQAFDEAIAELDTLGEESYKDSTLIMQLLRDNLTLWTSDMQDDGADEIKEAAPKADEQQ

SEQ ID NO: 42829 - protein, 396 aa, Azoarcus sp. BH72
MRPVRLPRLSQRSADVQPFHVMELLRRARDLEAMGRDIIHMEVGEPDFPTPAPVVAAATRFLDGGDVHYTPALGLPALREAIARFYHDRFGADVAPDRIIVTAGASGALMLALAATTNPGDEWLLPDPGYPSNRHLVRSFEGVAQALPVDAATRYQPTAAQVDAAWSARTLGLMVATPSNPTGTLLDAAELAALHRGTQARGGLLIVDEIYQGLTYGVEASTVLSQPALNAADDLFVVNSFSKYFGMTGWRLGWLVAPPAYVREIEKLAQHFFIAPSTPAQHAALAAFAPDTTEILEARRHEFAARRDTLLPALRELGFVVATEPQGAFYIYADVSALASDSEQLARRLIEEAGVAATPGLDFGHHHPRRHLRIAYTTRQDRLLEAAERIAAVLRP

SEQ ID NO: 42830 - protein, 469 aa, Vibrio parahaemolyticus RIMD 2210633
MSVENVLSLIQENEVKFVDLRFTDTKGKEQHISIPAHQIDADFFEEGKMFDGSSVAGWKGINESDMVMMPDASSAVLDPFTEDATLNIRCDILEPATMQGYDRDPRSIAKRAEDYMRSTGIADTVLVGPEPEFFLFDDVKFSNDMSGSFFKIDDIEAAWNTGSDIEGGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHQSLAKDGVNLFAGDKYGGLSETALYYIGGIIKHARAINAFANPSTNSYKRLVPGFEAPVMLAYSARNRSASIRIPVVPSPKARRIEARFPDPAANPYLAFACLLMAGLDGIKNKIHPGEAMDKDLYDLPAEEAAEIPKVAESLEVALNALNEDREFLTAGGVFSDDFIDSYIALKSKDVERINMATHPLEFELYYSV

SEQ ID NO: 42831 - protein, 520 aa, Glycine max
MRSSSSSDRNRINIAASAQKVDVDNRISLRFYYRIADNILRQADIFRAEKNIIDLYVMLLRFSSLVSETIPRHRDYRSSPQRQKESLKKKLLISLNELENLKPVVQQKINELNNKFAYQQNGQGKFISNNSLDFSPVKKLTSASYGLIKAVRPTAGEFVYQGSRSQQFSYVRPVEEHVRRLSLTLPPPKEETLSRHSILGPNGLKGHWRPPIIDKGIKYPSNIDLSPVELPSLQQSMEDESLKKKDNSIAEHHKSELASILTQSEDCQLQPHPQPEPDQEPPSLISFETTETSAQIEVIRQPSPPPVLAEVQDLVPAVSPCVNEAGCKTEIPSLDNSVHAEDPLQLHISAALMESFMKLAKSNTKKNLETCGVLAGLLKNRKFYITALIIPKQESTSDSCQTTNEEEIFEVQDKRSLFPLGWIHTHPTQSCFMSSIDLHTHYSYQIMLPESVAIVMAPRDSSRNHGIFRLTTPGGMSVIKQCDQRGFHPHSQPPDGGPIYKTCTDVYMNPDLKFEVIDLR

SEQ ID NO: 42832 - protein, 404 aa, Oceanospirillum sp. MED92
MSSNINRDTFNQVMVPNYSPMASIPVRGLGSRVWDQQGREYIDFAGGIAVNALGHSHPELVQALKEQAEKLWHLSNVWTNEPAIQLAQSLCTKTFAGRVYFANSGAEANEAAFKLARKYAYDHFSADKHEIISCVNSFHGRTLFTVSVGGQDKYREGFEPVPAGISHVPFNDLDALEAAISDKTCAVVIEPIQGEGGIMPASKAYLMKARELCDKHNALLIFDEIQTGVGRTGQLYAYQAYGVTPDILTTAKALGGGFPVGAMLTTEPIATALNIGSHGSTYGGNPLACAVANKVLSLIDSEEVLNGVEKRHQIFIEQLRQLNKTAPVFSEFRGMGLLLGCELQPAFKGKARDLLQLALEHGLMLLIAGPDVIRMTPSLIIPEEDIHQGMQRFTQAAEQFLQQQ

SEQ ID NO: 42833 - protein, 457 aa, Thermus thermophilus HB27
MAEIGVAVVGGGWAGLAAALALKEAGADFLLLEASLRLGGKVRTARQEGFLVEGGPDASVRYKKEVLELAQAFGLEPIGTLPEKPAAYILYRGKRHPLPEGLLQVVPGDLKALARTPLLSLPGKLRALYDLFLPRGAKEDETLREFVERRLGPEVYRALVAPLAGGVYGGEPDDLSMRAAFPQLWELEGRHRSLLLGAMRARKGRGSREGGSLFFSFAEGLQALTRRMAEALGERVLRGTPVLGLEPVRGRWRLHTPKGALLAEAVVLAIPAPQAAGLLRPFLPEATALLKGIPHTPAATVSLAFPGALPVEGHGLLVAKGEGLRARGFTWTHRKWPGRVPEGFSLVRAYFSGEAARLSEEALIRLALEDLARLLPGLPRVHRAWAFRFPEGMPAYRVGHLDRVERLEMALVKAPGLFLAGNYLQGVGLPEVVRSGRRAAQRALAHLSLGEAHGASR

SEQ ID NO: 42834 - protein, 399 aa, Burkholderia sp. 383
MRAPLRTRLRTTFIETVSQMSKQNKKILLLSVSAGAGHTRAAEAIRAFADHHPAGIEATHLDVMDFVSTGFRKLYTDLYIKLVSSQPALWGYLYQKTDEVDPAAPSQKIRRAIERLNCRALLAEIERQRPDAIICTHFLPAELLSREIRKGRVDTPVWVQVTDFDLHSMWVVPNMRGYFAANDEIAWRMHARGMAPDTVHVSGIPIMPAFGQPLDRAACAAEFGLDPARPTFLMMSGGAGLGGLDVLAARLLEMDADFQLIALAGKNKAMLASLQELAAQHPGRLFPQGFTQQVERLMACADLVITKPGGLTTSECLAMQLPMIVNSPIPGQEERNADFLLEQGVALKAIDDDALVYRIHALLQTPERLADMRRRLAPLGRPLAGRFVLDRVLGLEPAA

SEQ ID NO: 42835 - protein, 338 aa, Arabidopsis thaliana
MASLISFSLLPKPKAVRSSISAPQTQTINTEKLEDKFGRKGIKFSESNNIPMVELKVRNGSSLKLSLSDAHVLSYKPKVYWKDEGFEEVLYTVDGDESRGGVGVVIVNGEEPKGGSSVISGCDWSVKDTDSDAIDALQIELSCTAGVLDITYIVSLYPVSMATALVVKNNGRKPVTLKPGIMSYLRFKKRSGAGIQGLKGCSYCPNPPLSSPFELLSPSEAMKAESSGWFGSEEGEKPGIWAVEDSVITLLEKKMSRIYGAPPAERLKAVYNTPPSKFETIDQDDKDWVRRDVCGIPRIDVGQVWEATLLRVHRSNVNARSCRCSLRRDMERSNGNRA

SEQ ID NO: 42836 - protein, 489 aa, Burkholderia sp. 383
MSVFGLQRLYIGGGYVDATSGKTFDTFDPATGELLAQVQQASAADVDRAVASAQEGQREWAAMTAMQRSRILRRAVDLLRERNDELAALETRDTGKPIGETLAVDIVTGADVIEYYAGLATAIEGLQVPLRAESFVYTRREPLGVCAGIGAWNYPIQIACWKTAPALAAGNAMVFKPSEVTPLTALKLAEIYTEAGVPAGVFNVVQGDGSVGALLTGHPDIAKVSFTGGVETGKKVMSLAGASSLKEVTMELGGKSPLIVFDDADLDRAADIAVTANFFSSGQVCTNGTRVFVHRSIKDAFTQRVLERVKRIRVGKPTDADTNFGPLVSAAQLDKVLGFIESGKAEGAKLLAGGTRLTDGHFGSGQYVAPTVFGDCRDDMKIVREEIFGPVMSILDFESEDEVIARANDTHYGLAAGVVTENLSRAHRTIHRLEAGICWINTWGESPAEMPVGGYKQSGVGRENGITTLEHYTRIKSVQVELGRYNPVF

SEQ ID NO: 42837 - protein, 506 aa, Vibrio sp. Ex25
MIYAQPGSENAIVNFKSHYDNFIGGEWVKPTGGEYFDNISPINGQAYCKVARSGEADINLALDAAHNIRTKWAKTSVTERSNILLKIADRIEQHLEELAVAETWENGKPVRETLAADLPLVVDHFRYFAGCIRAQEGSAAELDEHTASYHFPEPIGVVGQIIPWNFPMLMAAWKLAPALAAGCCVVLKPAEQTPTSILVLMEKIGDLLPPGVINVVNGFGSEAGQALATSNRIAKLAFTGSTQVGNHILKCAADNLIPSTVELGGKSPNIYFSDVFDYEDEYLDKCIEGTLLGFFNQGEVCTCPSRVLVHEAIYDKFVEKLTERAQLIKQGNPLDTDTQVGAQASQEQFDKILSYLEIGREEGAKVVFGGGVSEQPESINQGYYIQPTMLEGHNKMRIFQEEIFGPVIAITKFKDEAEALEIANDTEYGLGAGVWTRDANVAYRMGRNIEAGRIWINCYHAYPAHAAFGGYKKSGIGRETHKMMLDHYQNTKNLLISYSVDPLGFF

SEQ ID NO: 42838 - protein, 380 aa, Pichia angusta
MSTVGKTITCKAAVAWEAGKDLTIETIEVAPPKAHEVRVKIAYTGVCHTDGYTLSGNDPEGQFPVIFGHEGAGVVESVGEGVTSVKVGDHVVCLYTPECRECKFCKSGKTNLCGKIRATQGKGVMPDGTSRFTCKGKTLLHYMGCSTFSQYTVLADISVVAVDPKAPMDRTCLLGCGITTGYGAAINTAKISEGDNIGVFGAGCIGLSVIQGAVKKKAGKIIVIDVNDAKKDWAFKFGATDFVNPTKLPEGQSIVDKLIEMTDGGCDFTFDCTGNVQVMRNALEACHKGWGESIIIGVAPAGKEISTRPFQLVTGRVWRGCAFGGIKGRTQMPDLVQDYMDGEIKVDEFITHRHPLNDINQAFHDMHKGDCIRAVVTMDE

SEQ ID NO: 42839 - protein, 120 aa, Methanosarcina acetivorans C2A
MIDLDTLKYENGLILAVVQDQKSREVLMCAYMNREALEKTVKTGIAHFWSRSRKQLWKKGETSGHLQKVKEIRIDCDMDSVLLLVEQVGGACHMGYRSCFYRNLKGEVVGEKVFEPKDVY

SEQ ID NO: 42840 - protein, 473 aa, Colwellia psychrerythraea 34H
MYTYNKLYINGDWQLPNTEDTIDVINPANSELCAKTPSASIADVDKAIAAAKYAFAQWSATTPAERSQLITAIADEMQNRIDDFASAISTSMGCPKHLAFDIQVQGAIDAFRGYADMTSYVDESSTEHGVMQCHSAVGVCVLINPWNYPLSQLVGKIGPALATGCTIVAKPAEQTPLQDLILAEIFDKVGVLAGVFNVITGYGFKIGEHLCSHPDVDMVSFTGSTGAGIKVAQAASTTVKRVCQELGGKSPFIITDDADLAAAVRYGVEDVMINSGQTCCALTRMLVPESLYQQAIVIAKAVAEENVVGDPQDENVTMGPLSSSLQQKRVLDYINIGIKEGAELVTGGPEIPARLQQGAYVMPTIFTNVTNDMTIAQEEIFGPVLCMIPYSDEQEAIKIANDTVFGLSSGVFAKDANAALQIARKIRAGQSYIQGTYFNSHAPFGGFKQSGNGREWGVEGLREFIEVQSIIIT

SEQ ID NO: 42841 - protein, 318 aa, Colwellia psychrerythraea 34H
MVADIGGTNIRLAIASPSDVITDIATYQCAKFANLIDVIRLYIMEKQLEGKTINACLAIACPVDDDYISMTNLPWQFSQKDLKEQLKLNTLTLINDYTAIALAIPYLSDSQKVKIGAGEAVSNKAISVCGPGTGLGVATLVPLDNKWHCISGEGGHVDFAPVDELEVKVFSYIYAYKKRVSYEQLLSGYGLEQIYQALVKITNEGKSNNFVAGDLSAEIISTNAINGDCILCKQALEFFCKVLGSFAGNLALTANSLGGVYIAGGIVPRFIDFIEKSGFRERFETKGRLSSLTQQTPTYVITETQPGLLGAAAYLNQL

SEQ ID NO: 42842 - protein, 542 aa, Thermus thermophilus HB27
MMEGERMNGFPSTMMEEELNLWDFLERAAALFGRKEVVSRLHTGEVHRTTYAEVYRRARRLMGGLRALGVGVGDRVATLGFNHFRHLEAYFAVPGMGSVLHTANPRLSPKEIAYILNHAEDKVLLFDPNLLPLVEAIRGELKTVRHLVVMDEKAPEGYLAYEEVLGEEVDPVRVPERAACGMAYTTGTTGLPKGVVYSHRALVLHSLAASLVDGTALSEKDVVLPVVPMFHVNAWCLPYAATLVGAKQVLPGPRLDPASLVELFDGEGVTFTAGVPTVWLALADHLESTGHRLKTLRRLVVGGSAAPRSLIERFERMGVEVRQGYGLTETSPVVVQNFIKSHLEALPEEEKLTLKAKTGLPIPLVRLRVADEEGRPVPKDGKALGEVQLKGPWITGGYYKNEEATRSALTPDGFFRTGDIAVWDEEGYIEIKDRLKDLIKSGGEWISSVDLENALMGHPKVKEAAVVAIPHPRWQERPLAVVVPRGEKPAPEELNAHLLKAGFAKWQLPDAYVFVEEIPRTSAGKFLKRALREQYKDYYGGA

SEQ ID NO: 42843 - protein, 160 aa, Triticum aestivum
STARSNQSQVSKPPPPRSRRRREAMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 42844 - protein, 315 aa, Prochlorococcus marinus subsp. marinus str. CCMP1375
MTWSINSIPSQEGRTVFVTGANSGLGFDTAQALLEKGATVILGCRTLEKAERSRQKLLDETDCGKIDVLEIDLADLEKVNEALDKIAVKYKKLDLLINNAGVMAPPQTFSKQGFELQFAVNHLSHMALTLKLLPLIAKQPGSRVVTVSSGAQYMGKINLDDLQGGEGYDRWSSYSQSKLANVMFALELSKRLQQSNLDIASLSAHPGLARTNLQSTSVKLNGSWQEAIAYKLMDPMFQSSRMGALPQLLAATDPTAKTGEQYGPRFNFRGYPKICRIAPSALNSDEREQLWQLSEKLIGDAVDISKGKELLSTKK

SEQ ID NO: 42845 - protein, 154 aa, Glycine max
  misc_feature (33)..(33): Xaa can be any naturally occurring amino acid
  misc_feature (126)..(126): Xaa can be any naturally occurring amino acid
  misc_feature (137)..(137): Xaa can be any naturally occurring amino acid
  unsure (1)..(154): unsure at all Xaa locations
MASSMISSPTVTTANRPGAGLVVQLIGLNSLVXFPTLKTHHDITFIASNGGRVQCMPVWPPVGKKKFETLSYLPDLDDAQLAKEVEYLLMKGWIPCLEFELEHSFLYREHIRSPGYYYGRYWTMWXAAMFGCTDASXELKELQEAYDCISNGYI

SEQ ID NO: 42846 - protein, 354 aa, Oryza sativa (japonica cultivar-group)
MAGSDEVNRNECKTVVPLHTWVLISNFKLSYNILRRADGTFERDLGEYLDRRVPANARPLEGVSSFDHIIDQSVGLEVRIYRAAAEGDAEEGAAAVTRPILEFLTDAPAAEPFPVIIFFHGGSFVHSSASSTIYDSLCRRFVKLSKGVVVSVNYRRAPEHRYPCAYDDGWTALKWVMSQPFMRSGGDAQARVFLSGDSSGGNIAHHVAVRAADEGVKVCGNILLNAMFGGTERTESERRLDGKYFVTLQDRDWYWKAYLPEDADRDHPACNPFGPNGRRLGGLPFAKSLIIVSGLDLTCDRQLAYADALREDGHHVKVVQCENATVGFYLLPNTVHYHEVMEEISDFLNANLYY

SEQ ID NO: 42847 - protein, 164 aa, Glycine max
  misc_feature (132)..(132): Xaa can be any naturally occurring amino acid
  misc_feature (137)..(137): Xaa can be any naturally occurring amino acid
  misc_feature (147)..(147): Xaa can be any naturally occurring amino acid
  misc_feature (153)..(153): Xaa can be any naturally occurring amino acid
  misc_feature (158)..(158): Xaa can be any naturally occurring amino acid
  unsure (1)..(164): unsure at all Xaa locations
MADAKQQQAAAPTGVWKTIKPFVNGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGSPAIXLIRMXADSTYQHTRXHYKNAXMHLRXRDASCL

SEQ ID NO: 42848 - protein, 398 aa, Burkholderia sp. 383
MSSNRGVVYLGPGQVEVQKIDYPKMVDPSGRAIGHGVILKVVSTNICGSDQHMVRGRTTAPVGLVLGHEITGEVVEIGRDVETLKLGDLVSVPFNVACGRCAMCKDTHTGVCLNVNPSRAGGAYGYVDMGGWIGGQAEYVLVPYADFNLLKFPDRDQAMSKIRDLTCLSDILPTGYHGAVSAGVKPGSTVYIAGAGPVGMAAAASARLLGAAVTIVGDMNAERLAHARAMGFETVDLSKDASLGEQIEQILGVPEIDCAVDCVGFEAHGHGSSGHSEEAPATVLNSLMEITRPAGAIGIPGLYVTDDPGAKDKAAQHGSLSIRFGLGWAKSHSFFTGQTPVLKYNRNLMQAILFDRLPIAKIVNVEVISLDQAPEGYKKFDGGAPRKFVIDPHGLLAA

SEQ ID NO: 42849 - protein, 340 aa, Burkholderia sp. 383
MSTESALQATIQALVQDGKGLLAADESGPTIAKRFKTIAVESTEENRRAWRTLLLSTPGLGEFVSGVILYEETLGQCADDGTPLPELAARQQIVPGIKVDAGKIPLALAPGDEITQGLDGLAARLDGYQRQGARFAKWRAVYNVSATLPGHAAIQANAEALARYAAICQEAGVVPIVEPEVLMDGDHSIGRCAQVTDAVLHAVFDALHRHRVVLAHMLLKPSMVVAGSTHTAQPAPAEVAEATVRLLRSAVPAEVPGIFFLSGGQTPEEATAHLDAMNRVAGRPWLLSFSYGRALQEPPLAAWQGQAANVRAAQDALLLRARLNGAACRGQYDAAMERTP

SEQ ID NO: 42850 - protein, 900 aa, Polaromonas sp. JS666
MNDSTPHHLLMQTADAFTPDPDPQETAEWREAFEALAATQGPARARHMLDELSRVARNRRIGWQPELSTPYMNTIGVNEQPVFPGDLALEERLASLMRWNALAMVVRANQAELGGSSELGGHIASYASAADLFETGFNHFFHAREGTGEIDGVKQHRGDLVFFQPHSAPGVYARAYLEGRLTEKDLSFYRQELTAPGQGAQGLSSYPHPYLMPGFWQFPTGSMGIGPISSIYHARFMRYLTHRRLLDCSGRKVWGVFGDGEMDEPESMSALTLAAREGLDNLVWVVNCNLQRLDGPVRGNGRIIDELEKLFAGAGWNVIKLVWGSDWDGLFARDLTGALTQAFAHTVDGQMQTFAAKDGRFNRDNFFGQNEELARLAQGMTDEQIDRLKRGGHDLVKIHAAYAAAANHKGQPTVILAHTKKGYGMGSAGQGKMTTHSQKKFDETDLLEFRNRFNLPLTDEQAKHIAFYKPADDSPEMRYMHAQRAALGGYLPKRDTTAEVIPVPALPSYAQFALGAAAKEMSTTMAFVRMLGSLLKDPALGPKIVPIVADEARTFGMANLFKQVGIYSSVGQRYAPEDIGSVLSYREALDGQILEEGISEAGALASWTAAATSYSVHGLAMLPFYIYYSMFGFQRVGDQIWAAADQRARGFLLGATSGRTTLGGEGLQHQDGSSHLIAATIPNCKAYDPAFACELAVIIDRGMREMMVEQKDVFYYVTMMNENYAQPDLRPGSEADIIRGCYQFNSYQGPASEGKSAKNPQHVTLMGSGAILTEVIKAAQQLADQGIHATVYSVTSWSELARDGAACQQRMLNGEGMTEGAKTDAFIRQQLHASQGPIIAATDYVRAVPESIRAFLPEGRAYLTLGTDGFGRSDTRAALREFFGVNAQSIVNAARHLLKA

SEQ ID NO: 42851 - protein, 377 aa, Isatis tinctoria
MADGEDIQPLVCDNGTGMVKAGFAGDDAPRAVFPSIVGRPRHTGVTVWMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELETAKSSSSVEKNYELPDGQVITIGAERFRCPEILFQPSLIGMEAPGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 42852 - protein, 433 aa, Haemophilus somnus 2336
MAKIVKVIGREIIDSRGNPTVEAEVHLEGGFVGLAAAPSGASTGSREALELRDGDKARFLGKGVLKAVSAVNNEIATALVGKEASNQAEIDQIMIELDGTENKSKFGANAILAVSLANAKAAAASKGMPLYAWIAELNGTPGVYSMPLPMMNIINGGEHADNNVDIQEFMIQPVGAKTLKEALRIGAEVFHNLAKVLKGKGLSTAVGDEGGFAPNLESNAAALACIKEAVEKAGYVLGKDVTLAMDCASSEFYNKENGMYEMKGEGKSFTSQEFTHYLEGLCKEYPIVSIEDGQDESDWDGFAYQTKVLGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGEKAPFLGLKAVKGQA

SEQ ID NO: 42853 - protein, 638 aa, Azoarcus sp. BH72
MNAKEHFIATEAKVDEAAIAPLPNSRKIYVEGSRPDIRVPMREIRQSDTPASFGAEPNPPIFVYDCSGPYTDPAAKIDIRSGLPALRAGWIAERGDTEQLADLSSEYGRQRAADPRLDELRFPGLHRKPLRARAGANVTQMHYARRGIVTPEMEYIAIRENLRRKDYLESLLAAGPTGQKMAALLTRQHPGQNFGAAIPNEITPEFVRDEVARGRAIIPANINHPETEPMIIGRNFLVKINANIGNSALGSSIAEEVDKMTWSIRWGGDTVMDLSTGKNIHETREWIIRNSPVPIGTVPIYQALEKVDGKAEDLTWEIFRDTLIEQAEQGVDYFTIHAGVLLRYIPLTANRMTGIVSRGGSIMAKWCLAHHKESFLYTHFEDICEIMKAYDVAFSLGDGLRPGSIYDANDEAQLGELKTLGELTDIAWKHDVQVMIEGPGHVPLHMIKENMDLQLEQCKEAPFYTLGPLTTDIAPGYDHITSGIGAATIGWYGTAMLCYVTPKEHLGLPNKQDVKEGIITYKLAAHAADLAKGHPGAQIRDNALSKARFEFRWEDQFNLGLDPDKAKEFHDETLPKESAKVAHFCSMCGPHFCSMKITQDVRDFAAQQGVDEAEALQKGMEVKAVEFVKSGAEVYRNV

SEQ ID NO: 42854 - protein, 346 aa, Pasteurella multocida subsp. multocida str. Pm70
MIQNILLLQINGKLKIKRKSYVIIPPVFMSIKDSEMNYLQIARETLAVEEQALARLGQRLDTHFNEIVELILQCQGRLVIGGIGKSGLVGKKMVATFASTGTPSFFLHPTEAFHGDLGMLKPIDIVMLISYSGETDDVNKLIPSLKNFGNKIIALTGNPNSTLAKHSDYVLDISVEREVCPNNLAPTTSVLVTMALGDALAVALIKARDFKPADFARFHPGGSLGRRLLCRVKDEMQTRLPVTRLETSFTDCLSIMNEGRMGVALVMEQNQLKGIITDGDIRRALTANGAETLRKTAQDLMTSNPKTIHQDAYLAEAEAFMKEKKIHSLVVINDQQNVVGLVEFTS

SEQ ID NO: 42855 - protein, 586 aa, Vicia faba
MCGILAVLGCSDDSQAKRVRILELSRRLKHRGPDWSGLHQHGDNYLAHQRLAIVDPASGDQPLFNEDKSIIVTVNGEIYNHEELRKQLPNHTFRTQCDCDVIAHLYEEYGENFVDLLDGIFSFVLLDTRDNSFIVARDAIGVTSLYIGWGLDGSVWIASELKGLNDECEHFEVFPPGHLYSSKEREFRRWYNPPWFNEAIIPSTPYDPLVLRTAFEKAVIKRLMTDVPFGVLLSGGLDSSLVASVTARYLADTKAAKQWGAKLHSFCVGLKGAPDLKAGKEVADFLGTVHHEFQFTIQDGIDAIEDVIYHTETYDVTTIRAATPMFLMSRKIKSSGVKMLISGEGSDEIFGGYLYFHKAPNKEEFHQETCRKIKALHRYDCLRANKSTYAWGLEARVPFLDKDFIKAAMDIDPEFKMIKHDEGRIEKWILRKAFDDEENPYLPKHILYRQKEQFSDGVGYGWIDGIKDHAAKHVTDKMMFNASHIFPFNTPNTKEAYYYRMIFERFFPQNSARLTVPGGPSVACSTEKAIEWDASWSGNLDPSGRAALGVHVSAYENQINPITKGVEPEKIIPKIGVSPLGVAIQT

SEQ ID NO: 42856 - protein, 886 aa, Magnetococcus sp. MC-1
MSTEKFVYVFGNGQAEGDAGMSHLLGGKGANLAEMTRLGIPVPAGFTLCTEVCGLYLQKRRYPELLKEQVNEALLKVQSAMGAGFGSGDDPLLVSVRSGARVSMPGMMDTVLNLGLNDHTVQGLIKRTGDARFAYDSYRRFVQMYADVVLGVDHHHFEAMLNALKQQTGKVQDTDITADEWKSLVAQYKNKVLEVTQKPFPEEPQDQLWGAIGAVFDSWTIPRAITYRRLNEIPESWGTAVTVQAMVFGNMGTDCATGVAFTRDPSTGHNRFFGEYLINAQGEDVVAGIRTPQQITLEGKRLNGSTLPAMEEAMPELYKELYAVQNRLEMHYREMQDIEFTIQRNKLWLLQTRTGKRTAKAALKIAVNMVHEGLINTREAVSRVSPESLNQLLHPTLDPKADKRIIAKGLAASPGAATGRVVFEADEAEQWAATGQMVILVRDDTSPEDIHGMHSAKGIITARGGMTSHAAVVARGMGRPCVSGCAGLSINMENEQFSVGGVTVAKGDWVTIDGSTGEVMLGQVPTVPPELSGDFTAFMEWVDGFTRMKVRANADTPDDARMARSFGAQGIGLCRTEHMFFGAERIIHVRGLILAQTESDRMRAIDKILPLQRSDFAGLFREMKGYPVMIRLLDPPLHEFIPHDEEGQNEVALVFGMPIDKVRERVASLKEFNPMLGHRGCRLGISFPEIYEMQVRAIMEAACQLVKEEGFIITPEIMIPLVGLESELSYLRERVVAVCETVMGENSVRIPYMIGTMIELPRAALIADQLAKSGEFFSFGTNDLTQTTMGISRDDAGPFLQEYVQKNLLPKDPFISIDQDGVGQLVRLAAEKGRSTRPEIKLGVCGEHGGDPESIHFFEKVKLDYVSCSPFRVPIARLAAAQAVLA

SEQ ID NO: 42857 - protein, 172 aa, Deinococcus radiodurans R1
MGVSGSGKSTVARALAERLGWAFAEADKFHPPENVAKMQGGTPLTDEDRWPWLRAIRDWLTQEAQAGHSTVVTCSALRRSYRDVLREAAGEVRFVHLTGTRDLLAERMGHRQGHFMPASLLDSQLATLEVPGPDEHALTLNIGAAPDELVREVLAGLQLGSTASLSSRPGRD

SEQ ID NO: 42858 - protein, 1028 aa, Thermus thermophilus HB27
MPPRRDLKKILIIGSGPITIGQAAEFDYSGTQAVKALRGAGYRVVLVNSNPATIMTDPELAERTYIEPLDLEHLEGILAREAPDALLPTLGGQTGLNLAMALYEEGILQKYGVELIGAKAEAIRKGEDREAFQEAMRRIDLEVPRGQLVGSVEEGLHFAREVGFPVVVRPSFTLGGTGGGIAHDEAELVEVLSRGLTLSPVHTALVEESVLGWKEFELEVMRDHADTVVIITSIENVDPMGVHTGDSITVAPAQTLSDVEYQRMRDAAKAIIREIGVETGGSNIQFAVDPKTGRQVVIEMNPRVSRSSALASKATGFPIAKIAALLAVGYRLDELPNDITRKTPASFEPTIDYVVVKIPRFAFEKFRPLRNTLGELKDELTTQMKSVGEVMAIGRTFKEALMKALRGLERDVRALAGVRTEELEKKLYPNPDRVYAVMELLRRGMPVEELYQATRIDPWFLHQMKEIVEAEEWLKTHPPKDREDWRFYKGLGLTDRRIGELLGKGEKEVRAERKALGVVPVYKTVDTCAAEFEAYTPYHYSTYELEDEVWPSQKPKVVILGSGPIRIGQGVEFDYATVHAVWALKEAGFETIMVNSNPETVSTDYDTADRLYFEPLTLEDVLNIVEHEKPIGVIATLGGQTPLKLAKGLEEAGVRLLGTPFSAIHQAEDREAFHALCQRLGIPQPEGRVAQSPEEALRLAPEVGFPLLVRPSYVLGGRAMQVVRDEGELKRYLEEVYAPLEERPSILLDRFLEGAIELDVDALSDGQEVMVAGIMEHVERAGVHSGDSATLLPPVHVPEEALKKVRDYTRRLALTLGVRGLLNVQYAVVGEEVYVLEANPRASRTVPFVSKAIGVPLAKLAALIAVGKTLKELGVRDLDPVPPYYAAKEVVIPWIKFPGVIPELGPEMRSTGESMGIDQDPYLAYYKAELGAGQRLPLSGQVRFIGEGLEDLKALYQEAGFALTEGQDYDLLISLVPDPELRRAVERGLPFITTREGAWWSLKAILRARESGLRVQSLQDWHQKAPRG

SEQ ID NO: 42859 - protein, 327 aa, Prochlorococcus marinus str. AS9601
MAGTLLFNALKEAIDEEMANDVNVCVMGEDVGQYGGSYKVTKDLYEKYGELRVLDTPIAENSFTGMAVGAAMTGLRPIVEGMNMGFLLLAFNQISNNMGMLRYTSGGNYKIPAVVRGPGGVGRQLGAEHSQRLEAYFHAVPGIKIVACSTPTNAKGLMKAAIRDDNPVLFFEHVLLYNLSEELPEGDYTCALDQADVVKEGRDITLLTYSRMRHHCLKAVEELEKKGIDVELIDLISLKPFDMETISKSIKKTNKVIIVEECMKTGGIGAELIALITEECFDDLDARPIRLSSQDIPTPYNGNLENLTIIQPHQIVEKVEHLISGSI

SEQ ID NO: 42860 - protein, 331 aa, Methanothermobacter thermautotrophicus str. Delta H
MYRITVIPGDGIGVEVMEAALHVLQALEIEFEFTHAEAGNECFRRCGDTLPEETLKLVRKADATLFGAVTTVPGQKSAIITLRRELDLFANLRPVKSLPGVPCLYPDLDFVIVRENTEDLYVGDEEYTPEGAVAKRIITRTASRRISQFAFQYAQKEGMQKVTAVHKANVLKKTDGIFRDEFYKVASEYPQMEANDYYVDATAMYLITQPQEFQTIVTTNLFGDILSDEAAGLIGGLGLAPSANIGEKNALFEPVHGSAPQIAGKNIANPTAMILTTTLMLKHLNKKQEAQKIEKALQKTLMRGIMTPDLGGTASTMEMAEAIKEEIVKGE

SEQ ID NO: 42861 - protein, 121 aa, Chlamydophila pneumoniae CWL029
MVNLLKELEQEQCRNDLPEFHVGDTIRLATKISEGGKERVQVFQGTVMARRGGGSGETVSLHRVAYGEGMEKSFLLNSPRIVSIEIVKRGKVARARLYYLRGKTGKAAKVKEFVGPRSSKK

SEQ ID NO: 42862 - protein, 202 aa, Crocosphaera watsonii WH 8501
MLKSNLFSLSLPSMIAVSCLIGFSVSESVSAQILAQETPSEGTEVPEDDPSDPSNLRPLTQADSLLSLQGGEKLMNEAGEAINQENYDLAVTKLQQARKVFNQLSNFYLQLANSFSGIDTEVYDSQRDSALKTGQMRDAATYQLALVHRAQDQPELAVPLLVQIIRSQNPTTDLGKKSYQQLYELGFVDVPFADEAQATSSN

SEQ ID NO: 42863 - protein, 323 aa, marine gamma proteobacterium HTCC2143
MLRLRSQLQAKKLPPDLVTLIDTIAIAGKDIAFRLQQGAMSGVLGSAEKENVQGETQKKLDVISNDLLKTYLLESNTVRGIASEEEENIVAGHDHAKYLVAFDPLDGSSNIDINSMIGTIFSILHAPTTETVSQADFLQPGRNQCAAGYILYGPSVMLALTTGNGVQMYTLDQRIGEFLLTTDHVVIGKDTQEFAINMSNQRSWAVPMQNYVNDLLAGSEGPRGKNYNMRWVAAMVADVHRILCRGGLFAYPWDNREPKTPGKLRLMYEANPMGMLVEQAGGSAWTDVGPILDIQPETIHQRVPVILGSINEVTACVGYHKNN

SEQ ID NO: 42864 - protein, 324 aa, Clostridium thermocellum ATCC 27405
MSSVRTIGVLTSGGDAPGMNAAIRSVVRTGLYYGFKVLGIRKGFNGLINGDIEELTARSVGDIIHRGGTILQTARSPQFKTEEGLKKAMSMAKVFGIDALVVIGGDGSYRGARDISKLGLNVIGIPGTIDNDIGCTDYTIGFDTAMNTVQDAIDKIRDTAYSHERCSVLEVMGRHAGYIAVNVSISGGAEAVVLPEKPFDMDTDVIKPIIEGRNRGKKHYLVIVAEGGEGKAIEIAKEITEKTGIEARATILGHIQRGGSPTVYDRVMASQMGAKAVEVLMENKRNRVIVFKDNQIGDMDLEEALQVKKTISEDLIQLSKILAL

SEQ ID NO: 42865 - protein, 582 aa, Arabidopsis thaliana
MAMIGMNIIGLFMVLMLLLSSPSSSFSACKPWRYFSRFRSSSRFSSTFKVGDLQRPLISDDGNLIQGQTSEVTREYDLEGACYQNDGLLHSSLTEGRFYKQRLPSSSPHFSQGESFVLEVISEPSDNALVGQTLKLPAEKGSLAEVQTYDWQNNRNENLQYNLEKDRLINLSPRLVEDQRSWLFLEVIAGPAIGLQHAVNSTSSSKLPVKLGRVSPSDLALKDSEVSGKHAQITWNSTKFKWELVDMGSLNGTLVNSHSISHPDLGSRKWGNPVELASDDIITLGTTTKVYVRISSQNEFQIPFKIGVASDPMAMRRGGRKLPMEDVCHYKWPLPGANKFGLFCVCDGHGGSGAAQSAIKIIPEVLANILSDSLRKEKVLSKRDASDVLRDMFAKTEARLEEHQYEGCTATVLLVWKDNEENFFAQCANLGDSACVIHLGGRYIQMTEDHRVVSLSERKRFQEAGLALRDGETRLFGINLARMLGDKFPKQQDSRFSAEPYISEPLRIDQSSKDVFAVLASDGLWDVVSPKKAVQLVLQMRDKERGRESSAEKIANGLLNEARAMRTKDNTSIIYLDFDTSL

SEQ ID NO: 42866 - protein, 407 aa, marine gamma proteobacterium HTCC2143
MSDSQREFEIILWGASGFTGRLVADYLYANYGQGNELRWALAGRNQSKLEGIVEEIAGAKDALPIVIADSGDLAAMKAMAARTQVICTAVGPYALYGTNLVAACVEKGTDYCDLTGELQWMKRVIGEYQSEAELSGARIVHTCGFDCIPSDMGVYYLQQQMQQVHGVSAAQIKLRTKAFAGGFSGGTVYSMMNMMDEADSDPEIVTTLADPYALNPPGSHRGEDVNDQTTAIYDEDFTSWTSPFAMAGINTRVVRRSNALMNYAYGEDFRYDEATLSDSSIKARAAALAGNMVMGSMAVTPLRKMAAGLLPAPGEGPSKTKRENGFYEIWLHGRHPNDRSKDLRAIVKGDMDPGYGSTSKMLAECAVCLARDDVEVAGGFWTPASALGNHLLARLQEHAGLSFTLND

SEQ ID NO: 42867 - protein, 105 aa, Glycine max
  misc_feature (21)..(21): Xaa can be any naturally occurring amino acid
  misc_feature (45)..(45): Xaa can be any naturally occurring amino acid
  misc_feature (48)..(48): Xaa can be any naturally occurring amino acid
  misc_feature (55)..(55): Xaa can be any naturally occurring amino acid
  misc_feature (62)..(62): Xaa can be any naturally occurring amino acid
  misc_feature (69)..(70): Xaa can be any naturally occurring amino acid
  misc_feature (75)..(75): Xaa can be any naturally occurring amino acid
  misc_feature (77)..(77): Xaa can be any naturally occurring amino acid
  misc_feature (92)..(92): Xaa can be any naturally occurring amino acid
  unsure (1)..(105): unsure at all Xaa locations
ETLNPYQSERSLLSPTALAGXMTMLQASLDMKAIVLGKYHYGVYXLGXGRHRRMXLTRGESXKPLAGPXXAGQAXNXVGQRRWPKNNAGCEXNAAGGARPAGDQG

SEQ ID NO: 42868 - protein, 378 aa, Burkholderia pseudomallei K96243
MPQTAEAPPQRAAERGETPALPATMRAVVCHGPQDYRLEQVPVPKPGPDEILTQVERVGICMGDIKTFRGAPSFWGDAVQPRYVKPPMIPGHEFVCRVVALGPGAERRGVKAGDRVISEQIVPCWSCRFCGHGQYWMCQKHDLYGFQNNVHGAMAEYMIFTKEAIVHRVPDSIPTDEAILIEPLSCSLHAADRANVGFDDVVVVAGAGTLGLGIIGAVRLRHPKQLIVLDMKPERAALARRMGADDVWNPAEENVIEKIRAITGGYGCDIYIEATGHHRAVGQGLAMLRKLGRFVEFSVFNDEASVDWSIIGDRKELDVLGSHLGPYMYPRAIEFIASRRIDVRGIVTHTFPLSRFADAFAVMERGEQSLKVVLDPRG

SEQ ID NO: 42869 - protein, 177 aa, Brassica napus
ARGESLPLEFETNKIILKLEIVKVVEVVDWNEMIEFNGFQIHYSQIEPVNSLFLDHRGFTHKFRLKNELLKTTYMNVLLALVETLNKPQHSLTETELSNARSDLVELTEAGFKLNWLKTMLDEVSFDGNKGNFADHGSQVEQHIKEKVEAARDWLEGAIHSWKGHLGFVHLRNEKID

SEQ ID NO: 42870 - protein, 391 aa, Magnetococcus sp. MC-1
MAYQPDRSQYPQRRVDGRLDIDLASGKYLKLWHGPQHPGITGNMSVELTLCGDEIVDAKTHVGYLHRGFEKLMERRTFIQCFPIVCRVCVPEPDFNEYCYAAAVEELAGIECPERARWIRTLILEMGRINSYLMYLGGQSGAFGMGVIGQWTTYIRDLMLDRFEELTGARIYHMFILPGGVRDGLPEGFEQRMEETLRELESTMKDVRDVLFHNAVFKKRSVGVGVIDPAWLEPYGVTGPNARAAGVAKDVRIDQPYLVYPELSYEAIVGKDSDIYTRADVRYRDLLQSVDLIRQILARMPHEGPVMAKLPNVLHWKIPQGETYIRGECSRGEYGYYVVTDGSGYPRRINVRGPSYTHAVALLEHMIINQNISDVAGLMVSLHTYPPEVER

SEQ ID NO: 42871 - protein, 450 aa, Bordetella parapertussis 12822
MAFDFDLYVIGAGSGGVRAARFAAGYGARVAVAESRYLGGTCVNVGCVPKKLLVYGAHFHEDFEQAAGFGWNPGRPEFDWPTLIANKNREIERLNGIYRNLLVNSGVALHEGHARIVDPHTVEINGQRHSAQHILVATGGWPFVPDIPGKEHAITSNDAFFLPELPRRVLVVGGGYIAVEFASIFNGLGAQTVQVYRRELFLRGFDGSVREHLRDELVKKGLDLRFNTDVERIDKRADGVLAVTLSDGSVLETDCVFYATGRRAMLDDLGLENTGVRLAESGYIEVDDEYRTSEPSILAIGDVIGRVPLTPVALAEGMAVARRLFRPQEYRKVDYDLIPTAVFSLPNIGTVGLTTEQALEHGFRVTRYESRFRPMKLTLTQSQKKTLMKLVVDADSQKVLGCHMVGPDAGEIVQGLAVALKAGATKQVFDDTIGIHPTAAEEFVTMRTAT

SEQ ID NO: 42872 - protein, 382 aa, Oceanospirillum sp. MED92
MDYPSSKLPSVGLTIFSQMTALANQQKAINLSQGFPDFDGPKPLLDAVGRFIAEGKNQYAPMAGLPELCQAVSDKVFRCYGRKLEAESEVTITSGATEAIFAAISATVNAGDEVIVFDPAYDSYEPAVTLNGGTTVHIPLLPPQFAIDFQRLQDAITLRTRMIIFNSPHNPTGSVMSSEDLLQLEQLLEGTNILLLSDEVYEHIIFDNQVHQSFNRSPMLAERSFIVSSFGKTYHVTGWKVGYCVAPEALMKEFRKVHQYLTFSTSTPMQAAIAEYMQSDAEHDQNLPVFYQQKRDLMNERLSSSRFGIMPSPGTYFQLLDYTAISDLSDQEFVLWLLKEAGVATIPLSPFYKDGTQTGMVRLCFAKSSDTLEKAAEQLCRI

SEQ ID NO: 42873 - protein, 389 aa, Oryza sativa
MLGIARRRLGSGCALGQLMQALRPAAAAAAARTYSAAAKEMTVREALNSALDEEMSADPSVFLMGEEVGEYQGAYKISKGLLDKYGPDRVLDTPITEAGFTGIGVGAAYQGLRPVVEFMTFNFSMQAIDHIINSAAKSNYMSAGQINVPIVFRGPNGAAAGVGAQHSQCYAAWYAHVPGLKVLTPYSAEDARGLLKAAIRDPDPVVFLENELLYGESFPVSAEVLDSSFCLPIGKAKIEQEGKDVTITAFSKMVGYALQDVREPQMKEKDVKFQAAEILSKEGISAEVINLRSIRPLDRATINASVRKTNRLVTLEEGFPQHGVGAEICMSVVEDSFEYLDAPVERIAGADVPMPYAANLERMAVPQVEDIVRAAKRACYRAVPMAATA

SEQ ID NO: 42874 - protein, 473 aa, Prochlorococcus marinus str. AS9601
MSKSPQDVLSQIKDEGIELIDLKFTDIHGKWQHLTLTSDMIEEDSFTEGLAFDGSSIRGWKAINASDMSMVPDASTAWIDPFYKHKTLSMICSIQEPRSGEPYDRCPRALAQKALKYLDSTGIADTAFFGPEPEFFLFDDVRYDSKEGGCFYSVDTIEAPWNTGRIEEGGNLGYKIQYKEGYFPVAPNDTAQDIRSEMLLLMGELGIPTEKHHHEVAGAGQHELGMKFDSLINAADNVMTYKYVVRNVAKKYGKTATFMPKPVFNDNGTGMHVHQSLWKSGQPLFFGEGSYANLSQTARWYIGGILKHAPSFLAFTNPTTNSYKRLVPGFEAPVNLVYSEGNRSAAVRIPLTGPSPKAKRLEFRSGDALANPYLAFSVMMLAGIDGIKNQIDPGDGVDVDLFELPADELAKIDTVPSSLNDSLNALKADKDYLLAGGVFTEDFIDNFIDIKYEEVQQLRQRPHPHEFFMYYDA

SEQ ID NO: 42875 - protein, 207 aa, Zea mays
  misc_feature (126)..(126): Xaa can be any naturally occurring amino acid
  unsure (1)..(207): unsure at all Xaa locations
GSEGYGATAYVTFKERFALETAVLLSGATIVDQPVCITYWGQPEGTFNFWDRPTWEVEEEIEYRNYQTCQYNTTPQEAFTVAQDIMKTMLEKGYVLSKDALAKARAFDESYGLTAAAAARAAELSXKRIGLTDRVNAGVGAMRSVDETYRVRETTKTVATATGRTAAKVVNGIVTSSYFSAGAMILSDALTRAAKAAADLAAHGRQN

SEQ ID NO: 42876 - protein, 473 aa, Mycobacterium smegmatis str. MC2 155
MTNHEYDRTTLYIDGQWVAPAATGTIDVVDPATEEVIGHVPGGTEADVDVAVAAARRAFDPLIGVDERRQRLDAVITAMEKRLPQIAETITREMGAPIRISQTVQTQVPLAVARGFADALADFEFSERIGNSLVVREPYGVVSAITPWNYPLYQVVAKVLPAIAAGCTVVLKPSNEAPLSVFEFVEALDDAGLPPGVVNLVSGPGSVIGERMAAHPDVDFVSFTGSTEVGARVGELAGRNIKKVALELGGKSANVILDGADLATAVRVGVGNAFLNGGQTCMAWTRMLVPLSRYSEALDLVAAAVAKYTVGDPWDPATRIGPSASQRQFETVLGFIERASRDGARLVAGGPEKIRDTGYYVAPTVFADVLPDSDLGQEEVFGPVLAVIPFRDSDEALEIANGTPYGLSGAVWAADDDTAIAFARQVQTGQLDINGGKYNPAAPFGGYKKSGVGRELGRFGFEEYLQTKSLQLP

SEQ ID NO: 42877 - protein, 243 aa, Crocosphaera watsonii WH 8501
MAVGKIIIAGNWKMHKTQAEALEFLTVLKSKVEETNETREIVLCVPFTALSILSKSLHGGKVRLGAQNVHWEDKGAYTGEISGPMLTELSVDYVVIGHSERRQYFSETDETANLRVITAQRHGLTPILCVGESKQQRDAGEAESVIINQLQKGLVDVDQSNLVIAYEPIWAIGTGDTCESTEANRIIRVIRDQLSNKNVTIQYGGSVKPNNIDEIMAQSDIDGALVGGASLDPVNFARIINYQ

SEQ ID NO: 42878 - protein, 517 aa, Mycobacterium smegmatis str. MC2 155
MTTSFDLIELKRVLGGLWGAQDPTDSTMAALKRGVHGEEAMLIAGELVTASHGKTFDNVNPATGQVIGAVADAGAADVDRAIDAARRAFDESSWPHDAEFRRHCLLQLHKAMAESADQFRATAVAEIGVAVRTTNTFHSDWPISSIPYWADMATNFEYEHTMPDRPWASGTRHVIRQEPIGVVAAITPWNFPLQTAMTKILPALAAGATVVLKPAFQTPWHATLLARLIAEKTDIPAGVINVVTPSDNAVAERLAVDPRVDLVHFTGSTAVGKKLMADASGRVARVALELGGKSANILLEDADFTQIVPQAAGVVCMNAGQGCVLPTRLLVPRSRYDEARELARITFEHMPFGDPTDPGTVQGPQISKVQQDRVLGLIAQGVAEGATLLTGGRIPDGFDGGFFVEPTLFADVDPHSTIAQREIFGPVLAMIPYDNVEHAIDIANNTSYGLAGYVWGDEDAAVTVARRIRSGMVAVNGGFFYGHDVPSGGYKESGLGRESGVEGFQEFLETKVIAVAG

SEQ ID NO: 42879 - protein, 177 aa, Lolium perenne
MAGRDRDPLVVGRVVGDVLDPFIRTTNLRVTFGNRAVSNGCELKPSMVTHQPRVEVGGNEMRTFYTLVMVDPDAPSPSDPNLREYLHWLVTDIPGTTGASFGQEVMCYESPRPNMGIHRFVLVLFQQLGRQTVYAPGWRQNFNTRDFAELYNLGPPVAAVYFNCQREAGSGGRRMYN

SEQ ID NO: 42880 - protein, 585 aa, marine gamma proteobacterium HTCC2143
MDKFYMPSLYQENHRIDNSVDDLIAAMSAPGADYAMTPKEIDGVSYQVFENRQPNLRGAFAIGEMHGDADFLVYEKERWSFAEGMQEAWNFASVLADKFGVKKGDRVALVMRNYPEWCMSYIAATSMGAVIVPMNGWWTTEELDYALRDCDATVVIADKERVERLKPLIDDVGFEIIAVRCTGEQPRGIQHYADVMNDAVDKPMPDVDIDELDDAMILYTSGTTGHPKGAVSTHLAVATVVQAWTVLTIATVTAQMQKDAAEGKAPNPNAPQPSALVAVPLFHVTGCNAVFLISIVVGRKLVLMHKWDATRALEFVQEEKITSFTGVPTMSWEMVTHPDVEKYDLSTLTGLGSGGAARPPEQVRQMAEKFPDAPPSSGYGLTETNAMGAINSGSNYLAKPGSTGRPTAPVVSIKIVDEAGSEVPQGERGEILIKSATNIRGYWNKPEKTAEDFVNGWFHTGDIGLMDEDGFLWVVDRLKEIVIRGGENISVTEVEQIIHQHPSVMEVACYGVPDARLGEALAASIMIVPGTTLTEEDVKTQVREHLAVFKIPAYVIIQATQLQRGATDKIFKRGIREVTIEQLGL

SEQ ID NO: 42881 - protein, 191 aa, Triticum aestivum
  misc_feature (85)..(85): Xaa can be any naturally occurring amino acid
  unsure (1)..(191): unsure at all Xaa locations
MSSSFCMQPSKFSFYDASKPMYTSRRNLPPSMISTSKITDSIISHGCFLDKCRVEHSVVGIRSRIGSNVHLKVRPLACKNHKQKXGSIIAFHNSKCGSPFLQDTVMLGADFYETDMERCDQLAEGKVPIGIGENTSIQNCIIDKNARIGKNVTIANAEGVQESDRASEGFHIRSGITVVLKNSVIADGLVI

SEQ ID NO: 42882 - protein, 123 aa, Zea mays
LGDLLSPLQSSFGGDEISTDDGFLFADTRLLTVYFLIRVFRPESSGSRSSSWFGTSRARTHPSGRRRFSRPASLWGESYEGNTGTSPRDEENNQSFDEQVFGTRRRRFRRRTVIDDDDEEEEP

SEQ ID NO: 42883 - protein, 593 aa, Oryza sativa (japonica cultivar-group)
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILVRMFPVWATTIVFSAVYAQMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 42884 - protein, 562 aa, Pseudomonas syringae pv. syringae B728a
MQADFWDDKRPAGVDAEVDLQTYQSVVDVFERCCRKFADRPAFSNMGVTLTYAELERHSAAFAAYLQQHTQLVPGDRIAVQMPNILQYPIAVFGAMRAGLTVVNTNPLYTAREMRHQFKDSGARALVYLNLFGKLVQEVLPDTAIEYLIEVKMGDMQSAAKGWLVNTIVDKVKKMVPEFHLPQAVGFKRALRLGRDSRMQVVPRGLQDVAVLQYTGGTTGLAKGAMLTHGNLVANMQQVYACMRQQGPRGGSLFEEGKEVMIAPLPLYHIYAFTANCMCMMISGNHNILITNPRDIGGFIKELGKWQFTAMIGLNTLFVALMNHPEFKKLDFSALKSTNSGGTALVKATAERWAQITGCTIVEGYGLTETSPVASANPYGTMARLGTVGIPVPGTAMKVIDDNGVELPFGERGELCIKGPQVMKGYWNQPDATAECLDAEGWFKTGDIAVIGADGFVSIVDRKKDLIIVSGFNVYPNEIEDVVMAHPKVANCACIGVPDERSGEAVKLFVVARDPGLSIEELKAFCKENFTGYKVPRQIVLRDSLPMTPVGKVLRRELRDIA

SEQ ID NO: 42885 - protein, 129 aa, Triticum aestivum
MAMSWTRALKHGVTPRDAAQLVGIRGFAAQAKGKKGGKGGAADAKPVLSKEMKSTTVFGANILKEGSDPKIQPDSEYPDWLWHLVDKRPVLSELRRKDAKTLPYEDLKRFVKLDNRARIKENNALTAKN

SEQ ID NO: 42886 - protein, 332 aa, Oceanospirillum sp. MED92
MATAFGSVFMPEMSITWFDGSSWSAVEMVPSDSISMHPGAHVLHYSSTCFEGLKAFRHEDGSVKIFRIDRNVSRMAQSARLLALPELDEEFMTKMILDTVTRFKSDVPAPPGSMYIRPTLFGTEPAIGKAAAPSETACFYVLLSPVGDYFAGGDRALRLLVDDQGLRCAPHNGMIKSGGNYASALLPTMRAKEKYNVDQVLFCPNGDVQETGAANFLLIDGDEVITRDLDESFLHGVTRDSVLQIARDNGLKVSERRLTVEELLERAAKPGCEAALSGTAAVLAPVGTLVYGDKEYTVGDGGIGETTLKLRKALNDIQWGKAEDKHGWLTDV

SEQ ID NO: 42887 - protein, 578 aa, Zea mays
  misc_feature (419)..(419): Xaa can be any naturally occurring amino acid
  unsure (1)..(578): unsure at all Xaa locations
MGFSFFTSRAGARLLDGIARPGFSTAALLLTAASGGGLVAYADSAAESAPDPSQDAPRKKVVVLGTGWAGTSFLKNLDCSRYEVKVISPRNYFAFTPLLPSVTCGTVEPRSIIEPKNKDVTFCEAECFKIDANRKTVHCRSAVGTNLDGNGDFMLDYDYLVVALGATVSTFNTPGVLEHCCFLKEVEDAQKIRKGVIDCFEKASLPNISEEEKRKILHFVVIGGGPTGVEFAAEMHDFLVEDLVKLYPAIQDLVKITIIQSAEHILTMFDERIASFAEQKFKRDGIEVCTGFRVIKVSDDLITMKRKSDGEELSVPYGMAVWSAGIGTRPVVMDFMQQIGQTNRRALATNEWLRVRECEGVYAIGDCATVSQRKIMDDISTVFKMADKDNSGTLTLKEINGVLEDICIRYPQVELYMKXSMHMLDIADLIKGAVGDSHKESMVVDIEEFKKALRHVDSQVKNAPATAQVAAQQGQYLAQCFNKMEKCREEPEGPLRMAGGSGRHFFRPFRYKHFGQFAPLGGEQAAAELPGDWISMGHSTQWLWYSVYASKQVSWRTRVLVVSDWTRRFIFGRDSSRI

SEQ ID NO: 42888 - protein, 184 aa, Triticum aestivum
QGIYLHSPALAPTLMASSATSVAPFQGLKSTAGLPVSRGSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIASKPPGCEESGKA

SEQ ID NO: 42889 - protein, 509 aa, Nocardia farcinica IFM 10152
MTDTLGTAARTDLGDEAAAVLRALGVDMPPPGDLVARTPITGERLLTLPADTPAEAQAAVERASAAFQRWRTVPAPVRAAVVRRLAELLVAHKADLARLVTLEAGKIRAEALGEVQEMIDICEFAVGLARQLYGRTMPSERPGHRLMETWHPLGVVGVISAFNFPVAVWSWNTAIALVCGDTVVWKPSETTPLTALACHTLLRRAAADVGADPEVHQLIQGDAAVGAVLVDDERVALVSATGSVRMGRAVAPRVAARFGRCLLELGGNNGAIVTPSADLELAARGIVFAAAGTAGQRCTTLRRLIAHVDVVGPLLDRLTRAYRSLAVGDPREDGVLVGPLIGAGAYRDMRAALDRALADGGELVFGGERVPGFGADAFYVRPAIVRMPAQTAIVREETFAPILYVLTYRDFEHAVRLHNGVPQGLSSAVFTTDQREAERFLAADGSDCGIANVNIGTSGAEIGGAFGGEKHTGGGRESGSDAWKAYMRRATNTINYSTELPLAQGVEFG

SEQ ID NO: 42890 - protein, 440 aa, Chlamydophila pneumoniae CWL029
MLNCSNQKHTVTFEEACQVFPGGVNSPVRACRSVGVTPPIVSSAQGDIFLDTHGREFIDFCGGWGALIHGHSHPKIVKAIQKTALKGTSYGLTSEEEILFATMLLSSLKLKEHKIRFVSSGTEATMTAVRLARGITNRSIIIKFIGGYHGHADTLLGGISTTEETIDNLTSLIHTPSPHSLLISLPYNNSQILHHVMEALGPQVAGIIFEPICANMGIVLPKAEFLDDIIELCKRFGSLSIMDEVVTGFRVAFQGAQDIFNLSPDITIYGKILGGGLPAAALVGHRSILDHLMPEGTIFQAGTMSGNFLAMATGHAAIQLCQSEGFYDHLSQLEALFYSPIEEEIRSQGFPVSLVHQGTMFSLFFTESAPTNFDEAKNSDVEKFQTFYSEVFDNGVYLSPSPLEANFISSAHTEENLTYAQNIIIDSLIKIFDSSAQRFF

SEQ ID NO: 42891 - protein, 465 aa, Xanthomonas campestris pv. vesicatoria str. 85-10
MPESSSATAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCALIFGLNTVSARWFAEGEFWFSLIKVVTILVFIVLGGAAVIGLLPLADGSPAPGLRHLRAEGWFAHGALPILMTMVAVNFAFSGTELIGVAAGETAQPARAIPLAIRTTLVRLVVLFVGTVLVLAALLPAKQAAVETSPFVRAFELLGIPYAADILNAVILTAILSAANSGLYAAARMLWSLANEGTLPSGLARLTGRGIPLRAVSLSMLGGLLALLTGVYAPETVFVAISAVSGFAVVVVWLSICAAHYRFRRQLLRDGAALETLAYRAPWYPWTPILGFSLCLLACIGLAFDPQQRIALWCGVPFVALCYGAYALTQWLAARRLHA

SEQ ID NO: 42892 - protein, 332 aa, Arabidopsis thaliana
MVTDFKSLLPVIDISPLLAKCDDFDMAEDAGVVEVVGKLDRACRDVGFFYVIGHGISDDLINKVKEMTHQFFELPYEEKLKIKITPTAGYRGYQRIGVNFTSGKQDMHEAIDCYREFKQGKHGDIGKVLEGPNQWPGNPQEYKDLMEKYIKLCTDLSRNILRGISLALGGSPYEFEGKMLRDPFWVMRIIGYPGVNQENVIGCGAHTDYGLLTLINQDDDKTALQVKNVDGDWIPAIPIPGSFICNIGDMLTILSNGVYQSTLHKVINNSPKYRVCVAFFYETNFEAEVEPLDIFKEKHPRKETSQVAKRVVYGQHLINKVLTTFANLVENS

SEQ ID NO: 42893 - protein, 231 aa, Chlamydophila pneumoniae CWL029
MEKDLHLHEKKCLAHEAATQVTSGMILGLGSGSTAKEFIFALAHRIQTESLAVHAIASSQNSYALAKQLAIPLLNPEKFSSLDLTVDGADEVDPQLRMIKGGGGAIFREKILLRAAKRSIILVDESKLVPVLGKFRVPLEISRFGRSAIIEEIRHLGYEGEWRLQDTGDLFITDSSNYIYDIFSPNSYPNPEKDLLKLIQIHGVIEVGFVIEKVEVWSSNSQGLISKKYSV

SEQ ID NO: 42894 - protein, 331 aa, Triticum aestivum
  misc_feature (37)..(37): Xaa can be any naturally occurring amino acid
  unsure (1)..(331): unsure at all Xaa locations
RGPAEVPYPWLTSTLSLAAGSAIMLVSWATRIAEAPXTDLDFWKALSPVAIAHTIGHVAATVSMAKVAVSFTHIIKSAEPAFSVLVSRFFLGEHFPLPVYFSLLPIIGGCALAAVTELNFNMIGFLGAMISNLAFVFRNIFSKKGMKGKSVSGMNYYACLSMLSLVILLPFAFAMEGPKVWAAGWQNAVAEIGPNFVWWVAAQSVFYHLYNQVSYMSLDEISPLTFSVGNTMKRISVIVASIIIFRTPVQPVNALGAAIAILGTFIYSQVIHLTRLTYLTAYVRKKEASNSEFDTKTLLASCCRQSSKGKPSKRCLFRRESARRRSDTICC

SEQ ID NO: 42895 - protein, 480 aa, Photobacterium profundum SS9
MSSSVETSSKKHNLSYIIRICCIAALGGILLGYDTAVISGAIGPIREYFNLTAAQTGWAVSSVVLGSIIGAISSGWCALKYGRRKALFLAALLFIISAIGSALAATFTIYVLFRIVGGIAVGLACVVSPMYMSEVAPKDFRGRAVSMFQQSAVIGQTGVFYVNYLIAKGMSEAWLVDIGWRWMLASEVLPALLFGSLLIIIPESPRWLVLKGHLDQAKETLSRISNPEHADRVILEIQKSLVPTNASKNNKVSLRSPLLFSILVIGTFVAAAQQLTGINVIMYYTPEILNPIAGGTENALLQTTFVGVVFIFGNALGMYLIDKVGRLPLMKYGTFGCALGMTIVGYVLYTGTEGYAALFALCLYVVAYAASWGCACWTMISEIFPNSIRSRAMAIAVGAQWFTGFIVTQSFPMLNENAYLKEHFNGAFSFWVFAVLSIMCMYVVVKYVPETKGVSLEDMEKVMAEKLGKNKKRQVAEASA

SEQ ID NO: 42896 - protein, 189 aa, Oryza sativa (japonica cultivar-group)
MAETLKPVALLLLILNLCMYVILAIIGGWAVNISIDRGFILGPGLRLPAHFHPMFFPIGNWATGFFVVFSLLAGVVGIASGLVGFSHIRHWNYYSLQPAATTGLLAWALTVLAMGLACQEISLDRRNAKLINSFRMVCELKPWEFGIQGTMEAFTIVLTATQLFYVLAIHSGSRGPVPVERTHAVAAGY

SEQ ID NO: 42897 - protein, 377 aa, Calymmanthium substerile
TDVPAAAAGAFKSYKLAAKAISRLQSLPSHNMALLCDVLVKEVSELTGYDRVMVYKFHEDEHGEVISEYRRPDMEPYLGLHYPATDIPQASRFLLLKNRVRMVCDCLATPVKVIQGKKWAQPLSLGGSILRAPHGCHALYMANMGSIASLVMAVTINEDEDEVKSDPSTGKRLWGLVVCHHTSSRFIPFPLRYACELLVQVFGIQINKEVELAAQIRESHILRIQTVLCDMLLRDSPVAIVTQSPNVMDLVKCDGAALYYKGQVWLLGITPTEEQIKNITQWLLKYHGSTKGLSTDSLMEAGYPGASELGDAVCGMAAVRISSKDVLFWFRSHTAKEMKWGGAKHDPVDSDDGRKMRPRSSFKAFLEVVKWRSQPWE

SEQ ID NO: 42898 - protein, 497 aa, Arabidopsis thaliana
MEMMILISLCLTTFLTILLFFKSLLKRPNSNLPPSPWRLPVIGNLHQLSLHPHRALSSLSARHGPLMLLRFGRVPVLIVSSADVAHDVMKTHDLKFANRPITKSAHKISNGGRDLVFAPYGEYWRNVKSLCTIHLLSNKMVQSSEKRREEEITLLMETLEEASLSSSSVNLSKLITNMVSDIMGKVVLGKKYSGEEGTIDVKTITKSFLDAVGLSPVGEYIPSLAWIGKITGSDGKLEKITKQFGDFIEKVLQEHEDTTADKETPDFVDMLLTIQRDETAQCQLDKSDLEVIIFEMFLGSTTTTSAVIEWAMTRLMRNPECLKKLQDEIRSVSKMNSYVSGKEVENMNYLKAVIKEVLRLHPPLPLLVPRLLSEDVKLKGYDITAGTQVIINAWAIQRDTATWGSDAQEFRPERHFDSTWDFVGRNFKYIPFGAGRRLCPGIGLGSVMASVTLANLVKRFDWRVEDGPSGYDKPDLVEGAGIDVCRKFPLVVFPSSA

SEQ ID NO: 42899 - protein, 331 aa, Photobacterium profundum SS9
MTKIALQQDRPLDAIVLGRAGVDLYAREANTDMADISGFNKFVGGSAANIAVAISKLGGKVGFIGCVADDAFGGYVRGYMTEQGINLDGMMTDNSGSRTSVAFTEMKPNDCTVLIYRNKASDLTLKPEQVDPAYIAQSKMLVVTGTALSESPSREATLIAMEHARRSNTVVVLDVDYRPYSWRTDVDASIYYGIAAGLSDIVIGNREEFDMMETVLAPGNTDDDATADRFLRANTQVVIVKAGELGSKVYCKDGHKFQQGIFRVEVKKPFGSGDSFAGGLIWTLVNGGELEDGVKHGSAAAAINVSGNSCTEAMPTKEVLFDFIETREQDL

SEQ ID NO: 42900 - protein, 377 aa, Talinum paniculatum
TDVPAAAAGAFKSYKLAAKAISRLQSLPSRNMLILCDVLVKEVSELTGYDRVMVYKFHEDEHGEVISEYRKPDLEPYLGLHYPATDIPQASRFLFLKNRVRMICDCLASTVKVIQDQKLTQPLSLGGSILRAPHGCHAQYMANMGSIASLVMAVMINEDEDEVKSDPSSGKRLWGLVVCHHTGSRFIPFPLRYACELLVQVFGIQINKEVELAAQIRESHILRIQTVLCDMLMRDSPIAIVTQSPNVMDLVKCDGAALYYKGQVWLLGITPTEEQIKDITQWLLEYHGSTKGLSTDSLMEAGYPGASELGDAVCGMAAVRISSKDFLFWFRSHTAKEIKWGGAKHDPIDNDDRRKMHPRSSFKAFLEVVKWRSQPWE

SEQ ID NO: 42901 - protein, 338 aa, Cryptococcus neoformans var. grubii
MSVPCISLHDFDDRRDEIIKELMDASMNVGFFTLCNHGISAEDVQAAFDLSNRFFALPDEIKIKTPLNGKNAGWEKNTQVRPSTGTADQKESMQLQFARMEGLWPSDEDVPGFRTRTEKFMNQIQALSIKVMECFADGLGLPHDIFTESTVERGENDCQNVLRLLHYHSTEGKQFGPNLWRAGAHADFDILTMLFQRDGEGGLEVCPGRKVVGDFGMGQTWIPVEPRQDRIVCNIGDQLMRWSDDQLKSTYHRVRLPEGNERKGPRYSIAFFNQSRINTVIQGPQKKYPPITGGEFIAEAMAKNRMQSAEIARHAALETGEKATTEVHFIPKHLQVVA

SEQ ID NO: 42902 - protein, 525 aa, Ipomoea nil
MMMAICSTAVAFIFIIVLSLGCYMILKLRCRSSDDKVVPRNWPLVGMMPALLKNAHRVHEFATDVLKHSGGTFEFKGPAAFANLSMLATSDPANIHHVLSKNFSNYPKGPEFRKIFDILGDGIFNVDSQLWELHRKTTLSFLNHAQFYTLLQTNVWHKVEKGLLPVLDWFAEEGAEFDLQDVFQRFTFDAISKLVLHHDPESLCLGLPYVPCEKAFNHAVDALLYRHIFPESFWKLQNWLGIGKEKKLIQAYRAFDEFIYSALKRLEERMMMITPNIDNNSDDHHLSLFTAYVQAYKQQEQPQAALLTTTTTTKFPRDTFLSLMFAGRDTTSSTLTWFFYLLAQNPLVQANARDEIENKLNLKQEIKRFFKLEECHKLVYLHAALCETLRLFPPLAIQHKVSTAMDVLPSGHLVKPNTRIILLFYSSGRMDSIWGEDCMEFKPERWISGNGRIKHEPSYKFPAFNAGPRTCLGKEMSFVQMKMIAAIILHHYEFQVVDSHSVSPSDSIIIQAKHGLKVKFTKRSM

SEQ ID NO: 42903 - protein, 337 aa, Blastopirellula marina DSM 3645
MTATTTSKQIELASRPSGLPTLSNFKLTTAELSPIKEGEFLVKNLWMSVDPYMRGRMKAGKSYVPPFQMGEPLEGGCIGEVVESRHDKFPAGDIVLGNLGWREYWKSTGEGVTVVDPQLAPVQAYLGVLGMTGMTAWVGLHKIAELQAGSTLFVSAASGAVGSVVCQLAKAKNCRVIGSAGKAEKIAWLKEKGGVDAVINYKQTEDLAGELAQLAPDGIDVYFDNVGGDHLEAAIEVMNDFGCCVECGMISIYNATEPTMAPRNLFKVVAKRIRMQGFIVVDHMQDQKEFIQAMAPLIKSGEVVWEESVTEGLEKAPQAFIGLFNGDNLGKQLVRIV

SEQ ID NO: 42904 - protein, 99 aa, Cucumis sativus
FACSDSRVCPSHVLDFQPGEAFVVRNVANLVPPYDQDKYSGTGSAIEYAVLHLKVQYIVVIGHSACGGIKGLMTFPYDGKYSTDFIEEWVKVGLPAKAK

SEQ ID NO: 42905 - protein, 455 aa, Mesorhizobium loti MAFF303099
MDTQPAPFVPPAPKPRTSPPSTLEMIRIVYRNPLELWGEPTYNEPWISANGVGGHLIVANDPGLIRHVLVDNAKNYKMATVRQKILRPILRDGLLTAEGEVWKRSRKAMAPVFTPRHIFGFAQPMLKRTKEFVTRYEEGGASDIAHDMTLLTYDILAETLFSGEIAGEPGSFANEIDRLFETMGRVDPLDLLRAPDWLPRLTRIRGRKTMAYFRKIVTDTVKMREEKFRRDPDAVPQDFLTLLLKAEGPDGLTRSEVEDNIITFIGAGHETTARALGWTLYCLAESPWERNRVEQEIDEVLAREPDPTKWLDAMPLTRAAFDEALRLYPPAPSINREPIEPEMWKDLYIPRHAAVLVMPWVVHRHRKLWDRPDAFLPERFHPGNREKIDRFQYLPFGAGPRVCIGASFAMQEAIIALAILLSRFRFDTTAETKPWPVQKLTTQPQGGLPMQVTPR

SEQ ID NO: 42906 - protein, 431 aa, Escherichia coli
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGVRCTVVCMPVPIEEASAFGVMAVDENDKTIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPKLDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 42907 - protein, 403 aa, Zea mays
LLFWWWGGFFGARKLYPGEIFFPGYVINSPFARPIKGGEIWGCGGGVGTNLKYMGSPRVFGILGGERERERKSFFLPPPPPRRGGETKKGKERKTKMAIVSVSNSFLTFNSPNQLRFSRRRFSAMASSTTGVRVAEGEGNLPKLVLTSPQNSEAEIYLFGGCITSWKVASGKDLLFVRPDAVFNKIKPISGGIPHCFPQFGPGLIQQHGFGRNMDWSVVDSQNADDNAAVTLELKDGPYSRAMWDFAFQALYKVIVGADSLSTELKITNTDDKPFSFSTALHTYFRASSAGASVRGLKGCKTLNKDPDPKNPIEGKEDRDAVTFPGFVDTVYLDAPNELQFDNGLGDKIIIKNTNWSDAVLWNPHTQMEACYRDFVCVENAKLGDVKLEPGQSWTATQLLSIS

SEQ ID NO: 42908 - protein, 212 aa, Ipomoea nil
TKESRMGLEKAKEEVSRAFVREEQMQGRTTKERTVHLCWNPSKNSRLTLNIDGSVKASTNNAGIGGALREDKGTWLGGFAYKIPLETPEAIEAKAIVLGMQWLWERGVREAEIQSDARKVVEWIQASDNLRGPIQGIIEEARLWLTKDWKISIRAVYREQNRVADALAGYGAFQSDAWTTFSSRPIISKEAYLQDIARVTSARRVRETQPVA

SEQ ID NO: 42909 - protein, 552 aa, Archaeoglobus fulgidus DSM 4304
MKPWFRHWPPLLTKTLDYPRVPLFEFVETSARRFGDKAAIIYYGREITYNELLDAVERFATFLSNAGVEKGDRVAIYAQNSPQFVIAFFGIMRANAAVVPVNPMLVERELEYVLSDSGSKLVVATSELAGRVLPVAKKLGIQVVCGNLSDFIPEQPTLPVPDFAKLKIDVEGTTSWSEAMKERNPPEVMVGSDDLALIPYTAGTTGLPKGCMHTHFTAIANVLSSVHWFNLTPSAISLATLPFFHVTGMVHSMLAPVYIGATMVLLTRWDRETALQAIERYRCTHWVNITTMVIDLLSDPKIAERDLSSLLVVGGGGAPMPKAVAEKLYQLTGIRYMEGYGLTETISQTHMNPPQNPKLQCLGIPDFGVDALVIDIETGKPLPPNEEGEIVVSGPEIFKGYWNKPEETEKAFIEIDGKRYFRTGDLGYMDEDGYFFIVDRIKRMINRSGFKVWPAEVEAVLYKHPAVKEVCVIGVPDERVVEEVKAFIVVNPEYRGKITEEEIIQWAKQQMAAYKYPRIVEFDDELPKSGAGKILWRLLQEREKEKLEKGGG

SEQ ID NO: 42910 - protein, 133 aa, Ipomoea nil
MASKKTSVLALFIVFNILFCTMVSACGTCPSPKPKPKPKPTPSPSNKGKCPKDALKLGVCANVLGNLLGLVVGNPPKKPCCSLIEGLVDLEAAVCLCTAIKANILGINLNVPLSLSLLLNVCGKKVPSGFQCP

SEQ ID NO: 42911 - protein, 199 aa, Zea mays
MPHLQPPRPHPHPTSRLSRASRPSPFPFFPAGTSRSGRLHPVPASGHSVSRVSKGKFAVAAVTLDDYLPMRSTEVKNRTSTDGIKSLRLITAVKTPYLPDGRFDLEAYDSLINTQINGGAEGVIVGGTTGEGHLMSWDEHIMLIGHTDNCFGANIKVIGNTGSNSTREAVLATEQGFAAGMHAVLHVNPYYGKTFTEGL

SEQ ID NO: 42912 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSIMRAALECSDKGWGTSVIVGVAASGQEISTRPFQLVTGRVWKGTAFGGFKSRTQVPWLVDKYMKKEIKVDEYITHNMNLADINDAFHLLHEGGCLRCVLAMQI

SEQ ID NO: 42913 - protein, 377 aa, Portulaca oleracea
TDVPAVAAGAFKSYKLAAKAISRLQSLPSRNMSLLCDVLVKEVTELTAYDRVMVYKFHEDEHGEVISEYRKPGLDPYLGLHYPATDIPQASRFLFLKNRVRMICNCLATPVKVIQDKKLAQPLSLGGSILRVPHGCHAQYMANMGSIASLVMAVTINEDDDEVKSDPSTGKRLWGLVVCHHTSPKFISFPLRYACELLVQVFGIQINKEVELVAQIRESHILRIQTVLCDMLMRDSPVAIVTQSPNVMDLVKCDGAALYYNGQVWLLGITPTEEQIKNLTLWLLKYHGSTKGLSTDSLMEAGYPCASDLGDAVCGMAAVRISSKDFLFWFRSHTAKEVKWGGAKHDPTDNDNGRKMHPRSSFKAFLDVVKWRSQPWE

SEQ ID NO: 42914 - protein, 377 aa, Quiabentia verticillata
TDVPAAAAGAFKSYKFAAKAISGLQSLPSRNMSLLCDVLVKEVSELTGYDRVMVYKFHEDEHGEVISEYRTPDLEPYLGLHYPATDIPQASRFLFLKNRVRMICDCLAAPVKVIQDKKLAQPLSLGGSILRAPHGCHAQYMANMGTIASLVMAVTINEDEDEVKSDPSTGTRLWGLVVCHHTSSRFIPFPLRYACELLVQVFGIQINKEVELAAQIRESHILRIQTVLCDMLLRDSPVAIVTQSPNVMDLVKCDGAALYYKGQVWLLGITPTDEQIKNITQWLLEYHGSTKGLSTDSLMEAGYPGASELGDAVCGMAAVRISSKDVLFWFRSHSAREIKWGGAKHDPVDSDDRSKMHPRSSFKAFLEVVKWRSQPWE

SEQ ID NO: 42915 - protein, 490 aa, Arabidopsis thaliana
MEIILVTLCLTTLLALLLLKSILKRTTTNNLNLPPSPWRLPVIGNLHQLSLNTHRSLRSLSLRYGPLMLLHFGRTPVLIVSSADVAHDILKTYDVICANRPKTKVIDKILRGGRDVAFAPYGEYWKQMKSICIQNLLSNKMVRSYKKIREDEIKLMIEKVENASSCSPPSPVNLSQLFMTLTNDIICRAALGRKYSSKEDGIDVENIVRAFSALVGEFPIGEYIPSLSWIDKIRGQDHKMEEVDKRFDEFVERVVKEHEDANKDTRSDLVDTLLTIQSDKSALKLIIWDMFLAGTATSLSFLEWAMTELMRNPKVMKKLQEEIRSSSRQGLFVTEKEAEKMDYLQAVIKEALRLRPPAPLMVPRVFSEDVTLKGYNIPAGTQVIINAWAIQRDTTTWGIDAEEFRPERHLDSILDFQGQDFKFIPFGSGKRICPGIGFTSALIGVTLANIVKRFNWRMDVEPQRVQHDLTEATGLVVFRKFPLIAIPSSA

SEQ ID NO: 42916 - protein, 197 aa, Medicago sativa subsp. x varia
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIRELKHYAPGVPIILVGTKLDLRDDKQFFVDHPGAVPITTAQGEELRKLINAPAYIECSSKSQQNVKAVFDAAIRVVLQPPKQKKKKSKAQKACSIL

SEQ ID NO: 42917 - protein, 501 aa, Burkholderia sp. 383
METNEHFPLLDATRAFLAKPKKMLIGAEWSDAASGRQLDVVNPADGTVLARVPEADAHDVQQAVAAARRAFDAGPWRTAKTTDRERLLLTLADLIEANARELAEIESLDNGKPVMVAQGLDVAMAAQCFRYMAGWATKIEGSVIDAGMPYMPDSEIFTYTRKEPVGVVGAIIPWNFPLLMAAWKLAPALATGCTVVLKPAEDTPLSALRLGELIREAGFPDGVVNIVTGYGHTAGAALSSDPRIDKIAFTGSTQTGKTIGHAALDNMTRMSLELGGKSPVIVLPDVDPDKAALGVANAIFFNQGQVCTAGSRAYIHAKVFDDVIERVAKIAASLKIGPGMDPSTQIGPLVSAKQRQRVCGYIDSGFGEGARAAAGGRAVDGPGFFVEPTVLVDTTQAMRVVREEIFGPVLVAMPFDDVDTAVQLANDTPYGLGASIWSNDLSAIHKLIPRIAAGTVWVNCHSLLDNAMPFGGMKQSGFGRELGRAVIDQYTESKSVMMNYA

SEQ ID NO: 42918 - protein, 272 aa, Bacillus cereus ATCC 10987
MTLQEQIMKALHVQPVIDPKAEIRKRVDFLKDYVKKTGAKGFVLGISGGQDSTLAGRLAQLAVEEIRNEGGNATFIAVRLPYKVQKDEDDAQLALQFIQADQSVAFDIASTVDAFSNQYENLLGESLTDFNKGNVKARIRMVTQYAIGGQNSLLVIGTDHAAEAVTGFFTKFGDGGADLLPLTGLTKRQGRALLQELGADERLYLKMPTADLLDEKPGQADETELGITYDQLDDYLEGKAVPTDVAEKIEKRYTVSEHKRQVPASMFDDWWK

SEQ ID NO: 42919 - protein, 635 aa, Photobacterium profundum SS9
MKHDSKTLDLICMGRVAVDLYGQQIGARLEDMGSFSKYLGGSSGNVAYGTARQGLKSSMLARVGDEHMGRFLREELNSVGVDTSHLITDEERLTALVILGIKDEETFPLIFYRDNCADMAITADDVSEEYIASARCLAITGTHLSNPQTRDAVLTALKYARRHGVKTALDIDYRPVLWGLTSLGDGENRFIESGKVTDQLQEVLGLFDLIVGTEEEFHIAGGSTNSIDALRAVRQVSQAELVCKRGALGCSVFSNDIPNDLDDGITIQGVRVDVLNVLGAGDAFMSGLLRGYLSDEGWEKACAYANACGALVVSRHGCAPSMPTKVELDDYLSRANDVPRPDIDARLNHLHRVTTRKPNWEELCVLAFDHRIQFVDMVREAGVDFDSIKPLKKLILQASQEVVEEAGLQGKAGILCDGTFGQDVLNEVTGSGWWIGRPIELPGSRPLRLEHGNIGSQLVNWPLEHVVKCLAFFHPDDQHPLRLEQEKMIKEVYTACCQSGHELLLEVILPADMSSSDDLYLRAVQRFYNLGVKPDWWKLPPQSVEGWNNISAVITERDTYCRGVVILGLDAPEAELKAGFAAAANQPLVKGFAVGRTIFGQPSRDWLAGKIDDRALIEKIKVNYHNLITLWRQRG

SEQ ID NO: 42920 - protein, 197 aa, Medicago sativa subsp. x varia
MSASRFIKCVTVGDGAVGKTCLLISYTSNTFPTDYVPTVFDNFSANVVVNGSIVNLGLWDTAGQEDYNRLRPLSYRGADVFILAFSLISKASYENVSKKWIPELKHYAPGVPIILVGTKLDLRDDQQFCIDHPGAVPITTAQGEELRKLINAPAYIECSSKSQENVKAVFDAAIRVVLQPPKQKKKKNKAQKACSIL

SEQ ID NO: 42921 - protein, 197 aa, Medicago sativa subsp. x varia
MSGSRFIKCVTVGDGAVGKTCLLISYTSNTFPTDYVPTVFDNFSANVVVDGSTINLGLWDTAGQEDYNRLRPLSYRGADVFLLAFSLISKASYENIAKKWIPELRHYAPGVPIILVGTKLDLRDDSQFFQDHPGAAPITTAQGEELKKLIGAPIYIECYSKTQKNVKAVFDSAIKVVLQPPKQKKTKRKGQKACSIL

SEQ ID NO: 42922 - protein, 174 aa, Glycine max
MKRPLTPSASGMKTNKKAKAMENDEDVEGLGRFDDNLLFEVLKHVDARTLAMAGCVNKQWHKTAQDERLWELICTKQWANTGCGEQQLRSVVLALGGFRRLHALYLFPLSKPQQLQQLTSSSSSSSSSSAWGPTVPQMIRSKPLRLGKDEVHLSLSLLSIRYYEKMNFNNRTTR

SEQ ID NO: 42923 - protein, 470 aa, Escherichia coli
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRSTGIADTVLFGPEPEFFLFDDIRFGSSISGSHVAIDDIEGAWNSSTQYEGGNKGHRPAVKGGYFPVPPVDSAQDIRSEMCLVMEQMGLVVEAHHHEVATAGQNEVATRFNIMTKKADEIQIYKYVVHNVVRNRFGKTATFMPKPMFGDNGSGMHCHMSLSKNGVNLFAGDKYAGLSEQALYYIGGVIKQPKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 42924 - protein, 712 aa, Oceanospirillum sp. MED92
MNKKLALISILFLAVVSFFMFDLGQFFSLEYIKDNQQAFADYYQANPVLTIAIFFAIYVLVTGLSLPGATIMTLVGGALFGLWTGLIIISFASTLGATLAFLFSRFLLRDSIQQRFGKQLESINEGVKREGAFYLFTLRLVPIFPFFVINLGMGLTSIKVWTFYWVSQLGMFAGTIVYVNAGTQLGQLESLSGILSPGIILSFTLLGIFPLIAKKVIELLKARKVYAGIKKPEKFDTNIVVIGAGSAGLVTSYIAAAVKAKVSLIEKHKMGGDCLNTGCVPSKALIRSARFLAESRNSEKYGIAKSEVEFNFAEVMERVSKVVETVEPHDSIERYTGLGVDCVQGSAQILNPYEVVVNGEIITTKNIVIATGARPRIPAIKNIEAMSPLTSDNLWKIRERPKRLLVLGGGPIGCELSQSFARFGSQVSIVLRGSHIMPKEDSDVSELVAARFKDEGISILPERKMREFVERDGEKLLICEYQGQTEEIAFDELLIATGRQANIEGFGLDNLGITSKADGTLEVNEYLQTKYPNIYACGDVAGPYQFTHAAAHQAWYAAVNALFGKFKKFKVDYSVIPAATFTDPEVARVGLNELEAKEQNIAYEVTRFDLEELDRAIADSDNHGFVKVLTVPGKDRILGATIVGPHSGELITEYVTAMKHGLGLNKILGTIHIYPTLSEANKYTAGEWKRANAPQGLLGWVEKYHNWMRGQK

SEQ ID NO: 42925 - protein, 447 aa, Bradyrhizobium sp. BTAi1
MLDKSPRPAVTVPNDLAAHWMPFTANRAFKKNPRLLAGAKDMHYITIDGRKIIDAAAGMWCCNAGHGRTEIAEAIGKQAAALDYAPPFQFGIPQAFELANRIADLAPAGLDHVFFCNSGSEAADTALKMALAYHQINGQGSRTRLIGRVRGYHGVGFGGTSVGGIVNNRKMFGTLLTGVDHIPATYDREKQAFTKGEPEYGAHFAEELENLVALHGANTIAAVIVEPMAGSTGVIPAPKGYLKRLREITQKHGILLIFDEVITGFGRLGHAFAAERYGVTPDLLTFAKGVTNGAAPMGGVVVRDTIHDAFMSGPEHMVEFTHGYTYSAHPIACAAGLATLDIYRDHKLFEHAKAIEPKWADAVMSLKGLPNVLDIRTVGLTAGIDLAPLPDAAGKRGYSAMEQAFHNTDLMLRIAGDTLALTPPLIISEDQIGEIVDKVGKVIKAVA

SEQ ID NO: 42926 - protein, 875 aa, Chlamydomonas reinhardtii
MLLQAPGLAPGSARRQAACSVAREATNVRIVTAPALTPGRAGVSGRRILPPSRVVSVELEAPTLSSSPATVSTKKLFCEPSGQPASTAYGPALTGRPAPLGASIDADTGAINFSVFSSSAESVSLVLFTEADLNAGRATFEIPLDPYVNRTGDVWHIMLPDLRDDLLYGYRVEGVHQEEDKDYPGMRHDKRRVVLDPYAVAVLNRRRWGQMGPNLPYGEEGVLGVMPTWPQAAAALPAARGSAFDWEGDTPLNLPMESLVIYEAHVRGFTAHASSGVAAPGTYAGMVERLDYLKSLGVNAIELLPVFEFNELEYYSQIPGSDQYRFNFWGYSTVNYFSPMGRFSAAVGQGAPARASCDEFKQLVKECHRRGIEVILDVVFNHTAEGNERGPTISFRGLDNRVYYMLAPGGEYYNYSGCGNTLNCNQPVVRQFILDCLKHWVTEYHVDGFRFDLASILTRAHSAWHPQQYDQETGQRVAMSSGGAIVTAEGIMTDGAGVPTGYPLADPPLVESISEDPVLRNTKMIAEAWDCDGLNQVGAFPHYGGRWSEWNGKFRDVVRNFIKGTDGPWAGDFASAICGSPNIYANNTPHETDWWANNGGRQWKGGRGPHASINFVAAHDGFTLADMVAYNNKHNEANGENNRDGEQHNNSWNCGEEGPTTKWEVNRLRQRQMRNLTGALLLSCGVPMINMGDEYGHSKNGNNNTYCHDSELNYLRWDQLAEDPHGFNRFVRLLIHFRRATPALQRTTFVNDKDIQWHGELPNTPDWTDTSRLVAFTLHDGKGGGLYVAFNTSHLPKLLQLPKWGGRVWQPLVDTSKVAPYDFLAVDGVLSAEDVAAARRQMAMWTADHTYPVLPWSCIVLQSAPEDPAATSMIK

SEQ ID NO: 42927 - protein, 375 aa, Solibacter usitatus Ellin6076
MRYDAIVIGIGGMGSAAAWHLASRGRRVLGLEQFTIPHEMGSSHGVTRIIRLAYSEHPSYVPLLRRAYELWRAMEQRAGEPLLVITGGVDVGCADSVTIEGSLRSCREHGLAHELLDAAEVGRRFPGFRLPGDLAAVYQPEGGIVLPERSMVVHAAAARELGAEIHEGERVMEWRPEGGGVRVWTEAGEYAADRLVITAGPWASRCVPELERLAIPERQVLIWTAPRRPERFAVGAFPIFNMEAEEGRFYGFPVYGVPGFKLGKYHHLGQQTDPDRVDREFHPEDEAVLRAGIRRYFPDADGETLLMKTCMFTNSPDEHFILDLHPEWPQVSIAAGFSGHGFKFAPVIGEVMADLAMEGGCSRFDLGLFGLHRFV

SEQ ID NO: 42928 - protein, 555 aa, Chlamydophila pneumoniae CWL029
MELLSLNKSYFEIQRLRYRPEILTLLETIRSKHIQETSSPPSPPPELQKHIPNLCRIPEVSIYTEQETSSKPLKIGVLLSGGQAPGGHNVVIGLFDALRVFNPKTRLFGFIKGPLGLTRGLYKDLDISVIYDYYNMGGFDMLSSSREKIKTEEQKKNILNTVKQLKLDGLLIIGGNNSNTDTAMLAEYFLAHNCKTSVIGVPKTIDGDLKNCWIETSLGFHTSCRTYSEMIGNLAKDALSAKKYHHFIRLMGQQASYTTLECGLQTLPNIALISELIATRKISLKQLSEQLALGLVRRYKSGKNYSTVLIPEGLIEHIFDTRKLIDELNVLLANGDSSIEKILSKLSPETLKTFHLFPKDIANQLLLARDSHGNVRVSKIATEELLAVMVKKEIEKIKPHMEFHSVSHFFGYEARAGFPSNFDCNYGIALGIISALFLVRQKTGYMITINNLAQSYTEWQGGATPLYKMMHLENRCGTETPVIKTDSVDPKSPAVQHLLQQSDSCLVEDLYRFPGPLQYFGKEELIDQRPLTLLWENQTHSPFQALYSTSGKRSL

SEQ ID NO: 42929 - protein, 420 aa, Methanothermobacter thermautotrophicus str. Delta H
MKSEELFRRASNVLPGGVSSPVRRFDPHPFFAAGGSGCLLESVDGESYIDYCLAYGPLILGHAHPRVVEAVNEQIKRGTTYGVPTEGEIELAEAIIERVPCAEMVRFTNSGTEATMAAVRLARAFTGRDRIVKFEGSYHGAHDYVLVRPGSGAATAPDSPGIPVDTVRNTLTVPFNHEEAMAELIEGAGEDIACILVEPVMGNIGCIEPENGYLQFLRDITRENDIILIFDEVITGFRLAPGGAQEYYRVEPDLVTLGKIVGGGFPMGALAGRREIMENISPAGNVYQAGTFNGNPVSVTAGRETLRLLDGRMYSDLERKGSTLRAGLRDLLSDLDLEYQVTGPASMFQLYFTGEEVRNYGDAKKSDTVLFMEYFHGLLERGVFIPPSQFECCFISAAHESEHIEATLEAAEEVLSGLKN

SEQ ID NO: 42930 - protein, 389 aa, Streptococcus thermophilus LMG 18311
MSEVTTQSKPERRKRQKLEDMEGYKPSIYGLTRDELIDWAVEHGEKKFRATQIWDWLYKKRVQSFEEMTNISKDFIAKLNDNFCVNPLKQRIVQESKDGTVKYLFELPDGMLIETVLMRQHYGLSVCVTTQVGCNIGCTFCASGLIKKQRDLTAGEIVAQIMLVQKYFDDRGDGERVSHVVVMGIGEPFDNYDNVLRFLRTINNDNGLAIGARHITVSTSGLAPKIKEFANEGVQVNLAVSLHAPNNDLRSSIMRINRSFPLEKLFEAIEYYIQTTNRRVTFEYIMLNEVNDHPENAQELADLTKKIRKLSYINLIPYNPVSEHDHYSRSTKERVATFYDVLKKNGVNCVVRQEHGTDIDAACGQLRSNTMKRDRQKAVAEASGKSEGK

SEQ ID NO: 42931 - protein, 492 aa, Triticum aestivum
  misc_feature (400)..(400): Xaa can be any naturally occurring amino acid
  misc_feature (423)..(423): Xaa can be any naturally occurring amino acid
  unsure (1)..(492): unsure at all Xaa locations
QRPDALHVVKRGALDIDRGGRVGGPELPSHRAARRRGSVRRRVADAGQALQLQGVPALLPSGHQLLRLLRRRQHHRQGGRVRHRDAVASAELDPGGPGGRRRRSGVHQRSRLRVVERVRLGAEALVLRQRLAVERGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQXSEEEATLNLNAMNKAPRTKKPWXNLSFSLRGVALQQSTLKAWSGKTENEEKARAAFLVRCKANSEATLGTYKGDATLAEGASESLHVKDYKY

SEQ ID NO: 42932 - protein, 192 aa, Medicago sativa subsp. x varia
MQSIKLVVVGDGAVGKTCLLIAYTSNSFPQEYVPTVFDNYSANVMVDGRMVSLGLWDTAGQEDYDRLRPLSYPGTDVFLLCFSVISPTSFSNVKSKWWPEVSHHCPNAKMILVGTKMDLRDDRDTLDGLKRKGLSPISQTDGEGLARDIGAVAYMECSALTQAGLKQVFDEAIKAVVVKKTPSPQEKNCTLF

SEQ ID NO: 42933 - protein, 300 aa, Linum usitatissimum
MFKVPEHQVAGHQAINGLLGPLVDDSGRFYKPLQGDERGATEMAFYTSFSAHKTIPQHVRRFFPAFHGTQSIEASDGSGLHPHLILEDLTSTRLHPCVMDIKIGSRTWYPEASQAYIEKCLKKDVESSSPFLGFRISGLQVYGNDKESSEVVLKPERKLLQNLTADEVRLVLKRFVSSNPKSDQPDCSFAAVVYGGSNGILAQLLELKAWFEDQTIYHFNSCSVLMLYEKEKTKMVNGGEESLGCAAVKLIDFAHVTEGNGVIDHNFLGGLCSLIKFISEILTGPDENSPKSCLQDGAAE

SEQ ID NO: 42934 - protein, 388 aa, Mesembryanthemum crystallinum
MFATLRQPTQSHSLITLSLQKPSIPKTEQLSFPNLPSSKHEEISHLSVTKPLHVASLLKPRKHLVECNAYEANRSQPLDINIELPSVKSETAKRVKIGIYFATWWALNVVFNIYNKKVLNAFPYPWLTSTLSLAAGSLMMLISWASRVAHPPKTDLQFWKSLLPVAVAHTIGHVAATVSMSKVAVSFTHIIKSGEPAFTVLVSRFLLGDTFPMPVYMSLIPIIGGCALAAVTELNFNMIGFMGAMISNVAFVFRNIFSKKGMNGQSVSGMNYYACLSMLSLLLLTPFAIAVEGPQVWAAGWQKAVSQIGPNFVWWVAAQSIFYHLYNQVSYMSLDQISPLTFSVGNTMKRISVIVSSIIIFHTPIQPVNALGAAIAILGTFIYSQAKV

SEQ ID NO: 42935 - protein, 380 aa, Vibrio sp. Ex25
MSQTAEKKAELGGAGLRGQSAGSTALCTVGKTGTGLTYRGYDITDLANNAQFEEVAHLLLRGHLPTQKELDAYKTHLLNLRGLPTELKQALELIPATAHPMDVMRTGCSVLGNLEQEMSFDEQLHSTERMLALFPAIICYWYRFSHDGVRIDTEDQTEDCIGGYFLRLLTDKEPSALHKQVMHCSLILYAEHEFNASTFAARVCASTLSDIHSCITAAIGTLRGPLHGGANEAAMEMIEDWQTPDEAEANIMKMLANKDKIMGFGHAIYRESDPRNALIKRWSKELSQQVGDTHLYAVSERVESVMKREKGLFCNADFFHASAYHFMDIPTKLFTPIFVMSRLTGWAAHVYEQRANNRIIRPSADYTGPDHQEWVPIENR

SEQ ID NO: 42936 - protein, 328 aa, Burkholderia sp. 383
MHAWSARHVPAQGGKVAVVTGANSGLGWQLAETLAAKGATVVMGCRDAARAAQAADAIRRLHPDARVEVDPLDLADLASIARFAADVAERHGRVDILCNNAGVMFLPLRHTHDGFEMQFGTNHLGHFALTGHLLPALRAARRARVVTMSSGLNRGGRIRVDDLRAEHRYNRYLAYCDSKLANLVFAIELQRRFERAAFAGISVAAHPGYAATNLQFAGPAMDSSPARAALMRAANRYLAQPADQGALPAIHAATSPDLAGGAYIGPSGLFESRGLPAPASVPRAARDVASAALLWEASEAATGVRFLSSGAPAGRSPGRPFDTAAEVR

SEQ ID NO: 42937 - protein, 377 aa, Ipomoea nil
MSTCVSLLVLKLFARKYHPGSKKRRNSITVKIDGVKDFTFEEMALATQNFDDSSLVGRGGYGKVYKGILADGTVVAIKRAQEGSLQGEKEFLTEIELLSRLHHRNLVSLIGYCGEEGDQMLVYEFMPNGTLRDHLSGKSKEPLDFAMRMRIALGSAKGILYLHTEADPPIFHRDIKASNILLDTKLIAKVADFGLSRLAPVPDLEGVLPAHVSTVVKGTPGYLDPEYFLTHKLTDKSDVYSLGVVFLEILTGKHPISHGKNIVREVNMHIVMAGYCLSLTNNGILSVMRENCYSCSQCARQTDARPSMIEVVRELEEIWYMMPDSDNKIRNSKLSIDLHKTDTSPSSSMPMKHPYASTDISGSDLISGGILPNIAPR

SEQ ID NO: 42938 - protein, 345 aa, Streptococcus pyogenes MGAS10394
MIFIRRKSLMVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 42939 - protein, 333 aa, Haemophilus influenzae Rd KW20
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVAAGYIVYGSSTMLVYTTGNGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIEPTALHERVPLFVGSEDMVKKAQEMMEEFKE

SEQ ID NO: 42940 - protein, 291 aa, Haemophilus influenzae Rd KW20
MAENRYELNKNLAQMLKGGVIMDVQNPEQARIAEAAGAAAVMALERIPADIRAVGGVSRMSDPKMIKEIQGAVSIPVMAKVRIGHFVEAQILEAIEIDYIDESEVLSPADNRFHVDKKEFQVPFVCGAKDLGEALRRIAEGASMIRTKGEPGTGDIVQAVRHMRMMSQEIRRIQNLREDELYVAAKDLQVPVELVQYVHKHGKLPVVNFAAGGIATPADAALMMQLGAEGVFVGSGIFKSGDPIKRASAIVKAVTNYRNPQILAQISEDLGEAMVGINENEIQILMAERGK

SEQ ID NO: 42941 - protein, 285 aa, Linum usitatissimum
  misc_feature (58)..(58): Xaa can be any naturally occurring amino acid
  unsure (1)..(285): unsure at all Xaa locations
MLKVPEHQVAGHQDINGLLGPLVDDSGRFYKPLQGDERGATEMAFYTSFSTNKTIPQXVRRFFQAFQGTQSIEASDGSGLHPHLILEDLTSTRLHLCVMDIKIGSRTWYPEASQAYIEKCLKKDVESSNPLLGFRISGLQVYGNGKESSEVVLKPERKLLLNLNADEVRLVLKRFVSSNLKSDQPDCSFAAVVSSGSNGILAQLLELKAWFEDQTIYHFNSCSVLMLYEKEKTKMVNGGEESLGGAAVKLIDFAHVTEGNGVIDHNFLGGLCSLIKFISENQIML

SEQ ID NO: 42942 - protein, 273 aa, Leptospira interrogans serovar Lai str. 56601
MGIILSFFIGHWFLSAFVQSFFLHRYAAHAMFKMNKFWEKFFYIFTCVAQGSSFLNPRAYAIMHRQHHAYSDTGKDPHSPVASKGFLDMMWKTALNYEAILEETTNVEKEFKGNYPEWPAIDVLSNSWTFRLFCGTLYTLFYFYFVPEGQYAWYLLLPIHWLMGPLHGAIVNWCGHMYGYRNHKKNPDNSKNTLFVDFMIAGELYQNNHHAHPNSPNFAFRWFELDFTYQVMKILHFFRIIKIQRAVWTEKGKKILRGSEVLVEPTSTSTVAA

SEQ ID NO: 42943 - protein, 1142 aa, Mesotaenium caldariorum
MSTSRMSQSSGESTAKTKREVRVAQATADAKLNTAFEASAAVGGSFDYTKSVGASLNAGSEAIPSSAVTAYLQRMQRGGITQTFGCMLMVEEGSFRVRAFSENAGEMLDLVPQAVPSMGQQSLIAVGTDIRTLFTSASVSLLEKAAMATDVSVMNPVSLQSRAAKKPFFAVLHRIDVGLVVDLEPVRPSDPNVSAAGAMQSHKLAAKAISRLQSLPGGDIGLLCDAVVEEVRELTGYDRVMAYKFHEDEHGEVIAEIRRSDLEPYLGLHYPATDIPQAARFLFMKNRVRIICDCSAPPVKVIQDPTMKHPISLAGSTLRGVHGCHAQYMANMGSVASLVMAVIINDNSSEEGATAAGGILHKGRKLWGLVVCHHSSPRYVPFPLRSACEFLMQVFGLQLNMEVELSSQLREKHILRTQTLLCDMLLRDAPMGIVSQSPNITDLVKCDGAALFYHGRAWLLGVTPSEAQVRDIAAWLLDSHKDSTGLSTDSLADAGYPNADSLGVSVCGMAAARITSKDFLFWFRSHAQKEVKWAGAKQEPGDRDREEGEEGGRMHPRSSFQAFLEVVKQRSLPWEDVEMDAIHSLQLILRGSFQDMEGEGGGSQQGNKRMINARLNDLKLQGMDELSTVANEMVRLIETATAPILAVDSLGCVNGWNAKVSELTGLPVSEAMGKSLVKDLVQRESREAVERVLYMALNGEEEQNVEIQLKTWGPQLHSHGGTVILVVNACASRDVSESVVGVCFVGQDVTGEKEVLDKFIRIQGDYTTIVRSRNSLIPPIFGSDEYGCCTEWNPAMEKLTGVRREDVIGRMLMGDVFGSALRLRGSDGLTQFMIVLNRAMDGADTDKFPFTFYDREGKCVDSLLTANKRTDADGAITGVFCFLHTVSLELQQALSVQKAAERVAEAKAKELAYIRQEIQNPLDGIHFARSFIEHTELSEDQKQLMETSATCEKQLRRILDDMDLESIEEGYLELETGEFMMATVMNSVVSQGMVQSSKKGLQLFCDTPPEFKSMCVFGDQVRLQQVLADFLMNAVQFTPASGWVEIKVVPNVRSLPGGITMAHMEFRVTHSGEGLPEDLVHQMFDRADAHSKSQEGLGLSMCRKIVRLMSGEVRYVREPGKSYFLVLLDLPLAQREDAGSAM

SEQ ID NO: 42944 - protein, 429 aa, Chlamydophila pneumoniae CWL029
MQSARRHLNTIFILDFGSQYTYVLAKQVRKLFVYCEVLPWNISVQCLKERAPLGIILSGGPHSVYENKAPHLDPEIYKLGIPILAICYGMQLMARDFGGTVSPGVGEFGYTPIHLYPCELFKHIVDCESLDTEIRMSHRDHVTTIPEGFNVIASTSQCSISGIENTKQRLYGLQFHPEVSDSTPTGNKILETFVQEICSAPTLWNPLYIQQDLVSKIQDTVIEVFDEVAQSLDVQWLAQGTIYSDVIESSRSGHASEVIKSHHNVGGLPKNLKLKLVEPLRYLFKDEVRILGEALGLSSYLLDRHPFPGPGLTIRVIGEILPEYLAILRRADLIFIEELRKAKLYDKISQAFALFLPIKSVSVKGDCRSYGYTIALRAVESTDFMTGRWAYLPCDVLSSCSSRIINEIPEVSRVVYDISDKPPATIEWE

SEQ ID NO: 42945 - protein, 467 aa, Erwinia carotovora subsp. atroseptica SCRI1043
MSNLFSFAAVSSPAVTQAHWPERLTPYLDSEIEQFLFNSPQRLSWLVEQYGSPLNIVWPHTVTNNIAALRTVLQRHDVDCRLYYGAKVNKSPGLVQAAVNAGIGVDVSSLQELKDALRAGCDGARLCATGPAKTREFLTELVHHRALIVLDSPEEFDDVLALAALLRVTKPVRVLLRYRPSFAQASRFGMLADEVARCLETLSTRQDVLHLEGFHFHLGGYAPDTRVAALAEVLPLLERARSRGLQPTMIDIGGGLPIQYLSASRYQAYLAEQNEADYRHGQVPTSFYPYGGERSAADYLEAFLSASIGQHCVANILKQHGLILAIEPGRSLADQSAITVFRVTRTRRQPDGNHVVFVEGSSFSACETWFNSEFLIDPLHVFSVKKDTRPTPGKAWIAGHSCLDDDVITNRLIHFQTVPQPGDLLIYANTAGYQMDLLENAFHRHPLPARLCAFKGKKGELIFSSDN

SEQ ID NO: 42946 - protein, 313 aa, Mesembryanthemum crystallinum
MGEEEKGKSASNSSSNSNSNSNSSGVWRTIKPFVNGGASGMLATCVIQPIDMVKVRIQLGQGSALSITKNMLRDDGIRAFYKGLSAGLLRQATYTTARLGSFKILTNKALEANEGKPLPLYQKALCGLSAGAIGASVGSPADLALIRMQADATLPEAQRRHYKNAFHALYRIIADEGVLALWKGAAPTVVRAMALNMGMLASYDQSVEFFRDSLGYGEVATVLGASTVSGFFASACSLPFDYVKTQIQKMQPDAEGKYPYKGSLDCTIKTLKSGGPFKFYTGFPVYCVRIAPHAMMTLIFLHQIQKLESTIGV

SEQ ID NO: 42947 - protein, 662 aa, Chromobacterium violaceum ATCC 12472
MCGIAGALLDRHAHDGDVAEARRMILRQTHRGPDGLAARRVGPALLASSRLAIVDVANGSQPFSDESRAIHAVFNGEIYNHLELRENLSRRGHSLSGGSDGEVIVHLYEEYGTDCFQWLDGQFAIAIFDSRDDSLHLARDRMGICPLHWARLDGALYFSSEIKGLLAVAGMPRRAEPRAMLQLAYFGAVCAPLTPFGGIHQLPAAHRLSFRAGRLEIGRYWSLDFPLAGEHARLSEAQAAEGLAARLERAVASHAQGEFEPTCFLSGGIDSAVIAALLQRRSQASIAAFCAASEHGRMDEGGAAARTAEWLGVDLKRVRIDEAGIADAFPRLIWHGETPVISTEASALMRLAGEAGKRSKIVLTGEGADEAFAGYLAFRQYRQLGALTGRGLSPLRTMVRPWLRGHYGSECLLPGEDRLGVLAEHFGCVPAQAYEWEFYREALTPLFSPELRAMAAAGGCWDGFEFDRGAVRGRHWLDRSLYVSYQVMLPNYLLGAHGDRIYAAHSVEGRYPFLDRALVEYAAALDPALKLRRGREKHILRVAAARWLPDEVAWRPKTRFVMPFGTPFVGPRAAPLYAELLSPGKLAEYGYFDPERVRSLFRALASPPSAGGKARRYLERLALGLGATFVVSAQLWHHLHLADGGSAVSGEAARRSAPATIA

SEQ ID NO: 42948 - protein, 970 aa, Brassica juncea
MPDSVRSMKMNMKSFLKKLHITPNQPDEAADGSSIPTNKSSDVSSSPHHQSPEVKPFSGLSNWLSSVGHRKSPSPPNSLNATNGGDDEQQQDSKEDPEVEEEYQIQLALELSAREDPEAAQIEAMKQFSLGSCAPDNSPAELVAYRYWNYNCLGYDDKILDGFYDLYGVLNASSAEKIPPLLDLQGTPVSDGVTWEAVLVNRSGDYNLLRVEQMGIDIAAKTESVSSSSFVNSELVRKLAVLVGDYMGGPVVDPDSMLRAWRSLSYSLKATLGSMVLPLGSLTIGLARHRALLFKVLCDSVGVPCRIVKGQQYTGSEDVAMNYIKTDDGREYIVDLMGDPGTLIPADAAGLQIDYDEPVCSTSPGDNDSFHDASSTNGIESSFQENIEFPPGEHSSSTKSSKEDVAKVEKAPPVQNLSSRPIHSFTHMRSPSWTEGVSSPAARRMKVKDVSQYMIDAAKENPRLAQKLHDVLLESGVVAPPNLFSEVYPQQLDATVEIKNLTEAKKEKETAQQGRHQNDLGPVRFLPPLPRLHSKADTHDQQHDHGKVVSQSDSSHSEASSTEYARTVPAAVAAAAVVASSMVAAAAAKTANTESSTLELPAAAAATATAAAVVATAAAVSRHLELGSNSDGDAGSGGHEPQGSGDSPHGPNSGGDRVSDRSTGDESSKSDGTLDDVSDCEILWEEITLGERIGLGSYGEVYRGDWHGTEVAAKKFLDQDLTGEALEEFRSEVQIMKKLRHPNIVLFMGAVTRPPNLSIITEFLPRGSLYRLIHRPNNQLDERRRLRMALDAARGMNYLHSCSPMIVHRDLKSPNLLVDKNWVVKVCDFGLSRMKNSTYLSSKSTAGTAEWMAPEVLRNEPADEKCDVYSYGVILWELFTLQQPWGRMNAMQVVGAVGFQHRRLDIPDFVDPAIAELISKCWQTDSKLRPSFAEIMVTLKKLQRPATGSNIPRPVPSSSSLSTEQEQKDC

SEQ ID NO: 42949 - protein, 499 aa, Glycine max
MLSPLLLFLCLTLPLFLLSFFKYRKTFKNPPLPPGPRGLPIIGNLHQLDSPSLHEQLWHLSKKYGPLFSLQFGLRPAIVVSSPKLAKEVMKDNDLECCGRPKLLGQQKLTYNGLDMGFSSYDSYWREIRKICVVHVLSSKRVQSFTSIRHFEVKQMIKKISRHASSSKVTNLNEVLISLISTIVCRIVLGRRYEEEGSEGSRFHKLFNECEAMLGNFFVSDYIPFMGWIDKLRGLDARLERNFKEMDKFYQEAIDEHMNSKKKTPEEEDLVDVLLQLKENNTFPIDLTNDNIKAVLLNLLVGATGTTEVTTIWAMTELIKNPSIMKKVQEEIRGLSGKKDFLDEDDIQKFSYLRAVIKETLRLHLPAPLLIPRETNKKCMLDGYEIPAKTLLYVNAWAIHRDPKAWKDPEEFIPERFLNCDIDLYGQDFEFIPFGAGRRLCPGMNMAFAALDLILANLLYSFDWELPQGMKKEDIDTEVLPGVTQHKKNPLCVVAKCYM

SEQ ID NO: 42950 - protein, 160 aa, Neisseria meningitidis
MPEGAEQDILKGMYLLKAGGGGDKKVQLMGSGTILQEVIAGAELLKADFGVEADIWSCPSFNLLHRDAVEVERFNRLHPLEAEKVPFVTSKLQGHDGPVIAATDYIRSYADRIRAYIPNDYHVLGTDGFGRSDSRANLRRFFEVDRYNVAVAALSALAEQ

SEQ ID NO: 42951 - protein, 259 aa, Streptomyces griseoflavus
MTSPRHALVTGGSSGIGKSVARRLASAGHTVTICGRDSERLQQAAKELSEQGAPVTSLIADVSKPRQVGDLVREAVETNGPLGILVNNAGRNGGGRTAELSDELWREVLSTNLDSVFYVTREVLARGGIGEVDHARIINIASTAGKQGVLLAAPYSASKHGVVGFTKAVGKELAPQGITVNAVCPGYVETPMASRVRQAYADAWETTEAEVLSAFEAKIPLGRYSTPDEVASLVEYLTTEGAASITAQAFNVCGGLGNF

SEQ ID NO: 42952 - protein, 346 aa, Cucurbita maxima
MDKLPAVGLLTPLDLNTVEAVPESHVWPHLDESSQKFKSDKTVSIPVVDFNDDNVLELIGKACEEWGMFQLINHGIPKTLTAETEEVARCLFALPKSQKMKTLNVPGTANGYCMARLTKHHDKMMWHEGFTVIGSPVDDFKKLWPSDYQPFCDKVEEYQLKMKALADKLISLIFKYLGISDEEMVKKLSYIDPATGKPHLALRLNSFPPCPEPSKVMGLAAHTDTSLFTMLHQARREGLQILNEKEGWLPLAPRRDALIINIGDFLQIISNGRFHSVPHRVMIRETEKTTMSMAYFFHPPGHLYVAPYCKPLSETLQTPIYKGVNVKEYFIIKAKASGKGIAALTI

SEQ ID NO: 42953 - protein, 313 aa, Bacillus anthracis str. A2012
  misc_feature (5)..(5): Xaa can be any naturally occurring amino acid
  unsure (1)..(313): unsure at all Xaa locations
MRNVXCIGELLIDFVCRNTNVSLVNGSNFEKKAGGAPANVAAAITKLGGHATFMGQVGNDPFGEFLEQTLQHAHVDTSMLIKDKQTTLAFVSIDQNGERDFTFMRGADGEYHFNSIDLSKIKTNDLIHFGSATALLSSPLKDTYFQLLQHARESGQFISFDPNYRNALITNTEQFIQDCLTFIKHAHFVKVSQEEAIMLSKESDLQQSALKLLNHGAKAVAITLGKDGTLLATKDKQTIVPSISIQQVDTTGAGDAFVGAMLYQIAKSEQMFLHNFEGLTTFISFANKVGALTCTNYGAISSLPSLTDVKAYE

SEQ ID NO: 42954 - protein, 254 aa, Pyrobaculum aerophilum str. IM2
MAVDFTTDELDEVASLIARSSCNVALTGAGVSTASGIPDFRGPQGVWRRVDPEKFEISYFYNNPDEVWDLFVKYLLPAFNVKPNPAHYALAEMERLGKLCAVITQNVDRLHQAAGSKNVIELHGALEYAVCTNCGSKYALAEALKWRKSGAPRCPKCGGVIKPDVVFFGEPLPQDALREAFMLAEMAEVFMAIGTSLAVYPANQLPLVAKKRGAKLVIINADETYYDFFADYIIRGRAEEVLPKLLDRLRGMLF

SEQ ID NO: 42955 - protein, 401 aa, Bradyrhizobium sp. BTAi1
MLAWRPAQGPAAAGPTFKEPTEPDGQVGHRTRAWRSSGGSKDMTLTFDIKPTTNPTSDQERAAKLANPGFGRVFTDHMAVVQFSQDKGWHSARVESRANFPLDPAAAVLHYAQEIFEGLKAYKRDDGGVNLFRPDANAQRFWNSAERMAMAQLPQNVFIEAVEQLVRIDRAWIPGGEGSLYLRPFMIANEVFLGVKPSAEYIFAVIASPVGSYFKGGPAPVSIWVSENYTRAAVGGTGGVKCGGNYAASLKAQAEAIAHGCDQVVFLDAIERRYVEELGGMNVFFVFDDGSLSTPPLGTILPGITRDSIIKLARDAGREVREEAYAIDQWRADAKSGKLKEAFACGTAAVISPIGKVRSASGDVLINGGEAGPVAMGLRKQLVDIQYGRSADPHNWIRDVK

SEQ ID NO: 42956 - protein, 260 aa, Methanothermobacter thermautotrophicus str. Delta H
MHNAAFRSLGMDWIYVPFPVKPENLKAAVEGLRALGVEGVNVTIPHKEAVLEYIDDIHGTAALIGAVNTLKFDDGTVRGYNTDASGCLRALEEVTSVEGSSVLILGAGGAARACAFQLAEKGASDITILNRTPEKARLLAEDMADKLGFEASYGGYELIQGSVKSADILIDTTPVGMHPHTDDRPLVGAELMHEGLVVHDLVYNPQRTVLLREAERASAIPVSGIRMLLYQGVEAFRIWTGRDPPLDVMEDALKRVLNRD

SEQ ID NO: 42957 - protein, 504 aa, Pericallis cruenta
MSILTLICTFITGLMFYGLVNLLSRRASRLPPGPTPWPIIGNLMHLGKLPHHSLADLAKKYGPLIHVRLGSVDVVVASSASVAGQFLKVHDANFANRPPNSGAKHMAYNYHDMVFAPYGPRWRMLRKMCSMHLFSAKALTDFRQVRQEEVTILTRVLARTGQSAVKLDQQLNVCFANTLSRMMLDRRVFGDGDPKADDYKDMVVELMTLAGQFNIGDYIPWLDLLDLQGIVKRMKKVHSQFDSFLDTIIDEHTIGTGRHVDMLSTMISLKDNADGEGGKLSFIEIKALLLNLFSAGTDTSSSTVEWGIAELIRHPQLMKQAQEEMDIVVGKNRLVTEMDISQLTFLQAIVKETFRLHPATPLSLPRIASESCEVKGYHVPKGSILFVNVWAIARQSELWTDPLEFRPGRFLIPGEKPNVEVKPNDFEIVPFGGGRRICAGMSLGLRMVNLLIATLVQAFDWELANGLEPEKLNMEEVFGISLQRVQPLLVHPRPRLARHVYGTG

SEQ ID NO: 42958 - protein, 467 aa, Coccidioides immitis RS
MLNLTNVLLIPPAAGALHVGYRYLQSYLEAERVRKLENTEDPPKAPNQGIFGINVYRDMARHKEEHVFLQKNLERYDELGDTYTSDMFGRTYIDTRDPENIKAILSTQFEQFSLGDSRLDAFYPMLGEGIFTHVYGGGPKGEPWRHSRAVLRPQFARHQIQDLAKLEDLLPDSPPKETQFYHDFTRGTEICMLRTLLGDLYFLQKDSSEFKRVSAFVQEYIDRFTHKALELHAAGKPTSYDSNGKYVFLEEISKSIRDPVRLRSELLNILLAGRDTTASLLSACFHQLARHKDVWDELRKEIMDNVGDRLPTYEDIKSLRYLRYVLNETLRLFPVVPWNGRQAVVTTTLPRGGGPDGKNKILVKKGTFVLYSTWGLHRSKFYGEDTNEFRPSRWETIRPGWNYIPFNGGPRICLGQQYALVEASYVITRLLQVFKDIENRDPVLPFVEHTTLTLSSEHGAKVALTPA

SEQ ID NO: 42959 - protein, 142 aa, Dechloromonas aromatica RCB
MAIERTLSIIKPDAVAKNVIGKIYSRFESNGLKVIAARMTWLSEQEAGQFYSVHKERPFFKDLVSFMTSGPVMIQALEGENAIAKNRELMGATDPKKADAGTIRADFAESIDANAVHGSDAPETAAVEIAFFFPGMNTYAGR

SEQ ID NO: 42960 - protein, 138 aa, Methanothermobacter thermautotrophicus str. Delta H
MIKSKGDVNILLNFRHNINGEDLIIAVAQDHETGEVLMVAYMNREALRRTLETGTAHYWSTSRGKLWLKGESSGHVQRVKDVLVDCDGDAVVLKVEQEGGACHTGYRSCFYRSIDGDELKVREDAVKVFDPEEIYGDG

SEQ ID NO: 42961 - protein, 324 aa, Nocardia farcinica IFM 10152
MITTFAGALNTGMRRALEDDPKVVLMGEDIGRLGGVFRVTDTLQKDFGDNRVIDTPLAESGIIGTAFGMALRGYRPVCEIQFDGFVYPAFDQIVSQVAKIHYRTGGKVSAPITIRIPFGGGIGSVEHHSESPEAYFAHTAGLRVVTPSTPADAYHMLRQAIAAPDPVIFFEPKRRYWDKADVDFDAPPELPLHRARVCRAGTDATVVAYGGTVAPALAAAEIAASEGHSLEVIDLRSLAPLDVDTVAESVTRTGRLVVTHEAPVFGGLGAEIAARITERCFYHLEAPVLRVGGYDIPYPPAKLEKHHLPDPDRILDAVDRSLAA

SEQ ID NO: 42962 - protein, 427 aa, Erwinia carotovora subsp. atroseptica SCRI1043
MTVRTSTLTAEGQASIALEMRSGVLGKTAVDIRPLGEHGLCSYDPGFANTAGCESAITYIDAANSVLLHRGFPVEQLAEQCDFTEVCYILLHGDAPSPEAYAKFADNITRHTLVHEQITRMFSGFRRDSHPMALMCAVVGALAAFYHDVLDINNAEHRELAAVRLLSKMPTLAAMCYKYSVEQPSVYPRNSLSYTGNFLHMLFSIPAEKYEVNPVLERAMNRILILHADHGQCPSTMAVRASGSSGANPFACIAAGLASMWGPLHGGANEACMRMLEEIKTVDRVPEFVRRAKDRCDSFRLMGFGNSVYQHFDPRAAILRKTCYEVLNELGMEDSLLQVAMELEHIAMTDAYFLENKLYPSVDFYTSVILKAMGLPSSMFTVISTVGRTIGWIAHWDEMHKQQEISIYRPRQIYTGQPQRDYVSLKG

SEQ ID NO: 42963 - protein, 414 aa, Mycosphaerella graminicola
MGDLQGRKVFKVFNQDFIVDERYTVTKELGQGAYGIVCAATNNQTGEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGSKPFFKGRDYVDQLNQILHYLGTPSESTLARIGSPRAQEYVRNLPYMQKIPFHTLFRNANPDALDLLDRMLAFDPSQRIDVDEALEHRYLSIWHDASDEPNCPTTFDFGFEVVEEVPEMRQMILQEVRQFRQSVRAPQQQQYSQGHQQGQQVPIPDGYDRTHEDPRPQEMGSTDPYGLERELHDGLDAMR

SEQ ID NO: 42964 - protein, 327 aa, Arabidopsis thaliana
MVSKKDKQIHSDHNPQDASPVEWAEIRHKLLAFQENIQSGSDIDARSDDPQMCGLYVSDIYEYLRELEVKPKLRPLHDYIEKIQEDITPSKRGVLVDWLVEVAEEFELVSETLYLTVSYIDRFLSLKMVNEHWLQLVGVSAMFIASKYEEKRRPKVEDFCYITANTYTKQDVLKMEEDILLALEFELGRPTTNTFLRRFIRVAQEDFKVPNLQLEPLCCYLSELSMLDYSCVKFVPSLLAASAVFLARFIILPNQHPWSQMLEECTKYKAADLQVCVEIMLDLYLSRSEGASKAVREKYKQHKFQYVAAIPVYQELPVTFWEDVVTI

SEQ ID NO: 42965 - protein, 564 aa, Xanthomonas campestris pv. vesicatoria str. 85-10
MCSIFGIFGLQPGDDLQALRRQALECSQRQRHRGPDWSGVYVDTGAILVHERLAIVDPAGGSQPLLSDDGQLALAVNGEIYNHRELKAELLQPYAFQTGSDCEVINALYREDTPASYLNRLNGIFAFALWDKTEGRVIIARDPIGVVPLYWGHDREGRLRVASELKSLVDDCADAAQFPPGHWYDSATGALSRYYERAWRHYDAVEGVQVQLQELREAFERAVHRQLMTDVPYGVLLSGGLDSSLVAAVAARYARHRIEENDTTEAWWPRLHSFAIGLKGSPDLAAAEVAAAALGTVHHGFEYTFDEGLDALPDVIRHIETYDVTTIRASTPMFLLARRIKAMGVKMVLSGEGSDEIFGGYLYFHKAPNAREFHEELVRKLDALNNYDCLRANKSMMAWGVEPRVPFLDREFLDVAMRMDARFKMIDKTSGGAARMEKGVLREAFAGYLPESILWRQKEQFSDGVGYGWIDGLKAHAQAQVSDRELAAADRRYPVNPPQTKEAYFYRSLFEQFFPGQAAAETVPGGKSIACSSPTAIAWDASFAAMADPSGRAIAGVHAQALAS

SEQ ID NO: 42966 - protein, 253 aa, Glycine max
GKMKLKSKKGWKSIVPLHLKGKSASRFSLFRKVNSAGYGPGKTPVYLNVYDLTPMNGYVYWAGLGIYHSGVEVHGVEYAFGAHDYPTSGVFEVEPRQCPGFKFRKSIFIGITSLDSTQVREFMERQSARYNGDTYHLIVKNCNHFCKDICYKLTGKSIPTWVNRLARLGSICNCILPEALRISAVAHDPNYQPHDSEKRRLRSGFNCLSSISMRQKHLSTSSLFLQSPIRGCLSSSWPSSELRKSINRSLKER

SEQ ID NO: 42967 - protein, 457 aa, Burkholderia sp. 383
MNAASHPVDRVLPRRQMLTLGLQHMLVAYIGAIAVPLIVASALKMSPADTTVLISTALFCSGISTILQTVGVWKLGVRLPILQGVAFSSVGPVIAIGLTPGVGFAGVCGAVIGAGIITTFAAPLVGRLRRLFPPVVTGCIVTVIGLQLFPVAYQWAGGGDAAKLQFGELSFLAVALVVAVVILAVNRFANAFLRNLSVLIGLVAGSLLAIALGMGNFTNVAAAPWFTVPYPFHFGTPVFAIVPVLTMVIVMIVQMVESMGLFVAIGDIVEKQVSEEDVVRGLRANGVASAIAGTFAAFPFIAFMENVGLVILTGVRSRWIVAVSGVLMCVVALVPKIGAIVASTPSAALGGAGIAMFGVVVAAGVQTLAKVDFENNRYNVLIVGFTIATALIPVMAPKVFAHMPDWTQPFLHSGVVLACLVSVLLNALLNGVPAAEPVESHVHADAAHASPMARECD

SEQ ID NO: 42968 - protein, 118 aa, Glycine max
MATLDSDVTVFPAGEASSSAGPSSSTKKPKRFEIKKWNAVSLWAWDIVVDNCAICRNHIMDLCIECQANQASATSEECTVAWGVCNHAFHFHCISRWLKTRQVCPLDNSEWEFQKYGH

SEQ ID NO: 42969 - protein, 231 aa, Arabidopsis thaliana
MLGAKVHTCARDETQLQERLREWQAKGFQVTTSVCDVSSRDQRVKLMETVSSLYQGKLNILVNNVGTSIFKPTTEYTAEDFSFVMATNLESAFHLSQLAHPLLKASGSGSIVLISSAAGVVHVNVGSIYGATKGAMNQLARNLACEWASDNIRTNSVCPWYITTPLSNDFFDEEFKKEAVRTTPMGRVGEANEVSPLVAFLCLPSASYITGQTICVDGGATVNGFSFKTMP

SEQ ID NO: 42970 - protein, 841 aa, Oryza sativa
MIHPSLLTTIQWVALSTLILITIAADNYSSSSSPIFLNCGASTMQLDINNRSWEGDTRSKFASAMNGIAASATYQDPSLPSLVPYMTSRIFISNYTYSFPISPGRIFVRLYFYPVAYGYYASEDAYFGVKTNNLILLDNFNASQTAQAANYAYILREFSLNVTLGSLDLTFFPSTQNGSYAFVNGIEIVPTPDIFTTRTPTHNTEGNLDPSDIDSMTSFQTMYRLNVGGQAIIPQGDSRFYRSWEDDSPYIYGAAFGVTFGKDSNVTITYPGTMPNYTAPADVYATARSMGPNWQINLNYNLTWILSVDAGFYYLLRFHFCEIQYPITKMNQRSFFIYINNQTVQDQMDVIRWSGGIGMATYADYLIVTVGSGQMDLWVALHPDLSSRPQYYDAILNGLEVFKLWDIGKKNLAGLNPPLPPQPKTDVNPKGVSGGGKLKAAVPAAICAVVVLITACFCVCIICRRKKVAKHSGKTDKKCLTYQTELYKSPSNLCRNFTFHEMQIATSSFDETLLLGRGGFGDVYRGEIDNGTTVAIKRSNPLSLQGVHEFQTEIETLSKVRHGHLVSLIGYCQEKNEMILVYEYMARGTLREHLYSTKRPPLPWKERLKICIGAARGLYYLHTGPKETIIHHDVKTANILLDDKWVAKVSDFGLSKVNPDIDATHVSTVVKGTFGYFDPEYFRLKQLTQRSDVFSFGVVLFEILCARPPVNTELPEEQVSLREWALSCKKIGTLGEIIDPYLQGEIAPDCLKKFADCAEQCVADRSIDRPEMGDVLRNLEVALKMQECAENNSKFSEETTSSKTTPDMMTIMDTDKQSTYSTMSITGQRTIFSDMMDPQAR

SEQ ID NO: 42971 - protein, 1162 aa, Rhizobium leguminosarum bv. viciae 3841
MPKRQDIKSILIIGAGPIVIGQACEFDYSGTQACKALKEEGYRVILVNSNPATIMTDPGLADATYVEPITPEVVAKIIAKERPDALLPTMGGQTALNTALSLKRMGVLDRYNVEMIGAKPAAIDMAEDRALFREAMARIGLETPRSMLANATDIKDLDRKTHEAERVKLRESLSGSDLDKALDELENQWNLGESDRKQRYMSHAMAIAAQAIDHVGLPAIIRPSFTLGGTGGGIAYNRSEFFEIVGGGLDASPTTEVLVEESVLGWKEYEMEVVRDKADNCIIICSIENIDPMGVHTGDSITVAPALTLTDKEYQIMRNASIAVLREIGVETGGSNVQFAVNPKDGRLVVIEMNPRVSRSSALASKATGFPIAKIAAKLAIGYTLDELDNDITGGATPASFEPSIDYVVTKIPRFAFEKFPGASPVLTTAMKSVGEVMAIGRTFAESLQKALRGLETGLTGLDEIEIPGFEEGESSQNAIRAAIGTPTPDRLRMVAQALRQGMSEAEVHEGCKIDPWFIAELKAIVEMEARIREHGLPQDATNLRMLKAMGFSDARLATLTGKRPKEVAEFRNSLNVRPVFKRIDTCAAEFASPTAYMYSTYETPFVGAARSEAEVSDRKKVVILGGGPNRIGQGIEFDYCCCHAAFALKDAGYEAIMINCNPETVSTDYDTSDRLYFEPLTAEDVIEILRAEQEKGEVVGVIVQFGGQTPLKLAEALEKNGIPILGTAPDMIDLAEDRDRFQKLLMKLDLNQPNNGIAYSVEQARMVATEIGFPLVVRPSYVLGGRAMQILHSEGQLQSYLLDTVPELVPEDIKQRYPNDKTGQINTLLGKNPLLFDSYLSNAIEVDVDCLSDGTDVYVAGIMEHIEEAGIHSGDSACSLPPRSLSVELLDELERQAKAMAKALNVGGLMNVQFAIKDGTVYVLEVNPRASRTVPFVAKTIGAPIAKIAARVMAGEKLDATFAAYGEKPDPRKLKHIAVKEAVFPFARFPGVDTLLGPEMRSTGEVIGLDTDFALAFAKSQLGAGVELPRDGTVFVSVRDADKPRVLPAIRILVEQGFKVLATGGTARFLAENGITATKINKVLEGRPHIEDAIRNRQVQLVINTTDGNKAISDSKSLRRATLMQKVPYYTTMAGAEAAAQAIKALKAGNLEVRPLQSYFA

SEQ ID NO: 42972 - protein, 92 aa, Triticum aestivum
  misc_feature (14)..(14): Xaa can be any naturally occurring amino acid
  misc_feature (73)..(73): Xaa can be any naturally occurring amino acid
  unsure (1)..(92): unsure at all Xaa locations
MAFSMLSFGTMAAXSAAQATMVAHFNGLMSSAVFPATATANNDTTCMTSNGGRGNCMQVWPTIVKKKIETLSXLSDPTDSAWAYEVDYLIRN

SEQ ID NO: 42973 - protein, 479 aa, Mesorhizobium loti MAFF303099
MAQFRKNLIDGEWVGDAGSHNINPSDTGDVVGEYASAGVEQAKQAIAAAKAAFPSWSRSGPLARHAVLKKASDEIMARKDEIGRNLAREEGKTLAEGIGETIRAAQIFDFFAGETLRLTGEMVPSVRPGVGVEITREAVGVVGIITPWNFPIAIPAWKIAPALAHGNTIVFKPAELVPESAWSIVDILHRAGLPKGVLNLVMGKGSVVGQAMLDSPDINAITFTGSVGTGKRVAAASVEHMRKFQLEMGGKNPLVVLDDADLAVAVDCALNGAFFSTGQRCTASSRLIVTEDIHDRFVEALKERMGKLVIGDALDAQTQIGPVVDATQLKQDEDYIAIGVREGATLAFGGERLDRKTPGFYLSPALLTEATNAMRSSREEIFGPVASVIRVKNYDEALSVANDTPFGLTSGICTTSLKHATHFKRNSEAGMVMVNLPTAGVDFHVPFGGRKGSSYGPREQGRYATEFYTTVKTAYTFAG

SEQ ID NO: 42974 - protein, 92 aa, Leptospira interrogans serovar Lai str. 56601
MEFLLQLENILKKRKQDLPDKSYTADLFRGGVDRILKKVGEEAGEVIIAAKNSDKKELTHEVADLLFHLQVLLVEQGLSLQEIVEELHKRHS

SEQ ID NO: 42975 - protein, 370 aa, Triticum aestivum
  misc_feature (217)..(217): Xaa can be any naturally occurring amino acid
  misc_feature (256)..(256): Xaa can be any naturally occurring amino acid
  unsure (1)..(370): unsure at all Xaa locations
MGRDQQAGAAAAHREKVKLFMGVLALQFLLAGFHIVSRAALNMGISKLVFIVYRNVISLALLAPFAYFLEKKDRPPLTFSLLAEFFVLALIGITANQGFYLLGLYHLSPTYASAIQNMVPAITFVLAAVLRLEQVDLGRRHGVAKVVGTVVSIGGATVITLYKGLPLFSHNLHVQAVLSWTSGSPIFNWTLGCVFILGHCLSWSGWMVLQVPVLKRXYPARLSVISLTCVFGLLQFLVIAAFTEEDLSRWKVRSGXELFTILYAGLVASGVAFALQIWCIDRGGPLFTAVFQPVQTVAVAVMAAIILGDQLYTGGIIGAVLIVIGLYFVLWGKSEEKKTRSQDPEMARHLLGEDGCAADKDQQVSTTVLA

SEQ ID NO: 42976 - protein, 254 aa, Leptospira interrogans serovar Lai str. 56601
MIDLKGKNAVVTGAARGIGKSTALTLAKAGANLVIADLNEESSKATADEISKQTGVKAIGIGTNVSDVDSAAKAIQACVDEFGSVDILVNNAGITKDTLLMRMKKEQWDAVIAVNLTGTFNCTQAAIKFMMKNPNGGSIINLSSIAGVNGNIGQTNYSASKAGVIGFTKAVALEMASRKVRCNAIAPGFIATEMTDAIPEKIRTAMVAAIPLKRAGQPEDIANTIAFLASDISSFITGQVIEVNGGGFLPGATA

SEQ ID NO: 42977 - protein, 151 aa, Methanothermobacter thermautotrophicus str. Delta H
MMEKSFVMLKPDAVKRRLAGRIIARFEDRGLKIVAFKMLQIPEDLAMEHYQEHREKPFFRDLVDYITSAPVIAMVIEGKDCISLIRKMVGATNPAEADLGTIRGDFALETGRNIIHASDSPESAEREIKLFFDESEICSYEMPDREMIYEE

SEQ ID NO: 42978 - protein, 467 aa, Bacillus cereus ATCC 10987
MKSLLRKKAITTESPRQLQRTLTALDLTFLGIGAVIGTGIFVLTGIVAAKHSGPGIMLSFLIAAFTCACVAFCYAEFASSIPVSGSVYTYAYMTVGEVVAFIVGWCLMLEYLLAVAAVAVGWSGYLQSLLQGFNIHLPAIIASAPGVGKGGLIDLPAVCILLIITGLLSFGIRESARINNIMVLIKLAVIIAFIVAGAKYVKPENWTPFIPFGYDGIITGAATVFFAFLGFDAIATAAEETKKPQRDLPIGIIGSLLICTVLYMIVSFVLTGMVPYTQLDVSDPVAFALHFVGEDTIAGLLAVGAMTGMTTVLLVVMYGQVRVSYAMSRDGLLPKALARVNKRVKIPLLNTWITGVVAALLAGLLDLHVLANLVNIGTLTAFTFVCCAVLILRKTHPDLKRGFRTPFVPVLPVVAILCCLYLMANLSKTTWISFIAWLIVGLCFYFFYSRKHSHLATEKANDEQKKA

SEQ ID NO: 42979 - protein, 277 aa, Nostoc punctiforme PCC 73102
MRYRALIVAFLALCLGLITACSDAPATSSRDVLTYDQIRGTGLANKCPQLAETSRGSIPIDSSQSYAIKELCLEPTSFFIKEEPANKRQEAEFVAGKLLTRYTSTIDQVQGNLKINSDNSLTFEETDGLDFQAITVQLPGGERVPFLFTIKNLVAQTQPSLSSINTSTDFEGTFKVPSYRGAAFLDPKGRGVVSGYDNAVALPAQADDEELTRTNVKRAENLNGKISLQIAKVDSSSGEIAGTFESEQPSDTDLGAGEPKEVKIRGLFFARVESTRS

SEQ ID NO: 42980 - protein, 102 aa, Synechococcus elongatus
EFNVPSYRTANFLDPKGRGLASGYDSAIALPQAKEEELARANVKRFSLTKGQISLNVAKVDGRTGEIAGTFESEQLSDDDMGAHEPHEVKIQGVFYASIEPA

SEQ ID NO: 42981 - protein, 179 aa, Glycine max
YNKAFEEKKTELQTKVVEIYEASSTEIKSLVKEPKEAGLKKNSTEVQKFLEELVKIDFPGSKAASEASSKFGPALASGSVFFVFEKVSTFIVTEEKDVEAPPGVETKTEEETSSVVKEREIVVEEEKKKEKKEEEKPQVIETSDEKKVEEKPAETSAKGEEKPAEEAAAVVEQAEPPKP

SEQ ID NO: 42982 - protein, 267 aa, Antirrhinum majus
YFWEAKGQTPLFPRIFGHEAGGIVETVGEGVTELQPGDHVLPIFTGECKECRHCKSSESNMCDLLRINTDRGVMIGDGKTRFFKNGQPIYHFLGTSTFSEYTVLHVGCVAKINPEAPLGKVCVLSCGISTGLGATLNVAKPTKGSTVAIFGLGAVGLAAAEGARMAGASRIIGIDLNPSRFNEAKKFGITECVNPKDHNKPIQEVLAEMTDGGVDRSVECTGNVNAMISAFECVHDGWGVAVLVGVPNKDDAFKTHPVNLLNGRTLK

SEQ ID NO: 42983 - protein, 115 aa, Streptococcus pneumoniae R6
MNPLIQSLTEGQLRTDIPSFRPGDTVRVHAKVVEGNRERIQIFEGVVIARKGAGISENYTVRKISNGIGVERIFPIHTPRVEKIEVVRYGKVRRAKLYYLRALQGKAARIKEIRR

SEQ ID NO: 42984 - protein, 125 aa, Triticum aestivum
MSAMETDAPDAPPPAAPAPAADAGAGSSSSSSRKPGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 42985 - protein, 279 aa, Brassica napus
  misc_feature (262)..(262): Xaa can be any naturally occurring amino acid
  unsure (1)..(279): unsure at all Xaa locations
MAISYNALAQSLPGRSSFFVPKALCIKQRSRSTVVFASNDKNIIALQAKVDTLLDRIKWDEKGLAVAIAQNVDTGAVLMQGFANREALSTTLTSRKATFFSRSRSTLWTKGETSNNFINVLDVYLDCDRDSIIYLGTPDGPTCHTGAETCYYTSVLDQLNNDEASGEKLASTTLYSLESIISKRKEESTVPQEGKPSWTRRLLTDDALLCSKIREEADELCRTLEDKEEVSRTASEMADMLYHAMVLLSKRDVKFEDVLEVXRKRFSQSGIEEKQSRSK

SEQ ID NO: 42986 - protein, 1530 aa, Schizosaccharomyces pombe
MNQNSDTTHGQALGSTLNHTTEVTRISNSSDHFEDSSSNVDESLDSSNPSSNEKASHTNEEYRSKGNQSYVPSSSNEPSPESSSNSDSSSSDDSSVDRLAGDPFELGENFNLKHYLRAYKDSLQRDDIITRSSGVCMRDHSVYGVGSGYEFLKTFPDIFLQPYRAITEKQVVEKAILSHCHALANAGELVMVLGQPGSGCSTFLRSVTSDTVHYKRVEGTTHYDGIDKADMKKFFPGDLLYSGEHDVHFPSLTTAETLDFAAKCRTPNNRPCNLTRQEYVSRERHLIATAFGLTHTFNTKVGNDFVRGVSGGERKRVTISEGFATRPTIACWDNSTRGLDSSTAFEFVNVLRTCANELKMTSFVTAYQASEKIYKLFDRICVLYAGRQIYYGPADKAKQYFLDMGFDCHPRETTPDFLTAISDPKARFPRKGFENRVPRTPDEFEQMWRNSSVYADLMAEMESYDKRWTETTPASSEDPEKDNFGSDISATTKHELYRQSAVAEKSKRVKDTSPYTVTFSQQLWYCLARSWERYINDPAYIGSMAFAFLFQSLIIGSIFYDMKLNTVDVFSRGGVLFFSILFCALQSLSEIANMFSQRPIIAKHRASALYHPAADVISSLIVDLPFRFINISVFSIVLYFLTNLKRTAGGFWTYFLFLFIGATCMSAFFRSLAGIMPNVESASALGGIGVLAIAIYTGYAIPNIDVGWWFRWIAYLDPLQFGFESLMINEFKARQFECSQLIPYGSGYDNYPVANKICPVTSAEPGTDYVDGSTYLYISFNYKTRQLWRNLAIIIGYYAFLVFVNIVASETLNFNDLKGEYLVFRRGHAADAVKAAVNEGGKPLDLETGQDTQGGDVVKESPDNEEELNKEYEGIEKGHDIFSWRNLNYDIQIKGEHRRLLNGVQGFVVPGKLTALMGESGAGKTTLLNVLAQRVDTGVVTGDMLVNGRGLDSTFQRRTGYVQQQDVHIGESTVREALRFSAALRQPASVPLSEKYGYVESVIKLLEMESYAEAIIGTPGSGLNVEQRKRATIGVELAAKPALLLFLDEPTSGLDSQSACSIVCFLRKLADAGQEILCPIHQPSAVLFDQFDRLLLLQKGGKTVYFGDIGEHSKTLLNYFESHGAVHCPDDGNPAEYILDVIGAGATATTNRDWHEVWNNSEERKAISAELDKINASFSNSEDKKTLSKEDRSTYAMPLWFQVKMVMTRNFQSYWREPSILMSKLALDIFAGLFIGFTFYNQGLGVQNIQNKLFAVFMATVLAVPLINGLQPKFIELRNVFEVREKPSNIYSWVAFVFSAIIVEIPFNLVFGTLFFLCWFYPIKFYKHIHHPGDKTGYAWLLYMFFQMYFSTFGQAVASACPNAQTASVVNSLLFTFVITFNGVLQPNSNLVGFWHWMHSLTPFTYLIEGLLSDLVHGLPVECKSHEMLTINPPSGQTCGEYMSAFLTNNTAAGNLLNPNATTSCSYCPYQTADQFLERFSMRYTHRWRNLGIFVGYVFFNIFAVLLLFYVFRVMKLRSTWLGKKITGTG

SEQ ID NO: 42987 - protein, 224 aa, Archaeoglobus fulgidus DSM 4304
MAKRGEIDPWNIDVVDVTDRFLKRIEDAKKLDLRVSGRVLLYAAILVRMKAEAITLEALGGDEEEELEMYDYDSFYFLDEPLEFPEEVDEEELDEVILEALTSMRRRVRKITTLKDLIDELRRAEEVERRRRRRRRRERQEEVGIDAALRVPHEESLEEMIARVEREVFEALRKKDTVTLFSLVKSWDVPTLVDYYVSVLHLAFRKKVEIRQEEFYGDVEIQKF

SEQ ID NO: 42988 - protein, 337 aa, Haemophilus influenzae Rd KW20
MPNFSFVFFYDSAKITPISTALLGRRMNYLKIAQDSLSVESNALLQLSQRLGDDFNQVIDLILACEGRLVIGGIGKSGLIGKKMVATFASTGTPSFFLHPTEAFHGDLGMLKPIDIVMLISYSGETDDVNKLIPSLKNFGNKIIAVTSNKNSTLARHADYVLDITVEREVCPNNLAPTTSALVTLALGDALAVSLITARNFQPADFAKFHPGGSLGRRLLCKVKDQMQTRLPTILPTTNFTDCLTVMNEGRMGVALVMENEQLKGIITDGDIRRALTANGAGTLNKTAKDFMTSSPKTIHQDEFLSKAEDFMKAKKIHSLVVVNDENHVVGLVEFSS

SEQ ID NO: 42989 - protein, 250 aa, Leptospira interrogans serovar Lai str. 56601
MGMSFRDHFSSHSSFYSEFRPGYPKDLFYYLKNLSPHGKTVWDCGTGTGQAAVPLGELFEKVIASDPSENQIVNAEPHQNVEYRVCKAENSTLGNHEVDLITVAQAFHWFDFNPFYKEVIRVGKKKGILAIWGYGLHSISSEIDGLVDKLYGEIVGPYWPSERKYVEEKYKTIPFPFEEIVPPHFSMKEEWNVDQLLGYLRTWSSVQKYIQKNESDPVLLVEEYIRNSWGPTQTKIVEWPLFFKIGRLPD

SEQ ID NO: 42990 - protein, 399 aa, Arabidopsis thaliana
MASATFSVAKPSLQGFSEFSGLRNSSALPFAKRSSSDEFVSFVSFQTSAMRSNGGYRKGVTEAKIKVAINGFGRIGRNFLRCWHGRKDSPLDVVVINDTGGVKQASHLLKYDSTLGIFDADVKPSGDSALSVDGKIIKIVSDRNPSNLPWGELGIDLVIEGTGVFVDRDGAGKHLQAGAKKVLITAPGKGDIPTYVVGVNAELYSHEDTIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDAAEKELKGILDVCDEPLVSVDFRCSDVSSTIDSSLTMVMGDDMVKVIAWYDNEWGYSQRVVDLADIVANNWK

SEQ ID NO: 42991 - protein, 465 aa, Brucella suis 1330
MNDKKPAPKRGNKKPQTNSNSAADLRPGLAARLCAARLLGAVIEKNTSLDGLTDNAHGHPQYLALEPRDRALVRAILGSALRNRGSIERAINKRLDRPLPENAVALKHLLHVAVAQIFYLDLPDHSAVDLAVEAANSDPRNRKYAGLVNALLRHLARNKERALAHTFEPEANVPEWFAKSITDAYGTEKAATILAMHAYEPPIDFTVKGDAKAWAEKLGGVALPNGSVRLQTVEGNLTDLPGFAEGEWWVQDVAASLPARLMGDIKGKRVADLCAAPGGKTAQLVLQGADVTALDLSENRLKRLNANLERLGFEAKTVATNLMDFKPDELFDAVLLDAPCSSTGTVRRHPDVPWTKTPQDIAKLAELQGKLLAHAATLVKPGGVIVFSNCSLHPLEGEEMARKAPENPLLEPFPITEQDCPGLEGLVTAEGFLRSTPADLPPDRLDGNPHMAGMDGFFAARFKRV

SEQ ID NO: 42992 - protein, 236 aa, Sophora flavescens
TSGKLRGKLLYFPRIFGHEAAGIVESVGEGVSNVQVGDHVLPVFTGECGECAHCKSEESNMCALLRIDTIRGVMHSDGKCRFSINGTPINHFVGTSTFSEYTVVHSGCLAKINPQAPMDKVCILSCGISTGLGAALNVAKPKKGSTVAIFGLGAVGLAAAEGARIAGASRIIGVNLNPKRFELAKNFGVTEFVNPKDHDRPVQEVIADMTNGGVDRSIECTGNINFMISAFECVHD

SEQ ID NO: 42993 - protein, 236 aa, Wisteria floribunda
TSGKLRGILLCFPGIFGHEASGIVESVGEGVTDLQVGDHVLPVFTGECGECAHCKSEESNMCDLLRIDTDRGVMHSDGKSRFSINGTPINHFVGTSTFSEYTVVHSGCLTKINPQAPLDKVCILSCGISTGLGATLNVAKPKKGSTVAIFGLGAVGLAAAEGARIAGASRIIGVDLNPNRFEEAKKFGVTEFVNPKDYDKPVQEVIAGMTNGGVDRSIECTGNINAMISAFECVHD

SEQ ID NO: 42994 - protein, 235 aa, Wisteria floribunda
PRIFGHEASGIVESVGEGVTSLKPGDHALPIFTGECGERAHCKSNESNLCDLLRINTERGVMLADGKTRFSKDGKPIYHLVGTSTFSEYTVLHVGCVAKINPAAPLDKVCVVSCGFCTGHGATVNVAKPKPNSTFAVFGLGAVGLAAAEGARLSGASRIIGVDLVPGRFEQAKKFGVTDFVNPKDHNKPVQEVIIEMTDGGVDRAVECTGHIEASIQAFECVHDGWGVAVLVGVP

SEQ ID NO: 42995 - protein, 425 aa, Erwinia carotovora subsp. atroseptica SCRI1043
MVNNDKHDPLMLARQLPLKSVALILAGGRGTRLKGLTALRAKPAVHFGGKFRIIDFALSNCLNSGIRRIGVITQYQSHTLVQHIQRGWSFLNAEMNEFVDLLPAQQRYSTDHWYRGTADAVCQNLDIIRRYRAEYMVILAGDHIYKMDYSRMLIDHVEKGAECTVACLPVPLEEASAFGVMSVDKQHRILDFAEKPDNPTPMPDNPDMALASMGIYVFNADYLYQLLETDRNASDSAHDFGQDLIPKIVSQRLAWAHPFTLSCVTSGEDEHQYWRDVGTLEAYWRANLDLASVTPELDVYDRHWPIRSAIESLPPAKFVQDRSGSHGMTMNSLVSGGCIVSGSVVTHSVLFPRVRVNSFCSIDSTVILPDVNVGRSCRLRRCVIDRACHLPEGMVIGENAEEDSRRFYRSEEGIVLVTRSMLEKL

SEQ ID NO: 42996 - protein, 448 aa, Streptococcus pneumoniae R6
MTSAKEYIQSVFETVKARNGHEAEFLQAVEEFFNTLEPVFEKHPEYIEENILARITEPERVISFRVPWVDRDGKVQVNRGYRVQFNSAVGPYKGGLRFHPTVNQGILKFLGFEQIFKNVLTGLPIGGGKGGSDFDPKGKTDAEVMRFCQSFMTELQKHIGPSLDVPAGDIGVGGREIGYLYGQYKRLNQFDAGVLTGKPLGFGGSLIRPEATGYGLVYYTEEMLKANGNSFAGKKVVISGSGNVAQYALQKATELGATVISVSDSNGYVIDENGIDFDLLVDVKEKRRARLTEYAAEKATATYHEGSVWTYAGNYDIALPCATQNEINGEAAKRLVAQGVICVSEGANMPSNLDAIKVYKENGIFYGPAKAANAGGVAVSALEMSQNSLRLSWTREEVDGRLKDIMTNIFNTAKTTSETYGLDKDYLAGANIAAFENVANAMIAQGIV

SEQ ID NO: 42997 - protein, 145 aa, Triticum aestivum
ILRPIHYSGRAIESKHGSDHGANAHTDYGMLTLLSTDGTPGLQICRDKDGRPQLWEDVHHIDGALVVNIGDLLERWTNNVYRSTLHRVLMVGKERYSVAFFVWPSPDTMVTCIESCCSEANPPRYPPIRSDEYLEQRLTSTYKYK

SEQ ID NO: 42998 - protein, 476 aa, Alteromonadales bacterium TW-7
MTSPISPSSNSSAHTLGTCSLFYVIFISAVAAIGGFLFGFDSGVINGTVSALGNAFNSSSVATGFNVASVLLGCAVGALAAGPLADKFGRRAIMIFTAIIFAISAFGSGISESSAEFIFYRLFGGLGIGAASVLAPAYIAEVAPPALRGRLATLQQLAIVLGLFAAFLSNYLIADAAGSAQNILMLDIAAWRWMFWVELVPAILFLVGVLFIPESPRYLVAQGKVDDAKTVFSKISNDSADAQISDVKSSLHSDKKPSIRDLFIDGSKKVHPIVWAGVALSVFQQFVGINVVFYYGSELWQAAGFDESQSLFINVLAGTTNIVSTFIAIALVDKIGRKPLLLVGSVGMFISLSALTYIFGSAGLDEAGKLALSDNMGTFALIMANLFVVFFGLSWGPVVWVLLGEMFNNRIRGAALAVAASAQWIANFAITMTFPIMLANIGLASAYGFYALSALISIFFVAKYINETRGKTLESM

SEQ ID NO: 42999 - protein, 400 aa, Campylobacter lari RM2100
MSSILSIKDIDLAKKKVFIRCDFNVPQDEFLNITDDRRIRSAIPTIRYCLDNGCAVILASHLGRPKEIASKYSLEPVAKRLARLMAKDVIMAKDVIGEDAKKKASELKSSEILLLENLRFEKGETKNDENLAKELASMADVYINDAFGVCHRAHASVEAITKYFDNTHKGAGFLLQKEIEFASNLIKHPARPFVAVVGGSKVSGKLQALTNLLPKVDKLIIGGGMAFTFLKAQGYDIGNSLLEEDLIEEANKILLKGKNLGVKIYLPVDVTAAQTCSQEAVMKYTPVQEIPAGWMGLDIGPASVRLFKEALSDAQTIWWNGPMGVFEIDKFSKGSIKMSHYISESHATTVIGGGDTADVVARAGDADEMTFISTGGGASLELIEGKELPGVKPLTIKDSE

SEQ ID NO: 43000 - protein, 400 aa, Rhizobium leguminosarum bv. viciae 3841
MAFLADALSRVKPSATIAVSQKARELKAKGRDVIGLGAGEPDFDTPDNIKTAAIDAINRGETKYTPVSGIPELRKAIAAKFKRENGLDYSWEQTIVGTGGKQILFNAFMATLNPGDEVVIPAPYWVSYPEMVALCGGTPVFVSATQEHNFKLQAADLEKAITPKTKWFIFNSPSNPTGAAYTQDELKALTDVLMKHPQVWVLTDDMYEHLTYGDFKFVTPVEVEPKLYDRTLTMNGVSKAYAMTGWRIGYAAGPIQLIKAMDMIQGQQTSGATSIAQWAAVEALNGTQGFIPANKKIFEGRRDLVVSMLNQAKGIVCPVPEGAFYVYPSCAGLIGKTAPSGKVIETDEDFVSELLETEGVAVVHGSAFGLGPNFRISYATSEELLEEACRRIQRFCGACK

SEQ ID NO: 43001 - protein, 505 aa, Myxococcus xanthus DK 1622
MPIVHDWLARRAALAPERTALIDADHGERRISFREWNDSASRTAAFLHHALGVGRGDRVAVLAYNCVEFLDLFFACAKLGAVLQPLNWRLSATELGGLLADAEPSVFVFGPEFRTQVEAVRSGASFVRHWLSLAAPGPSERAFSERDTQTDVALPPLELEEDAPWVLCYTGGSTGLPKAAVLTHRSITANAVNTVMGWGLTADDVAILNAPLFHAGGLSVFTAPLAYAGGASVVCRSFDVEGVFDLVRRGVVSLFFGVPTMFIEMQRHPRFDAVDLSRLKLVISGGAPCPAPVFERFFARGVDFKTGYGLTEAGPNNFWLPPEDVRRKPGAVGVPLFHVEARIDGETQPGDVGELLLRGPHLCAGYWRRPGDTARTFADGWLHTGDLATRDAEGCFRIVGRSKDLIISGGENIYPSEVESVLAGHPDVAEVAVIGVADPKWGETPRALVVARPGTSPSAEALLRFCDGRLARYKTPKSIRFVDALPRTSAGKVDRRTLGAAHGAP

SEQ ID NO: 43002 - protein, 639 aa, Mesorhizobium loti MAFF303099
MSGVAGILLRQEAPADAATDIQRMLARMRHRGPDGNSWWLDSGIALGHAWLNTTDEAGPGPLTMAGGKLAITADCRLDNRDELMARLGIRDRSVADAVLLMRAYLRWGESCPVHLQGDFAFAIWDAERQLLFCARDHFGVKPFYYHAADRRFAFASEIGPMLGLDGVGARISEHRISGFLAGLPDDPQSTPYSDIFTLPARHSLTVTAQQVVLRRYWQIEPSVRPARSDAAEEFAHLFSQSVRNRMRGSRSVGAMLSGGLDSSSIACVAGLQNAAERKPKLPTFSLVFEKGSSMDERAFIDAVLDQHKTDPTLIPVGNYAPFAEFERVLEEQEGTFLAPGLTLTRGIYRTAGAKGIKVLLDGHGGDEVVSQGHGHLHELANGGRWLDLWREVRSASNTYGDSTLGLYFQFLTLYGPAWRIAKARQLANRALNRIRKPTQMQRGRSWRDLINPDLARRTELIDRFHRAGYMPPGVQASDALSHRWILSNGYVPHSFEVLDKAAANFGVEPRYPFWDKPLVEFCLALPGEEKLSHGFGRYVLRRAMEGILPAAVQWRRDKIDFTANLVNGMVRNHRDLLEQLLVSDAGRIAPYVNLPQVSAAYARLLSQPDQVASLDVQYVWRSASLSLWLRQVQHGGSPA

SEQ ID NO: 43003 - protein, 232 aa, Wolbachia endosymbiont of Drosophila simulans
MNGMRSSFVDFIGKLNNKSNEITSKLVICPPFTSFPSSIELNNNINIGAQNCHHKKFGSYTGEISAEMLKELGCTYVILGHSERANEKDSEIKLKSEIAIESGLHPIICVGENSEDYKNEKTKEVIEYQCKNRLPTHGEYTVAYEPIWAIGTGHVPNNDAIAKVIEVIKLCTSKKHIIYGGSVSSENIENLLNISNLSGVLIGSASLDFDHFYKIIQQVEKKFSLINSKISN

SEQ ID NO: 43004 - protein, 212 aa, Kluyveromyces lactis NRRL Y-1140
MSEAAGKTLRKYKIVFLGEQGVGKTSLITRFMYDTFDDNYQATIGIDFLSKTMYLDDKTIRLQLWDTAGQERFRSLIPSYIRDSHVAIVVYDVTNRKSFEYIDKWIEDVKMERGEENVILVIVGNKSDLVEERQVSTEEGERKSTVLNAKLFIETSTKAGFNVKTLFKKIAKLLPEFQDAQSTPLDNDTNDKKPGVINLAAPDESQQSNGCC

SEQ ID NO: 43005 - protein, 567 aa, Kluyveromyces lactis NRRL Y-1140
MSKLSRKYHLPYTRAIIGENGLLIKDQFTSGPSTSSSTLLARRSNGGDFGDDEDDEDGDASGSFQSSVFETASLISCVTCLSDTESKDENEALLLPSNTVIPYAKILDVTNMEAEDDGSPWPDHTALIEVTFAKPRRNHLVPKTIKLSVDTSVFPNMGTDVAEEILNRSYKNTKRNKSILVIINPHGGKGKANKLFLSKAKPILLASGCKIVVKETTYHLHAVDIAKNLDIDEYDVVACASGDGIPHEIMNGLFLRSDRAKAFQKLAITQLPCGSGNAMSISCHGTSNPSYAALALLKSVESRIDVMCCTQPSYKNQPRLSFLSQTYGIIAESDIDTEFIRFIGPARFELGVTMNVLQRKKYPCDIYFKYAAKTKNELKDHYLQHKDRLNNLRNDLESSSTFTLDIPRSGKESNLDDITITDDSFKLRWPFEDDVPSDWERIDPELTRNTGIFYTGKMPYIAPDTKFFPAALPDDGTMDFVLTDGRTPLTRIAPILMSLNRGSHVLQPEVEHSKILAFRLVPYAKNSVISVDGENFPYETLQVEVLPKLVKTLLKNGSYVETDFESM

SEQ ID NO: 43006 - protein, 398 aa, Zea mays
MPLSSFSFLRHHLPLPLQLPPTSNRQPPHPRLFHLLLPPFTPRRTFVCQPLTAATDDMAAAAAAASPPTLLEHMGQAGTAADLTVLVAHIQSACKRIAALVASPGNAELSRAKARGGAMAAGRDAPKPLDELSNDIILSALQSSGKVAALASEENDLPIWISDGGPYVVVTDPLDGSRNIEVSIPTGTIFGIYNRLVEVDHLPLEERAQLNSLQSGTRLVAAGYVLYSSATILCISFGAGTHAFTLDWSTGEFILTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKNRILTIQPVKLHQRLPLFLGSMDDMLELESYGDVQQKVNPGYEV

SEQ ID NO: 43007 - protein, 658 aa, Erwinia carotovora subsp. atroseptica SCRI1043
MAELQTGKPTPLGASFDGNGVNFALFSADAERVELCVFDERQQEQRIVLTARSGDIWHGYLPDAQPGLRYGFRVDGPFEPSQGLRFNPHKLLLDPCARQLDGWVVDDASLQGGIDQRDERDSAEIMAKCVVTAEDYDWQDDQHPQTPWNQTVIYEAHVRGLTQLHPDIPEDIRGSYAALGHPVMIDYLTSLGITALELLPVQQHADEPRLQQIGLRNYWGYNVLLPFAVDNSLAAGDDALNEFRDAVKALHNAGIEVILDVVFNHSAELDVEGPTLCQRGIDNRSYYWLGDSGEYHNWTGCGNVLRLNHPAVMDWVMDCLRFWREVCHVDGFRFDLATVLGRTPDFTAAAPLLSAMKNDNRLQGCKLIAEPWDIGHGGYQLGQFPTPFAEWSDRYRDDMRRFWLHGDISLGAFARRFAASSDIFQQRDRLPYASINKLTAHDGFTLRDLVSFNHKHNDANGEGNRDGTDSNFSNNHGTEGLEADDDIHQRRQASQKALLTTLILSQGTPMLLAGDELGHSQQGNNNAYCQDNELTWLHWDHADRGLREFVAGLIQLRRTIPALQQETWWQEGDGAVQWLNREGQPLTPPQWEQGEHQLQILLSGRWLVLVNASLHAGAFMLPEGHWQVSPPFDETNPPEGGMWHGQAQAVCVLIKQTA

SEQ ID NO: 43008 - protein, 145 aa, Oryza sativa (indica cultivar-group)
MGFSETQEELVLRSWQSMKKDSESIALKFFLRIFEIAPAAKQMFSFLRDSGDDVPLESHPKACESATQLRKTGDVKVREATLRRLGATHVKAGVADAHFEVVRTALLDTIKDAVPEMWSPEMRGAWEEAYDQLAAAIKEEMKKAA

SEQ ID NO: 43009 - protein, 237 aa, Xanthomonas campestris pv. vesicatoria str. 85-10
MSHSASRRKLLQCACCAPIAAAAASLPFALRAAPSKKTDLNAEQALQILRDGNNAFVENRPKKVISDSKRRLELALGQTPFVILVSCSDSRVPPELLFGRGLGEMFIVRNAGNTVDTTALGSIEYAVSQLGVPLVVVMGHESCGAVAAAVSVVENNTFFPGAIGSMIEPIVPAVLTAKAKGGTDLLADSVKANVKRTVDRLRAASEPALLEPLRAGNVRVVGAYYTLQDGKVDFFDV

SEQ ID NO: 43010 - protein, 395 aa, Oryza sativa (japonica cultivar-group)
MDLYLMFHSVLMHVAAALVVLVYIPLSMPVKLFLWAFVKPLRKESLRGKVVLITGASSGIGEELAYQYAAQGACLALVARRKKALEGVAAAALERGSPDVLVLPADVSDADQSRRAVEETVAHFGKLNHLVANAGIWSSCSFDEVTNITAFTKMMDVNFWGSVYPTYYALPHLKASKGKLVVSCSAAGTVGTSRMSFYNATKAAQLRFYETLRAELGSEVGITVLTPGYVESEITKGKGIQSGGDVAVNEEARDEQIGVFPVGRVAELGEVAMDGIRAGDWYVTWPSLFRPLQLVACLAPGVLDWACRALYGTRKGARPPLGKRIMEATGMKRLFPEALRRNPAIKTEDEEYCDGEEGYGAADDAAAAYLLQCRKGLRAAHTYIRCIFSLSDSIL

SEQ ID NO: 43011 - protein, 555 aa, Zea mays
  misc_feature (51)..(51): Xaa can be any naturally occurring amino acid
  misc_feature (109)..(109): Xaa can be any naturally occurring amino acid
  misc_feature (134)..(134): Xaa can be any naturally occurring amino acid
  misc_feature (256)..(256): Xaa can be any naturally occurring amino acid
  misc_feature (272)..(272): Xaa can be any naturally occurring amino acid
  misc_feature (296)..(296): Xaa can be any naturally occurring amino acid
  misc_feature (327)..(327): Xaa can be any naturally occurring amino acid
  misc_feature (351)..(351): Xaa can be any naturally occurring amino acid
  unsure (1)..(555): unsure at all Xaa locations
MYTLPVRATTSSIVASLATPAPSSSSGSGSGRPRPRLIRNAPVFAAPATVXCKRDGGQLRSQTRERSREKGRASTPADGDKRGGERGQRRGGEEEEEDEQLPLPSEKKXGGASEGEAVHRYPHLVTPSEPEALXQPPPPPSKASSKGMDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGXIRALLSLKDGAPDNFXFVEDWVRIGSPAKNKVKKEHASVXPFDDQCSILEKEAVNVSLQNLKSYPFVKEGXLAGGTLKLVGAHYDFVKGQFVTWXEPPQDAIERLTSGFQQFKVNVYDKKPELFGPLKSGQAPKYMVFACSDSRVCPSVTLGLQPGEAFTVRNIAAMVPGYDKTKYTGIGSAIEYAVCALKVEVLVVIGHSCCGGIRALLSLQDGAPDTFHFVEDWVKIGFIAKMKVKKEHASVPFDDQCSILEKEAVNVSLENLKTYPFVKEGLANGTLKLIGGHYDFVSGEFLTWKK

SEQ ID NO: 43012 - protein, 895 aa, Oryza sativa
MGHSNVWNSHPKNYGPGSRVCRVCGNPHGLIRKYGLMCCRQCFRSNAKDIGFIKPPRAGLDPEATPPASIASRFESKDQEKLGVQLSSMPQVRPASAEKPTRQWAAWTRQEEQSFFNALRLEGKNFEKITLRVQSKNKDQHQHPVAYTYILADFRGSTGEGCRANLGMDCAIISEGEWADTLTDISVGYLLTEASIGTNTDCPGTAIAKNTLFLENPCSYDSFDAAVALHASRHKTVEQPALASHSTIWGAEETCDEFSFNLAASRKQESSNTSASSCPGSDSGVLPSTSQGFQGFLQDLAGAKVADNPCMDDAKDMEALCANSPPRSKSDSGLKDQSLADLYWAQVTLTAHIAPLTRGSPVQVAVVLAHEIAWRHGHLYDDLTFDLEVLLVVREVGHWIPETFRAPLVERTVRAIDSSLALSIGRRDPRWAEFPADFLGGFVILRSHRVAMDPCPFVRVLVGNLALRMPVAPPAAGAGAGVHPSTAPCYCKIRLGRMPWQVAAAPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASNSLGYRFDLLLPGVDHAVPLAESSIAASKGGKFAIDLTSMQPQSRGGTPGCSPRGSGDFSQWPLASYSYRGFVMSSSVQGEGRCSKPTVEVGVPHVGCAEDAAAFVALAAAVDLSMDACRLFSHKLRKELSHLRSDVLR

SEQ ID NO: 43013 - protein, 70 aa, Erwinia carotovora subsp. atroseptica SCRI1043
MSGRSIILMGVSGSGKSSVGTELGRAIEAKFIDGDDLHPRANIQKMASGTPLNDNDRAPWLERISDVAYS

SEQ ID NO: 43014 - protein, 479 aa, Burkholderia xenovorans LB400
MEEARHFIGGEWSAASGGETIAVLDPSDGQPFTQLARGTAADIDAAVHAARRAFEGAWGEASAAERGRVLYRLSMLVAARQEELALLEARDTGKPLKQARADSAALARYFEFYAGAADKLHGETLPYQTGYTVLTIRDPHGVTGHIVPWNYPMQIFGRSVGAALAAGNACVVKPAEDACLSVLRVAELAAEAGLPAGALNIVTGYGHEAGAALARHPGIDHISFTGSPETGKLVTQMAAENHVPVTLELGGKSPQIVFADADLDAALPVLVSAIVQNAGQTCSAGSRVLIDRSIYEPLLDRLSGAFHALRVGPSHADLDCGPLISAKQQRRVWDFLSDAQHDGIPMAAHGEVIPEAPESGFYQAPTLLRDVPASHRLARDEVFGPVLAAMSFSGEDEALALANGTPFGLVAGIWTRDGARQMRLARRLRSGQVFINNYGAGGGVELPFGGVKHSGHGREKGFEALYGFTVLKTIAIRHG

SEQ ID NO: 43015 - protein, 422 aa, Oryza sativa (japonica cultivar-group)
MSSHHRYAHLLDDPFFPFPPPSSSSCPFLSPPAASSTCPFFALDSPFAADPFHLHPFLPTPPTSSLLDPFLLHTLTDRVSQLELALAARAPHPRPTSRKCTYVTESTGRKVKWTTEDKPRAGERVLKWEAELDSPYDDGFDRKWKWEAKAKTASAAATKLKWATHLKGKGCLEPWSHSYTWEEDFSATDDDDDEEIEDQLHHKALQDHSKLKTKAKDDKKKKKKDNNTVVVNKEQKKCPFSVKIEEIPPEEDNTAGCVAIRKAFALGNGKAKKKELSPQDAALLIQLNYRAHLAHRSQVLRCLRDLAVAKAKLKEIRSLFYNISYRHRMAHDHEERQRFTEKIIVLLLTVDALEGPDYMVRTAKKSMLDELEGMLEIVDPQPPGKQRSLTRRKFDLPEGGPITDEKMAGVNNAVKVIQKGKK

SEQ ID NO: 43016 - protein, 486 aa, Triticum aestivum
MTSLPERGAAPPSNPTPSLSCVGDAAVASSSSSTSSAPEEQRKDGGPKQCKASILSSVLTIFEPDQDQSGRSGGHASGSYAWSRVLRRFVGGGSMWRFLGCGKALTAADVQFLGKCYKLSSEESSSDLDSEGGHAAFLEDFSSRIWITYRKGFDAISDSKLTSDVNWGCMVRSSQMLVAQALIFHHLGRSWRKSAQNPSNPEYIRILHLFGDSEACAFSIHNLLQAGKSYGLAAGSWVGPYAMCRAWQTLIRTNREQPEVINRNESFPMALYVVSGDEDGERGGAPVVCIDVAAQLCYDFNKDQSAWSPILLLVPLVLGLDKINPRYIPLLKETFTFPQSLGILGGKPGASTYIAGVQDDRALYLDPHEVQLAVNIASDNLEADTSSYHCSTVRDMPLDLIDPSLAIGFYCRDKDDFDDFCSRASELAEQANGAPLFTVVQSVQPSKQMYNQDDGSGCSGYGVSDNIDTEDLDGSGETGEDEWQIL

SEQ ID NO: 43017 - protein, 322 aa, Oryza sativa (japonica cultivar-group)
MSSHHRYAHLLDDPFFPFPPPSSSSCPFLSPPAASSTCPFFALDSPFAADPFHLHPFLPTPPTSSLLDPFLLHTLTDRVSQLELALAARAPHPRPTSRKCTYVTESTGRKVKWTTEDKPRAGERVLKWEAELDSPYDDGFDRKWKWEAKAKTASAAATKLKWATHLKGKGCLEPWSHSYTWEEDFSATDDDDDEEIEDQLHHKALQDHSKLKTKAKDDKKKKKKDNNTVVVNKEQKKCPFSVKIEEIPPEEDNTAGCVAIRKAFALGNGKAKKKELSPQDAALLIQLNYRAHLAHRSQVLRCLRDLAVAKAKLKEIRVLTTW

SEQ ID NO: 43018 - protein, 196 aa, Arabidopsis thaliana
  misc_feature (45)..(45): Xaa can be any naturally occurring amino acid
  unsure (1)..(196): unsure at all Xaa locations
MSSSSPSGSGSDLTERRGIPAAKFIQDVETYLSQSGLDPNSALAXFHQERLQQYKVVEMKLLAQQRDLQAKIPDIEKCLEVVATLEAKKGTGEALLADFEVSEGIYSRACIEDTDSVCLWLGANVMLEYSCEEASALLKNNLENAKASLEVLVADLQFLRDQVTVTQVTIARVYNWDVHQRRVKQVTPTAIAVADS

SEQ ID NO: 43019 - protein, 126 aa, Pyrobaculum aerophilum str. IM2
MKEVIYTDKAPKPIGPYSQAVRVGNLLFVSGQIPVDPKTGEVVKGDIRDQTRQVLENIKAVLEAAGYTLNDVVMAFVFLADMNHFPLFNEVYAMYFPERPPARVTVQAARLPRDVLIEIAVIAARG

SEQ ID NO: 43020 - protein, 392 aa, Triticum aestivum
  misc_feature (330)..(330): Xaa can be any naturally occurring amino acid
  unsure (1)..(392): unsure at all Xaa locations
SFFTKASCRIRHEDGNEYIDYVGSWGPAIIGHADDEVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDVEAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVQGILDAGAKTGHEMCGGHIRGMFGFFFAGGPXVHNFDDAKKSDTAKFGRFHRGMLEEGVYLAPSQFEAGFTSLAHTTLDIEKTVEAAEKVLRRI

SEQ ID NO: 43021 - protein, 334 aa, Triticum aestivum
MESSTSRTSLNCISLVDPDIQRSVALLKQACLDSGFFYVLDHGISQEFMDEVFAESKKFFELPNSEKMKLLRNEKNRGYTPMLDEILDPENQVNGDHKEGYYIGVEVPADDPQSNRPFYGPNQWPSEEVLPKWREVMEQYHREALRVAKSVARIIALALNLDEDFFDRPEMLGDSIATLRLLHYEGGQKTGQVSNPSKGVYGAGAHSDYGLITLLATDDVVGLQICKDRNAQPQVWEYVAPVKGGFIVNLGDMLERWSNSIFRSTLHRVVLDGQERYSIAFFVEPSHDCVVECLPTCKSETNPPKFPPITCSAYLSQRYKDTHADLSTYSDGKA

SEQ ID NO: 43022 - protein, 431 aa, Leptospira interrogans serovar Lai str. 56601
METKIQNFGECSIPSPADYEYYTSDTSRLIFRTVFQSKEDWNSYVQEGPDFFEQAGPREKIYFNPQEVTAGIVTCGGLCPGINDVIRGIVMELYYRYGVSRILGFPYGYQGLVKRYSHQPIELTPEKVAHIVDEGGSMLSSSRGNQSPEEMVDSLSFYGVKILFCIGGDGTLRGARTIVDEIAKRKEKISVVGIPKTIDNDINYVQKTFGFSTAFSKAMEAVECAHVEAKGAPNGIGLVKLMGRHSGFIAVNAALASRNVNYCLIPEVDFDLFGNEAFLDDLKKRIQKKGHAVIIVAEGAGQKFFDSTEERDSSGNLKLKDIGLFLKDTMTEFFKKENIPVNIKYIDPSYIIRSIPANAEDSVFCGFLAQNAVHAGMAGKTDMVVGMWNNVFTHLPISVAIQERKVLQPDRSTLWRSLLASTGQPAHMLAK

SEQ ID NO: 43023 - protein, 225 aa, Glycine max
MLEAMESSVNGGFTHLQSCGDSSEEELSVLPRHTKVVVTGNNRTKSVLVGLQGVVKKAVGLGGWHWLVLTNGIEVKLQRNALSVIEAPTGNEEDDDLEFENMPWNGSDLASDDTQKSHKPRHRMHRTLGSSHKTMSRSFSGDSQSKGSVSMPHGSTKVDLSKLEMAALWRYWRHFNLVDAVPNPSKEQLVDVVQRHFMSQGFVKIDRDDSSLPLVTSPIRHATQE

SEQ ID NO: 43024 - protein, 213 aa, Brucella suis 1330
MADLPDSLLAGYKTFMSEHFAHETARYRDLAEKGQSPETLVVACCDSRAAPETIFNAAPGEIFVLRNVANLIPPYEPDGEYHAASAALEFAVQSLKVKHIVVMGHGRCGGIKAALDTESAPLSPSDFIGKWMSLISPAAEAISGNALMTQSERHTALERISIRYSLANLRTFPCVDILEKKGKLTLHGAWFDISTGELWVMDHRTGDFKRPEL

SEQ ID NO: 43025 - protein, 482 aa, Ralstonia eutropha JMP134
MPVFPSNQRRGDAPMTSASTTVPTDLTNERLPSGRLLALGLQHVLVMYAGTVAVPLIVGGALKLPKDQLAFLINADLFAAGLATLIQAFGFWKFGIRMPVMMGVTFASVAPMIAIGTDPNVGLLGIYGAVIASGVFGILVAPMMGRMLGLFPPVVTGTVITLIGVSLMRVGINWAAGGQPTTRAVIDGVVKEVPNLAYGDLANLGIAGLTLAVILLLTKYGRGLVANCAVLLGIIAGTFVAMAMGKVSFEGLNEASFVAVITPLHFGIPTFELSAILSMCIVMLITLVESTGMFLALSDITGKKLSNEDLTRGLRADGLGTVIGGLFNTFPYTSFSQNVGLVTVTGVRSRYVAAAGGIILIAFGLFPKMAHVVASVPQFVLGGAGIVMFGMVAATGIRILGSCDFNRNRHNLFIVAISIGFGMIPTLAPTFFQYLPKWTVPFTHSGIVLGTIVAVALNLFYNGIQSREEAMRNAAANTHGTE

SEQ ID NO: 43026 - protein, 348 aa, Arabidopsis thaliana; identical to SEQ ID NO: 1265

SEQ ID NO: 43027 - protein, 342 aa, Coxiella burnetii RSA 493
MKVLSKLKPAPGLWLHKAPTPKPGRDEVLIKIKKTAICGTDLHIYKWDEWAQKTIPVPMHVGHEFVGEIVEVGEAASALAVGDRVSGEGHITCGDCRNCRAGKRHLCRYTVGVGVNRPGAFAEYLVIPAKNAYKIPAKISDDIAAILDPFGNAAHSALEFDLVGEDVLITGAGPVGLMSAAIARHVGARHVVITDVNDYRLALAEKVGVTAAVNSTKTPLTETMKNLGMTEGFDVGLEMSGNAEAFRSMLTVMNNGGKIAFLGIPPEPFAIDWNQVVFKSLLIKGIYGRRMFETWYKMTNLLLSGLDISPIITHEFPMKDFQQAFDVMLSGKTGKVILNWEQ

SEQ ID NO: 43028 - protein, 390 aa, Dechloromonas aromatica RCB
MSHVMNTYARLPVTFSHGNGSRITDTEGKEYLDALSGIAVSTLGHAHPKLVAAIAAQAGRMLHTSNLYRIGEQEQLADKLCELSGMQEVFFGNSGAEANEAAIKLARFYGHKKNIEIPTVVVMEKAFHGRTMATLSATGNRKTQAGFEPLVAGFVRVPYGDLEAIKAVAEHNKNIVAVMLEIIQGEGGIHLADPSFYRGVRELCDAQDWLMICDEVQCGMGRTGKWFGYLQAGVQPDIATLAKGLGSGVPIGACMAGGKAAGLFGPGNHGSTFGGNPLVSTAALTTIEVIEQDDLLGNAERIGLLIRKLFAEALAGVKGVVDIRGHGLMIGLELDRPCGALVGKALAAGLLINVTADTVLRFLPPLIFSESDAHELVERTAPLIKEFLAA

SEQ ID NO: 43029 - protein, 320 aa, Bifidobacterium longum DJO10A
MPEPVRERLEALKDAPGSVIVVGSMNADYTVTTKRLPKPGETVNGGAMKVLPGGKGANQASAAARLGVNVQLLGAVGEDSNADFLLSKLDEAGVDTADILHVEGPSGTTVITVSAEGENTIVYSPGSNAKASAGYVQSHRTTIAECAVLGLCLESPIATVIAAAQTAHDAGVTVLLNDSPFMDELPHELVEATDILLVNQHEVAQLLGLPDDDVESLDWYEVAERFTDYGFDRAIVTLGASGSVVIENGRWHRVSAAQVNAVDTTGCGDSFMGTVLAGLAAGHTLLQSAQIGSYVSAYAATKLGAQSAYGTAEEVIAYFS

SEQ ID NO: 43030 - protein, 521 aa, Pueraria montana var. lobata
MLLELALGLLVLALFLHLRPTPTAKSKALRHLPNPPSPKPRLPFIGHLHLLKDQLLHHALIDLSKKYGPLYSLYFGSMPTVVASTPELFKLFLQTHEATSFNTRFQTSAIRRLTYDNSVAMVPFGPYWKFIRKLIMNDLLNATTVNKLRPLRTEQIRKFLRVMAQSAEAQQPLNVTEELLKWTNSTISMMMLGEAEEIRDIAREVLKIFGEYSVTNFIWPLMYLKVGKYEKRIDDIFNKFDPVIERVIKKRREIVRRRKNGEVVEGEASGVFLDTLLEFAEDETMEIKITKEQIKGLVVDFFSAGTDSTAVATEWALAELINNPRVLQKARDEVYSVVGKDRLVDEVDTQNLPYIRAIVKETFRMHPPLPVVKRKCVEECEVNGFVIPEGALILFNVWAVGRDPKYWDRPLEFRPERFLESGAEGEVGPIDLRGQHFQLLPFGSGRRMCPGVNLATSGMATLLASLIQCFDLQVVGPKGEILKGNDAKVSMEESAGLTVPRAHNLRCVPLARTSVAAKLLS

SEQ ID NO: 43031 - protein, 646 aa, Xanthomonas campestris pv. vesicatoria str. 85-10
MCGLAGMLLASPRLHGEQLDALVRPMGAALRHRGPDDAGTWCDAQAGVALAHQRLSILDLSPLGHQPMRSADGRYVLAYNGEVYNFAQLRAALSALGHRFRGHSDTEVLLAAVVEWGLDETLTRCNGMFAIALWDERDNCLFLARDRVGKKPLYYGWAGDTLVFGSELKALWQHPDFDNGVDRDALTLLLRLGYIPAPACIHEHTFKLMPGRVLRMDAQAVAAGAAAHRPDQAQQPFWNAREAMQRALATPFTGTDAQAEEQLDSVLRDAVALRMVADVPVGVFLSGGTDSSIVTAMMQAQSAQPVHTFSIGFEGSHHDEAPLAREVATHLRTDHTELYVSGADALAVVPGLPDMFDEPFADASQVPTALVARLARGGVTVALSGDGGDELFFGYGRYQRALRNWRMHGLVPGPLRRLMAVAARRNGESSRTGGLAALVAEAGARGIGDIYRNRISRWRDPAAVVLGATEPDSFYSLADPLHGSGTPADAMMLADFAAYLPDDLLCKVDRTTMAVGLEARAPLLDWRVAEFAWSLPLSLKYRDGVSKYLLKRVLCRYLPDAMVYRGKRGFGAPVSAWLRGDLHGWADDLLAHGALQREGVFAADSVARLWRDFNGGERKWHTHLWTVLMFQAWQAHWREQRAAVVR

SEQ ID NO: 43032 - protein, 463 aa, Oryza sativa (japonica cultivar-group)
MALLLRHSPKLRRAHAILGCERGTVVRHFSSSTCSSLVKEDTVSSSNLHPEYAKKIGGSDFSHDRQSGKELQNFKVSPQEASRASNFMRASKYGMPITANGVHSLFSCGQVVPSRCFSSGADLPPHQEIGMPSLSPTMTEGNIARWVKKEGDKVSPGEVLCEVETDKATVEMECMEEGYLAKIIHGDGAKEIKVGEIIAVTVEEEEDIGKFKDYKAPSSAESAAPAESKPQSEPTEPKKEKEQPKAPEPKATKTEESFLSEDRTFSSPIARKLAEDNNVPLSSIKGTGPDGRILKADIEDYLASVAKGAKKETAAAPGLGYVDLPNTQIRKVTANRLLHSKQTIPHYYLTVDTRVDKLIKLRSELNPLQDTSGGKKISINDLVIKAAALALRNVPECNSSWMNDFIRQYHNVNINVAVQTEDGLFVPVIRDADKKGLATIADEVKQLAQRARDNSLKPEDYEV

SEQ ID NO: 43033 - protein, 449 aa, Erwinia carotovora subsp. atroseptica SCRI1043
MLSIFRPAAHQPRVSQDHVDPVYRRLRWQIFMGIFFGYAAYYLVRKNFTLAMPYLIEQGFSRGDLGFALSGISIAYGFSKFIMGSISDRSNPRVFLPAGLILSAAVMLFMGFVPWATSSIAIMFVLLFLCGWFQGMGWPPCGRTMVHWWSQKERGGIVSVWNCAHNVGGGLPPLLFLLGMAWFNDWKAALYMPAFAAILVAMIAFALMRDTPQSCGLPPIEEYKNDYPVDYNEKAEEELTAKQIFMQYVFPNKLLWYIAIANVFVYLLRYGILDWSPTYLKEVKHFALDKSSWAYFLYEYAGIPGTLLCGWMSDKVFKGNRGATGVFFMVLVTIATVVYWMNPAGNPGVDMACMIIIGFLIYGPVMLIGLHALELAPKKAAGTAAGFTGLFGYLGGSVAASAIVGYTVDFFGWDGGFMVMIGGSIMAVLLLVVVMLNEKKHKAELANRA

SEQ ID NO: 43034 - protein, 553 aa, Agastache rugosa
MLSVASAETQNPELSSHALQPQTQSCEETNHIFVSKLPTIPISNHLPLHTYCFENFSQYPDRPCLLVGSDGKSYSFAETHLICRKVAAGLSNLGIRKGDVVMALLQNCAEFVFTFMGASMIGAVITTANPFCTSKEIFKQFNASKSKMIVTQSMYVDKLRDTGDDSLRLRRGFLRRHDRQPAGEMPAFLRANGGRRGRRPRRSRSIPTTPSRCRSLGTTGLPKGVILTHKSLITSIAQQVDGENPNLYLKPDDVVLCVLPLFHIYSLNSVLLCSLRAGAGVLLMQKFEIGALLELIQLHRVSVAAVVPPLVLALAKNPLVDNFDLSSIRMVLSGAAPLGKELEAALLSRLPQAVFGQGYGMTEAGPVLSMSPCFAKVPLPTKSGSCGNVVRNAELKVVDPETGCSLPRNQPGEICIRGPQIMKGYLNDAEATARTVDVDGWLHTGDIGYVDEDDDVFIVDRVKELIKFKGFQVPPAELEALLISHSQIFDAAVVPQKDDAAGEVPVAFVVPANGSELTEEAVKEFVSKQVVFYKRLHKVYFVHAIPKSPSGKI

SEQ ID NO: 43035 - protein, 472 aa, Haemophilus somnus 2336
MSNTTAITNVFKLIEENDIKFVLLRFTDVKGKEHGVSLPVSLVDEDLFEDGKMFDGSSVEGWKAINKADMLLMPIAETAVVDPFAQIPTLSIRCSIFEPTTMQSYDRDPRSIAMRAENYMRSTGVADDVFFGPEPEFFLFDDVRFDVSMNGNSYTVDDIEAAWNTNKHYEGGNKAYRPLKKGGYCAVAPNDIAHDIRSEMCLLMEEMGLVIEAHHHEVATAGQNEIATKFNTLTLKADETQIYKYIVQNVAYEHGKTACFMPKPIINDNGSGMHCNMSLSKDGKNIFQGDKYAGLSETALYFIGGIIKHAKALNAFTNPSTNSYKRLVPGFEAPVLLAYSASNRSASIRIPAVTNPKAIRIEARFPDPLANPYLAFSALLMAGLDGIQNKLYPGDAMDKNLYDLPPEELKDIPAVASSLSEALDNLEKDYEFLTHGKVFSKEFIDTFIAMKRKEVERLNMTPHPVEFEMYYA

SEQ ID NO: 43036 - protein, 209 aa, Glycine max
MSIAEEESPSVMPKVITFLCSLLERVAESNDHNQHLQQHQKISVFHGLTRPNISIQCYLERIFKYANCSPSCFVVAYVYLDRFTQRQPSLPINSFNVHRLLITSVMVAAKFMDDMFYNNAHYAKVGGITKVEMNFLELDFLFGLGFHLNVTPGTFQAYCVHLQREMLLIQPLNFSDSTLNLGQSLKAHLCFNEDECSHQKQKQQQQLAV

SEQ ID NO: 43037 - protein, 485 aa, Brassica juncea
MAMASLYRRSLPSPPAIDFSSSEGKKIFNEALQKGTMEGFFRLISYFQTQSEPAYCGLASLSVVLNALSIDPGRKWKGPWRWFDESMLDCCEPLEVVKEKGISFGKVVCLAHCSGAKVEAFRTNQTTIDDFRKLVMKCSTSENCHMISTYHRGVFKQTGSGHFSPIGGYNAERDMALILDVARFKYPPHWVPLKLLWEAMDSIDDSTGKRRGFMLISRPHREPGLLYTLSCKDESWISIAKYLKEDVPRLVSSQQVDSVEKILSVVFKSLPSNFNTFIRWVAELRIAEDTKQNLSAEEKSRLNLKQVVLKEVHETELFKHISKFLSTVGYEDSLTYAAAKACCQGAEILSGCSSKEFCCRETCVTCVKGPGEAEGTVVTGVVVRDGSEQNVDLLVPSTQTNCECGPEANFPAGNDVFTVLLLALPPQTWSGIKDQALMQEMKQLISMASLPTMLQEEVLHLRRQLQLLKRCQENKEEEDFAAPAF

SEQ ID NO: 43038 - protein, 287 aa, Coccidioides immitis RS
MAPDELQALVTELHGSLQNEQLDQALALLSRSKLALLQLNALIPTSSTPPRLFSLAREILELGAITSIRRGDAPSFTRYYQQLQPFYDIERHIIATQGSTSQINVHTSQRSKITGLYLLLLLSMGNNTDFHTVLEGLVEEASIQGRIVEDDPFIKYPVELERSLMEGSYDKVWRETKLENVPSPDFGLFSDILIGTIRSEIADCSEKAYPSLPISNIKNLLFFNSEGAVIEFAKERGWTLKDGRVYFPTQEEQTDEDASQSEKQILLTGGNVIENAIGYARQLETIV

SEQ ID NO: 43039 - protein, 238 aa, Triticum aestivum
  misc_feature (185)..(185): Xaa can be any naturally occurring amino acid
  misc_feature (193)..(193): Xaa can be any naturally occurring amino acid
  misc_feature (206)..(206): Xaa can be any naturally occurring amino acid
  misc_feature (229)..(229): Xaa can be any naturally occurring amino acid
  misc_feature (233)..(233): Xaa can be any naturally occurring amino acid
  unsure (1)..(238): unsure at all Xaa locations
GDFGGDNRAGISRTLHRISAIRNRQGDIVGLTCRVGRAVPGSANLLQDLVKDGGSLLLIGPPGVGKTTVIREIARMLADDYEKRVMIVDTSNEIGGDGDIPHPGIGNARRLQVPNQEMQHKVLIEAVENHMPQAIVIDEIGTKLEAMAASTIAQRGIQLVASAHGVTIENLTMNPSLDMLVGGIXSVTLGDEXASRRRVQKTVLEXKGPSTFAYAVEIVSKTELRVHRXLEAXVDALL

SEQ ID NO: 43040 - protein, 450 aa, Oryza sativa (indica cultivar-group)
MARAAAAFVFVSLTLLCNASSQGEGAAAAAACRAADLVVRQRATGRVVEGKPEYAVEVANRCRWVTLRLHPVGPPLLVPHHARQDTVVAGYDVPADARVLVHVRAIAPDPASWPDRTDAFLPERFLPGAGGCDGGVDVHGQHFELLPFGSGRRISPATNLAKKMVALGVASLLQGFAWRLPDRGREHGGAGQAVHTPEGHNCHPVPLWEREFCIYVGGISWHRFCDNKRYVCMYKNIEQWDDSEAFDKFKNAKARFWANYHGQPSDISLPDPDMYIDKIDHNSKIDPELIADLNMVRLPFERDDELLPADGLGSTDTDNKCQQKQNQSGNWDIYVEKPTEVNKWEQDSRSNMDWGTKHESWNEWSKNCSGWGSALADSSALADSSWGNWNNSNNHHSSNNRDSFNGVNRNRYQDPNSISGRKRNSGGHIQQRNSRQRNQTEGYQGSTPRW

SEQ ID NO: 43041 - protein, 151 aa, Phaseolus vulgaris
  misc_feature (21)..(21): Xaa can be any naturally occurring amino acid
  misc_feature (24)..(24): Xaa can be any naturally occurring amino acid
  misc_feature (55)..(55): Xaa can be any naturally occurring amino acid
  misc_feature (59)..(59): Xaa can be any naturally occurring amino acid
  misc_feature (67)..(67): Xaa can be any naturally occurring amino acid
  misc_feature (74)..(74): Xaa can be any naturally occurring amino acid
  misc_feature (84)..(84): Xaa can be any naturally occurring amino acid
  misc_feature (93)..(93): Xaa can be any naturally occurring amino acid
  misc_feature (99)..(99): Xaa can be any naturally occurring amino acid
  misc_feature (107)..(107): Xaa can be any naturally occurring amino acid
  misc_feature (113)..(113): Xaa can be any naturally occurring amino acid
  misc_feature (133)..(134): Xaa can be any naturally occurring amino acid
  misc_feature (136)..(136): Xaa can be any naturally occurring amino acid
  unsure (1)..(151): unsure at all Xaa locations
MMLETVAAVPGMVGGMLLHLXSLXKFQHSGGWIKALMEEAENERMHLMTMVELVXPKWXERLLVLAXQGVFFNXFFALYILSPXAAHRIVGYXEEEAIXSYTQYLKXIERGAXENVPAPAIAIDYWRLPKDAXXKXVITVIRADEAHHRDV

SEQ ID NO: 43042 - protein, 318 aa, Streptomyces avermitilis MA-4680
MKPDDWEHCSGPVEEPGPGRFAGRTRVISLDPAMRGWLDDRPSYLPPVGIGEVMRAGSVIEVTASNHPDFQPGDHVVGTFGVQEHVVSDGKGAMKIDTSLAPPSTYLGALGMPGMTAYFGLLEVGALKDGETVVVSGAAGAVGSMVGQIAKAKGCRVVGIAGGPEKCALLTDELGFDAAIDYRTEDVRKALRGHAPDGIDVYFDNVGGDILDAALTRLAMHARVVVCGAISQYNNATPVKGPSNYLSLLVRRARMEGLVVFDYAKRYPQATQEISGWIGAGHIKVKEHVVRGTVDDFPETLQMLFRSENVGKLVLELA

SEQ ID NO: 43043 - protein, 175 aa, Candida glabrata CBS 138
MGAAPSKIVETLLEDTNFDRDEIERLRKRFMKLDRDSSGSIDKNEFMSIPGVSANPLAGRIMEVFDADNSGDVDFQEFITGLSIFSGRGSKDEKLKFAFKIYDIDKDGLISNGELFIVLKIMVGSNLDDKQLQQIVDRTIMENDLDGDGQLSFEEFKSAIETTEVAKSLTLQYSV

SEQ ID NO: 43044 - protein, 455 aa, Wolbachia endosymbiont of Drosophila simulans
MGVYCEIFPSNISFETISKFNGFILSGGPQSVNDDCSETSRVVHEIIKLNEATSVPILGICYGQQLICHYFGAKVKESFKQEFGRTKIKILKESPIVKDTWDVNSEVDVLMNHADSVDTIPQGFTVIASGVINQTIAMIVNEQRKIYCTQFHPEVKPTTNGSKLLSNFLDIANCKRDWTMKSFIEEQKEKIKNVVGEKKVIAAVSGGVDSSVAAALTHKAIGKQLNCIFIDTGLLRKNQTIAMLKEIPINYVDKSNLFLSRLKGITDPEEKRKIIGNTFIEVFEEEAKKIGDVDFLMQGTIYSDVVESGHASDNTSTIKSHHNVGGLPEKMNLKLVEPLRYLFKDEVRLLGKEIGLSDEIIFQHPFPGPGLAVRIISEVDKEKVQILQEVDEIYINTMKNYDLYDKIWQAFAVLLPIKTVGVMGDGRTYGYVCALRAVTSSDGMTADAFPFEDKD

SEQ ID NO: 43045 - protein, 611 aa, Oryza sativa (indica cultivar-group)
MAPSFRLSSAPESADEATAHKEIYDQLPRVAETFPSAPSLIGLPCSRHPDGWYTFTNGVVSSMVIKEHLTARATDIFLTTFPKSGTTWLKVLLYSTLHRGTDELVAHSPHQLVPFLESQVFVNDRIPDLSSLSSPRLFMTHIPSQSLPNSVATSGCKVVYLCRDPKDCFVSLWHFWNRFMPWDIDEAHRQFCDGVSQFGPFWEHILGYWRWHVEKPNQVLFLTYEELAADTLGQLRRLAEFVGCPFTTEEQKHGVDRNIVEACALENMSGLEVNRSGTITIVDSTVPNNTFFRRGVVGDWRNHLTPEMARRIDEITKSKFKGSGLLLHPQFLQLIKADLTTRHHDKFVPQKKQHFFARTTLFMASSSTAEAADGTSHKEIYDQLRQVVETFPAAVSGIGQPYCRHPDGWYMSRRGFVSAMAIKRHLMARTTDVFITTFPKSGTTWLKALIFVSWNIDVAVRQFCDGISHFGPFWEHVLGYWRWHVEMPSQVFFLTYEELAADTLGLLRRLAEFVGHPFTVEEQEAGVDRKIVEICAMESLSRLEVNLSGTTDFIEKDVPNNIFFRRGVVGDWRNYLTPEMAMKIDEIIEIKFEGTGLLFHPQLLREKGELK

SEQ ID NO: 43046 - protein, 500 aa, Coccidioides immitis RS
MAKQYELPFQLDDPSLLHFDSFVNNEWVTAADGNRFEVVDPGTGKPWATCPTSTAKDVPSTVEAAHAAFEEYKKMNPRQKAMLLMKWDELIREARSDLAKILTHETGKPIPEALAEIDYALGFTWWFAGEAERIHGSISTPAAPNRRVFTIKQPIGVAAALVPWNFPIAMVLRKASAAFAAGCTMIVKPSPETPISTLVLGHLAKKAGYPPGVFNVLTTDLDSTPSLSEALCKHPLVKKVTFTGSTRIGKLIASHCAHGLKKLTLELGGNCPFIVFDDANLDQAISQLMTLKWRHAGQACITANRIYVQSGIYDKFVQLFKERTAALVVGHGAKESTTMGPVTTPRTLEKAANQVEDARKLGGKVILGGKPKTDCGGGYFFEPTIITDMTQEMLISREETFAPIAAVYKFDTEEEAVKWANDTSMGLASYAFTKNVDRMWRMLENLEAGMIGMNTGNSSAAESPFGGIKESGYGKESGKDVAVNEYLITKTGTFTLEGQY

SEQ ID NO: 43047 - protein, 472 aa, Pseudomonas fluorescens PfO-1
MSGQNSQSGELKRGLKNRHIQLIALGGAIGTGLFLGSAGVLKSAGPSMILGYAICGFIAFMIMRQLGEMIVEEPVAGSFSHFAHKYWGGFAGFLSGWNCWILYILVGMSELTAVGKYIHYWAPEIPSWVTAAAFFVLINAINLANVKVFGEAEFWFAIIKVVAIVGMIALGSYLLVSGHGGPQASVSNLWSHGGFFPNGVSGLVMAMAIIMFSFGGLEMLGFTAAEADKPKTVIPKAINQVIYRILIFYIGALVILLSLTPWDSLLETLNASGDSYSGSPFVQVFSMLGSNTAAHILNFVVLTAALSVYNSGTYCNSRMLLGMAEQGDAPKALAKIDKRGVPVRSILASAAVTLVAVLLNYLIPQHALELLMSLVVATLVINWAMISFSHFKFRQHMNKTHQKPLFKALWYPYGNYICLAFVLFILGVMLLIPGIQISVYAIPVWVVFMWICYVIKNKRGAQQALHAASAAK

SEQ ID NO: 43048 - protein, 522 aa, Acidobacteria bacterium Ellin345
MKIVTAQEMRDIDRITTERYGVPSLTLMENAGRAAAEMVVENYPEARSIAVVCGKGNNGGDGFVAARHLHKMDRGVEVLLLADPEGLRGDAAEMYRQLGFAATIVKSEETISSNLQRAFAEADVILDAVLGTGFKPPVSPLYAKAIAAMNASKLPIVAVDVPSGADSDGMQPQSGEAIARADAAVTFTAPKPVHVFGDLVRGKTVVAPIGSPDEAIVSNLGLNVITPADYAAVLAARPLNSNKGMYGHALIVAGSFGKSGAAAMAGMACLRAGAGLATVATPKSVLTSVASYAPELMTESLAETADGTICEAAIWAIQELAKKMTVLAIGPGLTQNAETIQVVRELVRASEKPMVIDADGLNALVDQTEVLKDAKAATIITPHPGEMSRLCGISTKEVQADRVGIAKNFAASRYTIVVLKGDKTVIAAPSGETWINCTGNPGMATGGTGDVLTGILTGLLAQHPQDPLLCAIAAVHLHGMAGDLGRDRVGEISLIATDLIHALSGAFERAKKSLQKPWVPLN

SEQ ID NO: 43049 - protein, 313 aa, Xanthobacter autotrophicus Py2
MAPTVLLADIGGTTTRIARAGVDGIPFDIRLEANDSYGSIEDLLKTYLDSLGGEPPRCAALAVAGPIDGDGVRLTNRNWRFSTQALAQELSFARLTVLNDFEALAHGLPLLTRDDLMEVGTGRRVPGAPMLLSGPGTGLGTALILPREDGYEVLASEAGHMRLGAVTTDEARIVAHLVRDLGPVAVEHVLSGPGLVRLHRILSGEQLSSHAIIKAALDGQRQEKESCHIFLRLLGRVLGDLALAFDAKGGVYVGGGIGRAMAPLFAESPFRTAFEEHPPYLDRLSLIPIHVVTHATPGLIGIGEIGRRLLVDD

SEQ ID NO: 43050 - protein, 339 aa, Ralstonia eutropha JMP134
MTRISLTRYLVEEQRKHNTIQPELRLLIEVVARACKAISNSVNKGALAGVLGSAGTGNVQGETQQKLDVIANEVLLDANEWGGHLAAMASEEMESFYEIPNRYPKGEYLLMFDPLDGSSNIDVNVSIGTIFSVLHMPKPGQTVTEADFLQPGTHQVAAGYAVYGPQTTLVLTVGNGVHVFTLDREAGSFVLTQSDVQIPEDTKEFAINMSNMRHWAPPVRKYIDECLAGDEGPRGKNFNMRWIASMVADVHRILTRGGIFMYPWDKREPEKAGKLRLMYEANPMAMLIEQAGGAATNGHIRILDVQPEKLHQRVSVILGSKNEVERVTRYHHEAAGQQG

SEQ ID NO: 43051 - protein, 406 aa, Pseudomonas putida GB-1
MAIEIKAPTFPESVADGTVATWHKKPGEAVKRDELIVDIETDKVVLEVLATADGVLGDIVKGEGDTVLSDEVLGSIVEGGAAAAPAAAAAPAAAPAAAAADAGEDDPVAAPAARKLAEENGIDLATVAGTGKGGRVTKEDVVAAVANKKSAPAAAPAAKPAAAAAPVVVAAGDRTEKRVPMTRLRAKIAERLVEAQSNMAMLTTFNEVDMTEVMALRSKYKDLFEKTHNGVRLGFMSFFVKAATEALKRFPAVNASIDGNDIVYHGFADVGVAVSSDRGLVVPVLRNAESMSLAEIENGIATFGKKARDGKLSIEEMTGGTFTITNGGTFGSMMSTPIVNPPQAAILGMHNIIQRPMAVNGQVVIRPMMYLALSYDHRLIDGKEAVTFLVTIKNLLEDPSRLLLDI

SEQ ID NO: 43052 - protein, 478 aa, Pseudomonas putida GB-1
MTQKFDVVVIGAGPGGYVAAIKAAQLGLKTACIEKYTDAEGKLALGGTCLNVGCIPSKALLDSSWKYKEAKESFNVHGISTGEVKMDVAAMVGRKAGIVKNLTGGVATLFKANGVTSIQGHGKLLAGKKVEVTKADGTTEVIEAENVILASGSRPIDIPPAPVDQNVIVDSTGALEFQTVPKRLGVIGAGVIGLELGSVWARLGAEVTVLEALDTFLMAADTAVSKEAQKTLTKQGLDIKLGARVTGSKVNGNEVEVTYTNAEGEQKITFDKLIVAVGRRPVTTDLLAADSGVTIDERGYIFVDDHCATSVPGVFAIGDVVRGMMLAHKASEEGIMVVERIKGHKAQMNYDLIPSVIYTHPEIAWVGKTEQALKAEGVEVNVGTFPFAASGRAMAANDTGGFVKVIADAKTDRVLGVHVIGPSAAELVQQGAIAMEFGTSAEDLGMMVFSHPTLSEALHEAALAVNGGAIHVANRKKR

SEQ ID NO: 43053 - protein, 674 aa, Arabidopsis thaliana
MERSNLFHIPCFLLLFLLFNINGVHTTFVCGDEDFSPNTSYVENLESLLPSLASNVIRERGFYNVSLDGVYALALCRKHYEVQACRRCVDRASRTLLTQCRGKTEAYHWDSENDANVSCLVRYSNIHRFGKLKLEPIGNVPHSSLDPSSNLTRISQEFAARANRTVEVASTADESSVLKYYGVSSAEFTDTPEVNMLMQCTPDLSSSDCNHCLRENVRYNQEHNWDRVGGTVARPSCYFRWDDYRFAGAFDNLERVPAPPRSPQTRQDYRVKKGRMFQPWSVVVVVFPTGINLAVFVAFVLAYRRMRRRIYTEINKNSDSDGQATLRFDLGMILIATNEFSLENKLGQGGFGSVYKGILPSGQEIAVKRLAGGSGQGELEFKNEVLLLTRLQHRNLVKLLGFCNEGNEEILVYEHVPNSSLDHFIFDEDKRWLLTWDVRYRIIEGVARGLLYLHEDSQLRIIHRDLKASNILLDAEMNPKVADFGMARLFNMDETRGETSRVVGTYGYMAPEYVRHGQFSAKSDVYSFGVMLLEMISGEKNKNFETEGLPAFALIGNTHNGIMTFSNAAWKRWIEGELESIIDPYLNENPRNEIIKLIQIGLLCVQENAAKRPTMNSVITWLARDGTFTIPKPTEAAFVTLPLSVKPENRSMSERKDKDPFSVDEVSITVLYPR

SEQ ID NO: 43054 - protein, 575 aa, Haemophilus influenzae Rd KW20
MISGILASPGIAFGKALVLKEEKIVLDTQKITDDQIDAEVARFYEGRNAAVEQLNSIRERALISLGEEKAAIFEGHLMILEDEELEEEILDYLRSNKVNAGVAASKILDQQVTMLSEIDDEYLKERAGDIRDIANRLVKNILGMYIVDLGDIQEESILVAYDLTPSETAQLNLEKVLGVVTDIGGRTSHTSIMARSLELPAIVGTNKVTKLVNTGDYLILDAINNQVYINPTASQIDELKALEAKISEEKAELAKLKDLPAITLDGHKVDVVANIGTIRDCDGAERNGAEGIGLYRTEFLFMDREQLPTEEEQFIAYKQVVEAMNGRLTVIRTMDIGGDKELSYLDLPKEMNPFLGWRAIRIALDRREILNAQLRAVLRASAFGKLAVMFPMIISVEEIRELKAVIETLKAELREEGRLFDNNIQVGVMVETPSAAVNAKFLAKEVDFFSIGTNDLTQYTLAVDRGNEFISHLYNPMHPSVLGLIKQVIDASHAEGKWTGMCGELAGDERATLLLLGMGLDEFSMSAISVPRIKKLIRNVNFQDAKVLADTALQKPTAAEIDQLIEEFLLENSLN

SEQ ID NO: 43055 - protein, 187 aa, Oryza sativa (japonica cultivar-group)
MYTYRESIVLGKTTCSIFTVNQILRELSWKWPGGSYELLSRNCNHFCNTFCEKLDVPKLPAWVNRFANAGDAALEVAENTAEKLKQAKKDIAGACKAATTYLTGASSSSPSNADDSGGSTNSSLFEGTWLRSIIGISMKPSRSLMCSDSSDSSDDEKSEDERESDCQQPSGDQIEEKKDATQEQAGK

SEQ ID NO: 43056 - protein, 88 aa, Zea mays
  misc_feature (83)..(83): Xaa can be any naturally occurring amino acid
  unsure (1)..(88): unsure at all Xaa locations
MSGRGKGGKGLGKGGAKRHRKVLRDNIQGITKPAIRRLARRGGVKRISGLIYEETRGVLKIFLENVIRDAVTYIEHARRKTVXVMDVR

SEQ ID NO: 43057 - protein, 243 aa, Zea mays
  misc_feature (193)..(193): Xaa can be any naturally occurring amino acid
  unsure (1)..(243): unsure at all Xaa locations
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQAQAQAQQGQAVELEPEQQLDPRTQPAHDAEETAAEPPPAXASNGTTDGGNKRKAAAMEEEGMLAVMTVAAPESSTKPRLSTTTSSLAVET

SEQ ID NO: 43058 - protein, 426 aa, Ustilago maydis 521
MSMFGGLDGGFARFMQNGMDPRFPRPPRAYDEYFKAYSMAMLPGKERLNVSYGGKIIMPPSALAHLTNLEIESPWFFELRTTGASEVRRTHAGVLEFIADEGHVHLPAWMMRTLGLSEGDPIRLTGATLPKGKMVKIQPQTVDFLEISDPKAVLEQAFRNFSALTPGDIVEISYNCLTFEILIMEITPDADGISIIETDLEVDFAAPKGYVEPTPQPRPPPPTMASKLNIDSSRVESIPPTRTSTPGSLTGTSATGGSGMATPSGPFRGSGQTLSGKKSKGKKERQIEQLDPFSMIRRTDMPRIVTNDTQLTEKKIPAALNLPFGKLFFGYEIIPVGGKVDGTVKEKKTESFGGAGTTLSGRAPRPKPQEKDNSTPTASAASSGYTLGGGRVLGESSRSSRYATPTSSDGRSLNESRREVIEIDSD

SEQ ID NO: 43059 - protein, 523 aa, Oryza sativa
MGLEAFLGLVVLTIQARTPSLMPPGCAKVAGAACEPVSGPKKAMLFAGLYVTALGIGGIKGSLPSHGAEQFDEHAPRGRKGRSTFFNYFVFCLSVGALIAVTFAVWVEDNKGWQWGFGISTIAILLSIPVFVAGSRLYRNKVPTGSPLTTIAKVVLAAALARRGGAQSASNGAVIDRAPSPTGSTDMKEYCKPGDICGVADGAAEVATEPSQELVFLNRAVQRQPRCGALSCTVQEVEDVKIVLMVLPIFFSTIMLNSCLAQLSTFSVEQAATMDTRVGGLKVPPASLPVFPVTFIILLAPVYDHIIIPFARRATGTEMGITHLQRIGTGLVLSIVAMAVAAVVEVKRKNVASNAGMLDAAAPLPITFFWIAFQYLFLGSADLFTLAGLLEFFFSEAPARMRSLATSPVVGVAGAGGENLNHYHLERFYWVMCVLSTLNYLFFLFWAIRYKYRNAGVAVAAAEQEDVWVTAVTKTYSASVAREWEASAVGLRIHGWKESYSDETGSLQYREGSDISESYLEIN

SEQ ID NO: 43060 - protein, 503 aa, Acidobacteria bacterium Ellin345
MDLLATKPLDVLMSEASETGEHSLKRALGPVNLMMLGVGAIIGAGIFVLTGAAAAQFAGPAIVFSYILAGIACVFAGLCYAEFASLIPIAGSAYTYGYATLGEIFAWIIGWDLVLEYAFGAATVASGWSSTLVAFLQDYGVSLPPRICDVHGSIWVQYQGRWSPLATVQSVLDTAHIDYHTLPNVVCIFNLIAFLAILAVTTLLVIGIKESANFNTGVVFVKLFAVLVFIGVAGAFVIKNPTVAQANWHPFLAFGWAGVIRAAGVVFFAYIGFDAVSTAAQEAKNPQRDMPIGILGSLIICTVLYILVSGLLTGVVHYDRLNIGAPVSLAIRETGRKWGSYIVNAGALAGLSTVMLVMLLGQSRVFYSMAHDGLLWKWAGEIHPKLRTPWKSTIVVGICVAFFGATIPIGDLGTLVSIGTLLAFVIVCAGIMILRKRRPDLPRPFKTPLVPLVPILGILTSLLMMVFLPLVTWIRLVVWLLIGFIIYFTYGRKHSKVQAMQKK

SEQ ID NO: 43061 - protein, 1151 aa, Wolbachia endosymbiont of Drosophila simulans
MPKRTDIESILVIGAGPIVIGQACEFDYSGTQSCKVLKSEGYKVILVNSNPATIMTDPEFSDATYIEPVLPEIIEKIIIKERPDAILPTMGGQTALNCAIKLADDGVLDKYNVELIGVNREAIKKAEDRELFRQSMDKIGLKYPKSIIIKNQERIKEALDYIGLPAIIRSSFTLGGAGSGIAYNKEEFFNIAESALKISPINEVQIDESIIGWKEYEMEVIRDCKDNCIIVCSIENVDPMGVHTGDSITVAPALTLRDVEYQQMRNASIAVLREIDVSAGGANVQFAVNPKEDGSLVVIEMNPRVSRSSALASKATGYPIAKVVTKLAIGYSLDEIRNDCAPIIPAAFEPVIDYIVTKIPRFEFEKFKGTNCELSTSMKSVGEVMSIGRTFNESLQKAFRSLETDLTGLDEVFPENIDIDHVKSQLAKLLPNRLLIAADAMRHGISIEEINSITGYDLWFLQNIQQIILTEQKIKENGFPGTAYEMLELKKMGFSDARLAKLSNRPTSVIPVPSNVIPVRDTGIQPALHAGDRVKQIEEIRKKFGIKQVYKRVDTCAAEFESSTAYMYGCYEGDVENKTECEANISDREKVVILGSGPNRIGQGIEFDYACVHAASAAKEMGYETIMINCNPETVSTDYDTADRLYFAPLIAEDVLEILSKEQENGTLVGVIVQIGGQTPLKLAKVLNERGFKILGTSFDSIDLAEDRMRFKNLALQLNLKQPGSSICYSVEEALTNAEKVGFPLVVRPSYVLGGQSMSIRHDTQSFKEYVLNQTKIFEHGSLLLDKFLVNAVEVDVDAVCDGEKVFIAAVMEHIEEAGIHSGDSTCSIPTNTLSDEVIKEIKLQTERIALALKVKGLINIQFAVQENRPLAEPVCDEKFLGKVQMSTTEYSNVFEERRQALTTKLPSEIELCKRSSDVYILEVNLRASRTVPFISKVINIPIAKLATQVILGKKLNQENKPFNHFAVKAAVFPFTRFAGVDTLLGPEMKSTGEVMGIDSSFEAALAKVHMAAGYKLPTEGAALVSVKDDDKEYILPVVRMLKELSFEIYATKGTALYLNNNGIAAKAVNKVREGRPHIVDMLKDGKINLVINTSKGVKSVSDSKDIRRTAILQNIAYSTTASGSKALVLAIQYVKNSKLEVKSLQQIQNV

SEQ ID NO: 43062 - protein, 275 aa, Triticum aestivum
  misc_feature (254)..(254): Xaa can be any naturally occurring amino acid
  misc_feature (260)..(260): Xaa can be any naturally occurring amino acid
  unsure (1)..(275): unsure at all Xaa locations
AYLGDSIEQVCTKKQAGTGPEFPGYRRPTNPRVPKIKYAAMLLYDGELKIPSKYLVSPPLIDRTAGEYLENNGVRTFACSETVNFGHVTFFWNGNRAGYFDQTTEEYVEIPSDSGITFNEHPEMNALEIAERTRDAILIGKFDQVRINLPNGDMVGHTGDIEATGAACKAADEAVKMVLDAVEQPGGIYLVTADHGNAEDMGKRNKAGQPMLDNSGSIQILTSHTLQPVPVAIGGPGLHPEVRFRSDIQTPGLXNVAATXMNLHGFQAPADYETT

SEQ ID NO: 43063 - protein, 371 aa, Oryza sativa (indica cultivar-group)
MNTTAKLLALAVFAAAAILSLDSRSDVRQLEIRDGDVELIPLLDGAAGPESIVFGDAGDGPYTSVSDGRILKWLPPPERRWVEHSCSVPELLDSCRGSKDTKREQECGRPLGLKFNSKTGELYVADAYLGLRVVSPGENVSRPLVPKRTGSPFSFSNGVEIDHETGVIYFTETSTRFQRREFLNIVITSDNTGRLLKYDPKENKVEVLVDGLRFPNGLAMSIDGSYLLLAETTTGKILRYWIKTPKASTIEEVAQLPGFPDNIKMSPRGGFWVGLHAKRGKIAEWSISYPWLRKLILKLPAQRIQRITSFLTGFGRQVIALRLSEDGKTIEAMSVHGDVRKLFKSISEVEEKDGNLWIGSVLSPFLGLYRI

SEQ ID NO: 43064 - protein, 399 aa, Desulfovibrio vulgaris subsp. vulgaris str. Hildenborough
MSDVFRVSRRVQQIRISATKLMPMLAARVGGCVSLGQGVPSFRTPEHIVEAVCRALRDKADAGRYTLQPGMPALREAIAADLAARKGYMVNPDSEVGVTVGAMEALLMALLTVVDRGDEVIIPSPGYASHAEQVLMAEGVPVHVPLRADDWGLDVDAIRAAVTPRTRAVIVCNPGNPTGTVYDDADVRALCELALERNIMLISDETYDYMVYGGGEPLSPASLPEMRRHVIVVNSFSKKYALTGWRVGYCAADAAWMGELLKVHDAAAICAPAVSQYAALAALTGPQDCVDDMRAALSARRNLACARLDAMAPHFDYVQPRGAFYIMARYTFTDAPSDMVARRLLEEGRVITVPGASFGPTGERHLRLSFGMEEAELDEAFDRMAAWTQRVVASGGLGG

SEQ ID NO: 43065 - protein, 636 aa, Haemophilus somnus 2336
MKKEKTLDLICLGRVAVDLYAQQIGSRLEDVSSFAKYLGGSSGNVAYGTAVQGVKSSMLARVGDEHMGRFLREELQRLGVDTSHLITDKERLTALVILGIKDQDTFPLIFYRDNCADMAITADDFDEEYIASAKALAITGTHLSHPKTRHAVLTALEYAGRNGTKRLLDIDYRPVLWGLTSLGDGETRFIDSEAVTQSLQEVLHHFDVLVGTEEEFHIAGGSTDTLTALKNVRKVSNATLVCKRGALGCSVFEGDIPNHIDGGINVYGVRVEVLNVLGAGDAFMSGLLRGYINGESWEQCCRYANACGALVVSRHGCAPAMPTKEELDNYLSRAESVPRPDLDEQLNHLHRVTTRKQQWHDLCIFAFDHRKQLVDMAEKCGADLKRIPTLKTLLLKAAEQTAQKEGIYNGNAGVLADTTFGQEALNEITGKKWWIGRPIEMPSSRPLRLEHGDLGSQLISWPAEHVVKCLAFYHPADKAELKADQDATLKEVYRACCRTGHELLLEIILPADMEQKESYYTDMIAHFYSLGIKPDWWKLPGVSAKTWADISQVIEKNDKHCRGILILGLDAPEAVFENVFKASANAPLVKGFAVGRTIFGQPSADWLAGKIDDEQLIKETSERYRRLIKLWKNRKN

SEQ ID NO: 43066 - protein, 177 aa, Medicago truncatula
MALISSAAVTTVNRVSANLVAPFTGLKSSAGFPVTKKTNNDITSITSNGGRVNCMQVWPPIGKKKFETLSYLPPLTEDQLAKEVEYLIRKGWVPCLEFELEKGFVYRENHSSPGYYDGRYWTMWKLPLFGATDSSQVLKELAEAKAAYPESFIRIIGFDNVRQVQCISFIAHTPATY

SEQ ID NO: 43067 - protein, 421 aa, Mycobacterium tuberculosis H37Rv
MHIASVTSRCSRAGAEALRQGAQLAADARDTCRAGALLLRGSPCAIGWVAGWLSAEFPARVVTGHALSRISPRSIGRFGTSWAAQRADQILHAALVDAFGPDFRDLVWHPTGEQSEAARRSGLLNLPHIPGPHRRYAAQTSDIPYGPGGRENLLDIWRRPDLAPGRRAPVLIQVPGGAWTINGKRPQAYPLMSRMVELGWICVSINYSKSPRCTWPAHIVDVKRAIAWVRENIADYGGDPDFITITGGSAGAHLAALAALSANDPALQPGFESADTAVQAAAPYYGVYDLTNAENMHEMMMPFLEHFVMRSRYVDNPGLFKAASPISYVHSEAPPFFVLHGEKDPMVPSAQSRAFSAALRDAGAATVSYAELPNAHHAFDLAATVRSRMVAEAVSDFLGVIYGRRMGARKGSLALSSPPAS

SEQ ID NO: 43068 - protein, 180 aa, Medicago truncatula
MALISSAAVTTVSRASSTQANLVAPFTGLKSSAAFPVTKKTNNDITSIASNGGRVNCMQVWPPIGKKKFETLSYLPPLTEEQLAKEVEYLIRKGWVPCLEFELEKGFVYRENHSSPGYYDGRYWTMWKLPLFGATDSSQVLKELAEAKAAYPESFIRIIGFDNVRQVQCISFIAHTPATY

SEQ ID NO: 43069 - protein, 149 aa, Arabidopsis thaliana
MSSNKIVLSSSDGESFEVEEAVARKLKIVEHMIEDDCVVTEVPLQNVTGKILSIVVEYCKKHVVDEESDEFKTWDEEFMKKFDQPTVFQLLLAANYLNIKGLLDLSAQTVADRIKDKTPEEIREIFNIENDFTPEEEAAVRKENAWAFE

SEQ ID NO: 43070 - protein, 185 aa, Brassica napus
MVAEAEVVFQQSLPVVLDIDGVTSAVVSPLSSPKLGIRRPAASVSGGLSTSPVEDDCDSTIPVYVPTIRSGSYADIGPKRSMEDEHICVDDLSSQLGRLFQLPKPSASYAVFDGHGGSEAATYVKQNAIRLLFEDDNFPQTSVVNSVYVEQVKSSLRNAFLQADLALAEDCSISSSSGTTALARP

SEQ ID NO: 43071 - protein, 142 aa, Brassica napus
RGGPRRPEKEEKLLLVNFFFSSAVVVTARVKATMGVPLTAWKSSFAFPVTRRATTAIPSIVGTGGGVNCLQVWPPIGKKKFGTFFYFPDLTEVEWGKEVDYFFRTRWIPGVEFKLEHGFVARGHGSTPGYYDGRYWPMWKLP

SEQ ID NO: 43072 - protein, 452 aa, Shigella flexneri 2a str. 301
MLSIFKPAPHKARLPAAEIDPTYRRLRWQIFLGIFFGYAAYYLVRKNFALAMPYLVEQGFSRGDLRFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFFYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHEQLLQKRNGG

SEQ ID NO: 43073 - protein, 518 aa, Triticum aestivum
  misc_feature (156)..(156): Xaa can be any naturally occurring amino acid
  unsure (1)..(518): unsure at all Xaa locations
MDKAYIAVLSFAFLFLLHYILGKKSNGSKGAVQLPPSPPAIPFFGHLHLVEKPLHAALCRLGARYGPVFSLRLGARNAVVVSSPACARECFTEHDVAFANRPQFPSQMLVSYGGTSLVSSSYGPHWRNLRRVAAVRLLSAHRVAGMSGVIAAEVAXAWRARLCRAAAASTGGGAARVELKRSLFELSLSVLMETIAQTKGTRPEADGDTDMSLEAQEFKQVVDEIIPLIGAANVWDYLPVMRWFDVSGVRSRILATVSRRDAFLHRLIDAERRRMDEGGAGDEGEKKSMIAVLLTLQKTEPELYTDQMIIALCANLFVAGTETTSTTIEWAMSLLLNHPAALKKAQAEMDASIGASRMVAADDVPRLSYLQCIINETLRLYPAAPLLLPHESSADCKVGGYDVPSGTMLIVNAYAIHRDPAVWEDPAAFRPERFEDGKADGLLLMPFGMGRRRCPGETLALQTVGVVLGTLVQCFDWDRVDGAEVDMTEGVGITMPKAVALEAVCRPRAAMGDVLQKL

SEQ ID NO: 43074 - protein, 461 aa, Arabidopsis thaliana
MGKENAVSGNSIPIHGRPVTRALASALRASSKLITSSEVAATTQNQGRVLRAKSKRTALDEKKANAPKKRAVLKDITNVTCENSYTSCFSVAVENIKQIKKGRQSSSSSKVASSSATSQVTDAKVEVVSNSAGASLSVFTDTSLGTNETSYSIIAKPSSRSPPRPFGTVERSCGGASSPKFVDIDSDDKDPLLCSLYAPDIYYNLRVAELKRRPFPDFMEKTQRDVTETMRGILVDWLVEVSEEYTLVPDTLYLTVYLIDWFLHGNYVERQRLQLLGITCMLIASKYEEIHAPRIEEFCFITDNTYTRDQVLEMESQVLKHFSFQIYTPTSKTFLRRFLRAAQVSFPNQSLEMEFLANYLTELTLMDYPFLKFLPSIIAASAVFLAKWTLNQSSHPWNPTLEHYTTYKASDLKASVHALQDLQLNTKGCSLNSIRMKYRQDKFKSVAVFSSGELPDKLFIS

SEQ ID NO: 43075 - protein, 206 aa, Coxiella burnetii RSA 493
MEKSFEKIIRGYHDFRKKYATGNNSSMQSLAYHGQQPEIMIVACCDSRVDPALILQCDPGDLFVVRNVANIVPPYEADESHHGTSAALEFGICYLNVKHLIILGHSQCGGINALLNSENLKQNDFITRWVSLIKTNSSMIQDANQFSKEALTHSYQNCLTFPWIKERIQQKKLSIHLWFFDIKEGEIFAYSFENKKYQQLISNAQN

SEQ ID NO: 43076 - protein, 249 aa, Arabidopsis thaliana
  misc_feature (131)..(131): Xaa can be any naturally occurring amino acid
  misc_feature (165)..(165): Xaa can be any naturally occurring amino acid
  misc_feature (195)..(195): Xaa can be any naturally occurring amino acid
  unsure (1)..(249): unsure at all Xaa locations
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADXGLGGSGLAMPVEVVQFCWNFNLIRLQDLFREFGXGSKVRGDGRASLRGLKQEGQYLFYFNTPLXDRFPPAKEIGNFQGLVEHGLFLGMATSVIIAGKNGGERRGQREVKSSMGFLLGE

SEQ ID NO: 43077 - protein, 115 aa, Oryza sativa (indica cultivar-group)
MAVAIEAPFHVLAVDDSLPDRKLIERLLKTSSFQVTTVDSGSKALEFLGLHDHEDSPISTQSDQQEVAVNLIITDYCMPGMTGYDLLKKIKESSYLRDIPVVIMSSDNIPSRINR

SEQ ID NO: 43078 - protein, 174 aa, Ammopiptanthus mongolicus
MISSPAVTTVKASMGAPFTGLKSMASFPVPRKVNSDITTIANNGGRVQCMLVWPPLGRKKFETLSYLPPLSIESLTKEVEYLLRKGWVPCLEFELEHGFVYRENNRSPGYYDGRYWTMWKLPMFGCSDASQVMKELEECKKEYPTAFVRIIGFDNKRQVQCISFIAYKPPGFEN

SEQ ID NO: 43079 - protein, 695 aa, Acidobacteria bacterium Ellin345
MARPPRTPAQPVPGLTHPLGATICPEGVNFSLFSRHATGVELLFFDHAEDAQPTRVFRLDPVRNRTYYYWHLCIPDVSPGQLYGYRVYGPFAPDKGHRFNPEKLLLDPYGRCVVTPKTYSRDAAITPGDNCATAMKNAVVDVHDYDWEGDEPLRCPASRTIVYEMHVRGFTRNPNSGVAEEKRGTFAGVIEKIPYLKDLGITAVELLPVFEFDPLDCPPGLVNYWGYAPVSFFSPHKAYSSGHAYLAAINEFRDMVKALHRAGIEVILDVVYNHTAEGSETGPTFSFKGIDNLTYYILESDRCRYANYSGTGNTFKANHPVVRRMIVDSLCYWVEEMHVDGFRFDLASILARDSSGNTMANPPALWDIESEPRLAGTKFMAEAWDAAGLYQVGTFVGDSWKEWNGRFRDDVRDFFRGEDGTVCKLASRLLGSPDIYGHKGREAEQSVNFVTCHDGFTLNDLVSYEVKHNEANREQNRDGHDDNRSWNCGVEGPTNDPAINRLRNKQVKNFLATTLLSLGMPMLTMGDEVRHTQRGNNNAYCQDNELSWFDWSLLDEHADIHRFVKMIALRRLLRDVAPEQERRSLTEFLESARKTWHGVELDQPDWADHSHSIALCIEVAEEGIVFHFILNGYTEGLDFELPPRLNGSRWRRWIDTSLDSPDDIVNWRTAPAIQGPRYHAAAHSTVVLISATDGP

SEQ ID NO: 43080 - protein, 265 aa, Candida glabrata CBS 138
MTSVPVKKALTTLLRDPGNASCADCKSQSHPRWASWSLGVFICIKCAGVHRSLGTHISKVKSVDLDTWKEEHLKELVQMRNNVNANRVYEAKLPDSSKFNGKSLGNDINLLQEFIRQKYERKRWMDSSVDLSRDQPVVSQANSSSSSLVSTMSSSNESTNNTVAVEEKLKPQSTHSSSLLNLQGRKEIVENKRPARPTQQDTPQRNDLKKSILSLYSSANASKSNNNSTMNVSSGMGMTTPFNTTPQNNSSLSIDDDELFKNVWS

SEQ ID NO: 43081 - protein, 348 aa, Mycobacterium tuberculosis H37Rv
MTQIADRPARPDETLAVAVSDITQSLTMVQAINRALYDAMAADERVLVFGEDVAVEGGVFRVTEGLADTFGADRCFDTPLAESAIIGIAVGLALRGFVPVPEIQFDGFSYPAFDQVVSHLAKYRTRTRGEVDMPVTVRIPSFGGIGAAEHHSDSTESYWVHTAGLKVVVPSTPGDAYWLLRHAIACPDPVMYLEPKRRYHGRGMVDTSRPEPPIGHAMVRRSGTDVTVVTYGNLVSTALSSADTAEQQHDWSLEVIDLRSLAPLDFDTIAASIQRTGRCVVMHEGPRSLGYGAGLAARIQEEMFYQLEAPVLRACGFDTPYPPARLEKLWLPGPDRLLDCVERVLRQP

SEQ ID NO: 43082 - protein, 86 aa, Glycine max
MSQRIGTKLFVHRLSFYTTQEQLKKLFSPFGLVTQADLALDPITKRPKGFGFVSFKSEIEAEKACKAMNGRIVNGRLILVEPANEK

SEQ ID NO: 43083 - protein, 130 aa, Glycine max
MVRVSVLNDALKSMYNAEKRGKRQVMIRPSSKVIIKFLLVMQKHGYIGEFEYVDDHRAGKIVVELNGRLNKCGVISPRFDVGVKEIEGWTARLLPSRQFGYIVLTTSAGIMDHEEARRKNVGGKVLDFFY

SEQ ID NO: 43084 - protein, 99 aa, Medicago truncatula
MAVKMNIEDIQGKDNYPCRQQLLIHNGKVLKDETTLADNEVSEDGFLVVMLSKVNNRSMSGECFVDNSEEEDEEHLFDESDEEDEEQFFDDLDGDEDKE

SEQ ID NO: 43085 - protein, 126 aa, Dechloromonas aromatica RCB
MNLIEQLEQEEIARLGKTIPEFAPGDTVVVQVKVKEGNRERLQAYEGVVIAKRNRGLNSGFTVRKISSGEGVERTFQTYSPLVASIEVKRRGDVRRAKLYYLRERSGKSARIKEKLVRKEKPVVAA

SEQ ID NO: 43086 - protein, 807 aa, Ralstonia eutropha JMP134
MNARTGAPNLPDPLGNDVVGERAVVPPIAQGKARMAASAMHDELTAVEEAPAALAADSLFIDAVLAQSYRHFFGPTSQPAVPPRQQVISITRLMEKLAYLKAPDQARVREAFQFSDEAHLGQYRQSGEPYITHPVAVAELCADWRLDVQSIMAALLHDVMEDQGITKSELAEKFGPKVAELVDGLTKLDKLEFQSREQAQAESFRKMLLAMARDVRVILVKLADRTHNMRTLDFVPPEKRRRIALETMEIYAPIAHRLGLNTIYRELQELSFKVGSPFRYATLEKAVKAARGNRREVVKRILEAAQKALADAGIVAELSGREKTLYSIYRKMHDKQLSFSQVLDVYGFRVVVETQMHCYMAMGALHSLYKPMPGKFKDYIAIPKINGYQSLHTTLVGPFGTPVEFQIRTREMHQIAEAGVAAHWMYKTQADHANDIQQQAHQWLQSLLDIQSQTGDSQEFLEHVKIDLFPDAVYVFTPKGHIRALPRGATALDFAYAVHSDLGNQCVAVKINNELLPLRTELKSGDIVEVVTAPYSKPNPSWLSFVRTGKARAAIRHYLKTTKLDEAIQLGERLLEQSARQLGIELKAVPQTVWDRMIQWTGNKHREDIFADLALGRRVPAVVAKRMEILLQELSGDVDSALLAAVQTFSGEEAPAVPITGDEGMSILFPACCRPIPGDPIVGYLGKGEGLQIHVQDCKVAKRLHSKDPEHWIDVMWAKKTARAFDVSIKVMVRNVKGIVARVAADLTSADANVAHVSMEQQDAGHQEATYMQFIIQVQNRLHLANVMRALRRNPDVIRIFRDRNDG

SEQ ID NO: 43087 - protein, 260 aa, Halobacterium salinarum
MLTFVGLGLYDEASVTVAGRDAIAAADRVFAEFYTSRLIGTDVAALEAHHDTTIERRDRAGVEQHPEPILDAAADGDAVFLTAGDTMISTTHVDLRMRAADRGIDTRVIHAPTAASAAAGLTGLQNYRFGKATTLPFPWAHGADGVPGSVTDTIEANRERGLHTLVYLDIKVDHPRVDGDAYMTASQAADLLATNWDADALGVVVARAGAPDATVRADRLGALADADFGSPLHLLVVPGSLHHIERDALRELAGAPADAL

SEQ ID NO: 43088 - protein, 339 aa, Zea mays
PRARTDAVEIDVDALADTAAAGALPGSTDHAQRPGILPAGSAWPPPPWTVSALCLGLFAISTSGARDHYLEHPNRKCQYAISTSGDVFLLEANPRASRTVPFVSKAIGHPLAKYASLVMSGVTLPELGFTEEVIPKHVSVKEAVLPFEKFQGCDILLGPEMRSTGEVMGIDYEFSGAFAKAQIAAGQKLPLSGTVFLSLNDLTKRHLAEIGRGFRELGFSIVATSGTAKVLQLEGVPVEPVLKIHEGRPNARDMLKNGQIQIMVITSSGDALDSKDGLQLRRLALAYKVPITTTVDGARASIDAIKSLKNKSIEILALQDYFQTADASEDLQAVARTAP

SEQ ID NO: 43089 - protein, 790 aa, Coccidioides immitis RS
MFMLRNVSKFIFGDAAKESIIEIPQGQLYIVRPLSPKGFSELIFKDAAASIRRTGQEFQYQLVIQRAYEEGEEELVDDENEGGDVEGLGGDKDEKTFLLDQSLHFRSEVREGGEKVLAWRDLSGDVGDLYEFVCDISTSSEKVATFVLAAVQCQYERKYRRSAQKATERELQEFSFEEESPIPNASPIASPVSPTSKESAAAMSKEVVVGKDLTVAKSDGQTQAPPAAVHPDALEVLAKETAELHLFDFNSGTFILQDHFVTATVSEVGNWQYWLQITGTDREWLGQPVVADINPVFNFEYLSFIFNHYTADGSAYSWLLRFKNQAVEERFQEGLMQALWEYLHEMKWSKTKVDERDYVLEAFNDLTMEDIPEELEEEEEEEEEADEIDDSQRSEHYDSDEEADDVVTKEDDGNVNSQLAVGYKHDRSFVVRGSKIGVFKHTPNNNLEFSTNISKVETSKGKLFSPKKVMLHAEDSNMILQNESEPNTLYRMDLEYGKVVDEWKVHDDIPVTNFAPENKFSQMTSHQPFLGISRNALYRVDPRLSGNKLVEADLKQYVSKNDFSVAATTEKGYIAVASNKGDVRLFDRLGINAKTHIPALGEPIIGLDVSADGRWVLATCRTYLLLIDALQKEGKNEGRLGFEKPFGKDSKPQPRRLGLQPSHVAQFQHETGAPLSFTPARFNTGLDSSETSIITATGPFIITWNLKKVLAGRKDPYTIKRYAEEVKADNFKFGSDKNVIVALPNEVNMVAKQSFRKPTRESIAGPVTPARFGRRSSARLRKDEIVNSPF

SEQ ID NO: 43090 - protein, 514 aa, Listeria monocytogenes str. 4b F2365
MKDFTEQEKIIVLDFGSQYNQLITRRIREFGVYSELHPHTITVEEMKALNPTGIIFSGGPNSVYDEDAFRADERIFDMGIPILGICYGMQLMTTHFGGKVERAKDREYGKADIHVEKPNRLFAGLPTDQVVWMSHGDLVVEEPAGFEVTITSKSCPIAGIADEERSLYGVQFHPEVRHSVYGNELLKNFALNVCGCKGDWTMENFSEVEIAKIQEIVGDKKVLLALSGGVDSSVVGVLIHKAIGDQLTCIFVDHGLLRKGEADQVMATLQGEFNMNIIKVDAKKRFMDKLAGVSDPEQKRKIIGNEFIYVFDDEANKLDGVEFLAQGTLYTDIIESGTATAQTIKSHHNVGGLPEDMQFKLIEPLNTLFKDEVRALGTELGMPDAIVWRQPFPGPGLGIRVLGEITEEKLEIVRDSDYILREEIKNAGLEREIWQYFTALPNIRSVGVMGDGRTYDHTVVVRAVTSIDGMTADWARIPWDVLEKISVRIVNEVDHVNRVVYDITSKPPATVEWE

SEQ ID NO: 43091 - protein, 329 aa, Kluyveromyces lactis NRRL Y-1140
MVKVAINGFGRIGRLVLRIALQRKALEVVAVNDPFISVDYAAYMFKYDSTHGRYKGEVTTSGNDLVIDGHKIAVFQEKDPANLPWGKLGVDIVIDSTGVFKELDSAQKHLDAGAKKVVITAPSKTAPMFVVGVNEDKYNGETIVSNASCTTNCLAPIAKIINDEFGIDEALMTTVHSITATQKTVDGPSHKDWRGGRTASGNIIPSSTGAAKAVGKVLPELQGKLTGMAFRVPTVDVSVVDLTVKLAKEATYDEIKAAVKKASQGKLKNVVGYTEDSVVSSDFLGDTHSTIFDASAGIQLSPKFVKVVAWYDNEYGYSERVVDLVEHVA

SEQ ID NO: 43092 - protein, 268 aa, Zea mays
MAADERDRERWILPGATALVTGGSKGIGHAIVEELAALGARVHTCSRNAAELEECRRRWAEKGGGRLLQQVTVSVCDVAVRADREALMATVRDVFGGKLDILVNNAAQVVFKPAVECTGEEYARIMATNLESCFHLSQLAHPLLRNASLAGGGSVVHISSTAGLLGFPGAVLYSTAKGGVNQLTRSLAAEWACDKIRVNSVAPGIVMTDMVKNAASSEAVEQETSRIPLRRAGEPAEVASVVSFLCMPAAAYVTGQVIYVDGGRTISA

SEQ ID NO: 43093 - protein, 306 aa, Triticum aestivum
  misc_feature (53)..(53): Xaa can be any naturally occurring amino acid
  unsure (1)..(306): unsure at all Xaa locations
LLKFCCYDRMGLLHDVTCVLCEMELTIRRVKVSTTPDGRVMDLFFITDARELXLHTKSRREEAYEKLQSVLGDSVTSCEIESATEDMSSCLQASALLSPLVLEQMFSEVDVIEEQSSRSRSDSRLSVTMDNSLSPAHTLIQIQCGDHKGLLYDIMRTVQDCNIQISYGRFYAGQKGRCEVDLFAVQSDGKKILDQQKQRTMCSRLRTELLRPLRVALVNRGPDAELLVANPVEVSGKGRPLVLYDITLALKNLHRRVFLAEIGRHVVDDREWEVYRVHLGEDEHELSCSVRSKIVDSVTNMLMGWD

SEQ ID NO: 43094 - protein, 803 aa, Candida glabrata CBS 138
MAHRKLQQEIDRVFKKINEGLDIFDSYYERHESCTNNPSQKEKLESDLKREVKKLQRLREQIKSWQSSPEIKDKDSLLEYRRSVETAMEKYKAVEKASKEKAYSNISLKKSDTLGPQEKEIKEVSDYLSQEIDELERQYEAAQIEIDRLIVLNKKKKTASAANDEKKDQLKALQLRYRWHQQQMELALRLLANEELDPQKVNAIKDDIRYFIESNREPDFVEDETIYDTLDLTSNEAIAHEVAQYFAAQSSEDNLGGENNEPIDLDSIDTSKLSKKELRKLEREAKKAAKVAAKNAAIATANAPPTISIPAAKPQSADSSIISNSDDKNDDKSNNKSESVSPIVSKIENSTANTTPRSPLVKKPTTSTPVSSRPTTTGFNTDTAEIKGSHTHIQTQNGMTSSTILKPAVVPARPAGDLKWSVAASHGIEKERKINSPPSLVATMSSRSNSITQQTNEQTPTISKTQINTTGTTLAERLEKAHEQSVSAATQINSVSEQTKPAEPQNDNAKGSMDNTSDENNNKEQEVNIDSPILEAPLFSDFSDSDYEEIESDSEEQLSLDESNTQNLKKEHLKSALSSDFEMLLLPSGIQEFIMGMDLTKNNITTTSEGKIRRSRDTCNIFRLDNVPYGVNPPSPLDAFRSAQQWDTARHSLWSSLRNNEANFNEEILMSKFESLDMFTLFYNYYFSVTPLEKQIASKVLKNREWRVANNEVMWFLRQGEPKLVNDQYEIGDYKIFKLDDWTVIDKVNFKLDYGLLKDNQKQSNTDGRDTEQNSLTGDDDNALSHGQQLLQQLKRGKDSISA

SEQ ID NO: 43095 - protein, 523 aa, Xanthobacter autotrophicus Py2
MIFFLAADAARLARAGYVLAREGVLSLMSPAAAPPLARPLLRIARLIARKDAGSRPARFSAALSRLGPSYVKLGQFLATRPDVVGASVARDLEVLQDRMPIIGQEVAEATVAEAFERPVHEVYAQFGPAVAAASIAEVHKAEVADKDGTRHTVAVKILRPGVERRFSSDMGSFRRIAHFAEANFAEARRLRLETVVDTLARSVSMEMDLRLEAAAYAELAENIGADKEIHVPRVDWDRSGREVLTTEWIDGIKLSDKEALVAAGHDLKEIARVVMQSFLKQAMRDGFFHADMHPGNLFVDAQGRLVIVDCGIMGRLGLKERRFLAEILYGFITRNWRRTAEVHFEAGYVPLHHSVDDFALAIRAIGEPIHSRTADQISMARLLALLLEVTALFDMQTRPELLLLQKTMVVVEGVARSLDPQLDMWKTARPVVEDWIAGNLGPVGQLQRAGGGLSEMAHFAATLPGLLTRTGRVMEQLDVATRDGLSLSPASLEGIGRAEAKRAFWGNLALWVIAAALLGIWLG

SEQ ID NO: 43096 - protein, 419 aa, Bacillus cereus E33L
MIEIKVPELAESITEGTISQWLINVGDKVEKGGSVVELETDKVNVEIIAEDSGIVSKLLGEPGDTVEVGATIAILDANGAPVAVSTPAPAAEQPKQETAEAPKAAAPSAEQTATLQGLPNTNRPIASPAARKMARELGIDLNDVRSTDPLGRVRPHDVQAHAAAPKEAPAAPKSPAPAPVAKTEFEKPVERVKMSRRRQTIAKRLVEVQQTSAMLTTFNEVDMTAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDAERMENRPMMYIALSYDHRIVDGKEAVSFLVAVKDMLEDPKSLLLEG

SEQ ID NO: 43097 - protein, 514 aa, Arabidopsis thaliana; identical to SEQ ID NO: 1156

SEQ ID NO: 43098 - protein, 376 aa, Shigella flexneri 2a str. 2457T
MAKQDYYEILGVSKTAEEREIRKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETPVGLNEKQKQLLQELQESFGGPTGEHNSPRSKSFFDGVKKFFDDLTR

SEQ ID NO: 43099 - protein, 451 aa, Bacteroides fragilis YCH46
MSFNIVKNDKKRVIIVGGGFGGLKLANKLKKSGFQVVLVDKNNYHQFPPLIYQVASAGLEPSSISFPFRKIFQKRKDFYFRMAEVRAIFPEKKMIQTSIGKAEYDYLVLAAGTTSNFFGNEHIEEEAMPMKTVSEAMGLRNALLANFERSITCSTERERQELLNVVVVGGGATGVEIAGVLSEMKKFVLPNDYPDMPSSLMHIYLIEAGDRLLAGMSEDSSRHAEQFLREMGVNILLNKRVTDYKDHKVMLEDGTEIATRTFIWVSGVAAITFGNIDGELLGRGRRIKVDEFNRVQGTDTIFAIGDQCIQTTDKNYPNGHPQLAQVAIQQGELLAKNLQRLQKGKPMQPFHYRNLGSMATVGRNRAVAEFSSFKTAGWLAWVMWLVVHLRSILGVRNKANVLLNWVWNYFTYDQSLRMIVYAKKAKEVRDREELEAKTHWGEETQTQQPKG

SEQ ID NO: 43100 - protein, 375 aa, Oryza sativa (indica cultivar-group)
MAKASVVVPEQVGAAAAAQVGCPCPGTTLFPYPPPRAGIAVRRKCLQAAQQLELGAGLRGGWVESMRASSPTHAKAAAALAAGVDEEHAAWMARHPSALGEFEKVVAASKGKQIVMFLDYDGTLSPIVDDPDAAFMSETMRMAVRSVAKHFPTAIVSGRCRDKVFEFVKLAELYYAGSHGMDIKGPASRHAAAKSPPHNKGVLFQPASEFLPMIEQVHQRLEQATSSIPGAKVENNKFCVSVHFRCVDEKSWGALAETVRRVVREFPRLRLSQGRMVFEVRPTIKWDKGKALEFLLDSLGFADCRDVLPVYIGDDRTDEDAFKVLRRRGQGVGILVSKHPKETSASFSLQEPAEVMEFLLRLVEWNRLSRTRLRL

SEQ ID NO: 43101 - protein, 901 aa, Treponema pallidum subsp. pallidum str. Nichols
MNIAKSIHFLSNKEALDKRLDRGLLGIRGRQADELSSLGLPVLPSVVIDATVSRSLYGEKLRSALSPYLRKFTLLNRKEYADAKNPMLLKVVLSPNLAISNYPVLHNFGLTRDTFAGFAERVGEHFATHEVFFLLKGVFGVLLGIAESEENTKGASEFVETLKEIEVFLQGGKSSPSGREAMNRYRALLPDGFFDDAYVQLEEAVRLVSKLLSFEEDGEDGVAILIQPMVYGNYGGGSYSGRFFSRNIITGEKKLQGQYFEERFDECDAEGSDVNAIKPAYLKQLQDIAWKLEDHSREIREVRFTIEAGSLWLIEQKPVEAKSTISLVRLLLDLYEREVVDAEYVVKSVKPGQLNEILHPVIDMTSVTGLKSSQGGIIGVPGAAVGRVYFTADSLIEAWRVAKMGGQDTRCILCMPATYAGDVKAIEVATGVLSNEGGYSAHASVVARQYGKISLVRPDMKIYSDKAVVDGMTINEGDFVTLNVPYYGESTLYMGAAQLIEPDPETSGLVSFIELAKGFVRSFHVRANADSPHDAELALAFGAQGIGLCRTEHMFFKEDRINVFRRMIFSENAEERTGSLKQLQKMQGEDFYGIFKVMQGHEVTIRLLDAPLHEFLPHGESEVSKFLEYLEKVCGKGLSREELQERISMLSEVNPMLGHRGCRIAISYPEIYAMQVRAVFEAVYRLQKEKISVYPEIMIPIVMNCRELKQIVYGKKIEGHAYQGIGSIEEEVRLALKAKEVDYKVGAMIELPAAALSADEIARYAQFFSFGTNDLTQTTLGLSRDDFNTFMPDYTMYDLVDGNPFAILDARVRELIEVAMQRGRLARPDIQLGLCGEHGSRSENIRFCMEVGLDYVSCSSYSVPIALLAIAQAEIENAEKEGRKPAWRGRSSAKSGGRRAR

SEQ ID NO: 43102 - protein, 163 aa, Triticum aestivum
FWSDPDLGARVFAGRRRAPCYFNTGVMVIDLRRWRSGNYRHRVEQWMELQKEKRIYELGSLPPFLLLFAGEVEAVDHRWNQHGLGGDNILGSCRPLHKGPVSLMHWSGKGKPWDRLDAGRPCPLDHTWKSYDLYIGDGDASQASAPSWASLSSSALPAAVFSW

SEQ ID NO: 43103 - protein, 590 aa, Azoarcus sp. EbN1
MCGIAGEIRFDGQSPDVGALERMNARQRVRGPDSGGVFVQGALGFGHRRLKIIDLSESAQQPMFDPALGLGIVFNGAIYNHAALRRELETLGYRFYSRGDTEVLLKAYHAWGQDFVQRLNGMFAFAIWERDSGRVVLGRDRLGIKPLYYSAQPGLLRFASSLPALVAAGGVDTTVDAVALNHYLSFHAVVPAPHTILAGVRKLPPATLMTIHTDGRRSERSYWSLAYAHEPGDAARSFEEWTEILLEGLRSAVGRRLVADVPVGALLSGGVDSSLIVGLMAQAGVQGLRTYNVGFEDVGGEKGNEFEYADIVAERFATIHERIFVPEAQLLARLPEAVAAMSEPMVSHDCIGFFLLSEAVSRHSKVVQSGQGADEVFGGYHWYPKLAGSVDPVGDYLAAFRDRDYDEYCRMVGAANRADDCSGAFVAAHFDLPGAIDPVDKALRLDTTVMLVDDPVKRVDNMTMAFGLEARVPFLDHELVELAARIPARHKLAHGGKGVLKEAARQVIPSAVIDRPKGYFPVPGLKYLQGQVLERVRDALTNRAARERGLFRREYVDTLLADPGAHMTPLRGSKLWQLGLLEWWLQTHVR

SEQ ID NO: 43104 - protein, 538 aa, Myxococcus xanthus DK 1622
MTRPRPLSPEPFLPTLLLTAVAALLLTGCPEEGAVCTSGLSVCGDACVDLRGDVANCGACGNACGDGQTCQAGVCDCRPGTESCGGACVATASDVANCGACGNACAAGLVCESGVCREGCSEGSLRCGDSCVDVRADVLNCGACGNVCPDVQTCHEGRCGYDVVAACYTHGQLVGIQAGTDQLGPRRQFGSGVQTLASWDGHVLAADATASKLLQAAGGALGTVVEEDSLGGVAGSPNDILVDPPYVYVVDSVNNTLQVLKREGPSQGAGLGLRTVTQVNLGANTSPQALAKWGTTLYVPLFGTGGSMFQFGNAVARVDISNPEQPRKVDTISLTGLDLKPFDGGTVLPLPYSVAATEAGVYVSLTNLNPYNGYKPNGPGMLAKIDPASGRVSAIDLGAADCLNAGYVEAVGDQLVVACLGEAEYDEANGHSASAVRASGLVLVKNDAPVAAYALKAGCEPGTLGCNLSVASRFAVAEGAVYLADTNAGRVFVVAVEDGRLVERRGFSSPQALGPALEACPTDPRRPVSNAIDVTALH

SEQ ID NO: 43105 - protein, 291 aa, Listeria monocytogenes str. 1/2a F6854
MTNKITERITGHTELIGLIATPIRHSLSPTMHNEAFAKLGLDYVYLAFEVGDKELKDVVQGFRAMNLRGWNVSMPNKTNIHKYLDKLSPAAELVGAVNTVVNDDGVLTGHITDGTGYMRALKEAGHDIIGKKMTICGAGGAATAICIQAALDGVKEISIFNRKDDFYANAEKTVEKINSKTDCKAQLFDIENHEQLRKEIAESVIFTNATGVGMKPFEGETLLPSADMLRPELIVSDVVYKPTKTRLLEIAEEQGCQTLNGLGMMLWQGAKAFEIWTHKEMPVDYIKEILF

SEQ ID NO: 43106 - protein, 464 aa, Zea mays
  misc_feature (343)..(343): Xaa can be any naturally occurring amino acid
  misc_feature (375)..(375): Xaa can be any naturally occurring amino acid
  unsure (1)..(464): unsure at all Xaa locations
MGKAARWFRSLLGGGRKDQERQASPAPAPADRKRWSFARPSRDSAEASAAATEGSVRGAAGSAAIARAAWLRSLDDDTGRRQSKHAIAVAAATAAAADAAVAAAQAAVEVVRLTSQGPAFGGRGAVLDLDPRGRAGAAVKIQTAFRGFLAKKALRALKALVRLQALVRGYLVRRQATVTLQSMQALVRAQATVRAARCGRALPSLQPRLHHPPARPRFSLQERHADDARSEHGVAACGRRLSASVVVESASYDRSPKTVEMDTARPRSRAASLRTEDEWCAQAQPVSSSPPPPCQRHHHLPPCIEVPTPRHFQDHGWCTPEKPRPATAQCTPRCAPPTPTPAXKSVCGGPASCLAASPSCPGYMSSTQSSEAKSXARSQSAPKQRPARKRVPLSEVVLLQARASLGGGAGTHIKPCNARAQAQAPDACDLRAAVVSRFEQRASEEDAAAAAERGRDVFFLQRRW

SEQ ID NO: 43107 - protein, 381 aa, Candida glabrata CBS 138
MTEGKPIECLAAVAYEAGKPQVVEQIVVDPPKAHEVRIKIVNTAVCHTDAYTLSGADPEGLFPCVLGHEGAGIVESVGDGVTNVKPGDHVIALYTAECQKCKFCLSGKTNLCGAVRATQGKGVMPDGTSRFHNKKGESLYHFMGCSTFSEYTVVADVSVVAIDQTAPLESVCLLGCGVTTGYGAAVKTANVQKGDTVAVFGCGTVGLSVLQGAHQRGASRIIAIDTNDQKKDFCTQFGATDFINPTKDLKENETIVAKLIEMTDGGLDHTFDCTGNVNVMRSALEACHKGWGQSVIIGVAAAGQEISTRPFQLVTGRVWKGSAFGGVKGRSEMAGLIEQYKKGELKVDEFITHRRSFNEINEAFDDLHNGLCLRTVLSFSK

SEQ ID NO: 43108 - protein, 511 aa, Desulfovibrio vulgaris subsp. vulgaris str. Hildenborough
MSLKPTLLLILDGWGKAPAGPGNAVTLAGMPHLSSLLRQAGCTELACSGRAVGLPEGFMGNSEVGHMNIGAGRVVYQDMTRIDIAVERGELASNPALTGLFEAVRATGGRVHLMGLLSDGGVHSHIAHVEALALAARDAGVEVVVHAFLDGRDTAPTSGVGYVKRLASFLESNRAGRIGSLVGRYYAMDRDKRWDRNLLAWAMLTRGEGAPADDPVGAVEAAYAAGETDEFVKPRVVVEGGSPIGTIRDGDGVFFFNFRADRARQLSHMFVDGTFEHGDRGHVPSLAGFATMTSYDPALGLPVAFDKQPLDGTLGEVVANQGLRQLRIAETEKYAHVTYFLNCGREEPFPGEERRLLPSPRDVATYDLKPEMSAEAVTDTLLEEWAGGGYTLAVCNVANLDMVGHTGVIPAAVRACETVDACVRRIADAVLASGGRLVITADHGNAEELLDESGNPQTAHSMNRVPFTVVEQGRVHTFREGGVLGDIAPTILGLWGVPASAGMTGTSLITE

SEQ ID NO: 43109 - protein, 483 aa, Burkholderia sp. RP007
MDTQLIIDNADVPATAAATFERRSPTTGELVTRAAAASVADAIAAADSAAAAYRSWSTTGPTERRRILLKAADLLEARTPEFSRVMALEVGASDLWAGVNVMLAANLFREAAALTTQIQGETIPTDKAGVLSMTVRQPVGVILSIAPWNGPVVLAARAIAYPLVCGNTVVFRASELSPKTHMLIVDVLRDAGLPPGVLNAVTNAPQDAPEVVDALIAHPAVRRINFTGSTRVGRVIAEKAARHLKRCLLELGGKAPLVVLDDADIDEAVKAAVFGAFLYQGQICMSTERIVVDEKIADTFVARFAARARELPVGDPATCGGCVVGPMIVRESGDRINAMINDAVNQGANVVAGGFADGAVMPATIVDRVTPAMRIYDEETFGPITTVVRAKDADDAVRIANDTAYGLSSAVFGRDVTRALSVAMRIEAGSCHINGSTVQNEAQAPYGGTKASGYGRFDGRAVIDEFTELKWITIEPTPQSYPF

SEQ ID NO: 43110 - protein, 716 aa, Pisum sativum
MHQLILPFLKPWKGLVDGKTGYLYFWNPETNVTQYERPLSSAAPPKPSAVPSSSVQVQQSSQGRGRSPDFSDRYDRNGNGGSDESGSRSHQSSKGGTNSSHNNVANGTHVTGNVSSIKGLVASDTGPALTPEAYRRRHEITVTGDNVPPPVMSFASSGFPSEIHKEVQNAGFSAPTPIQAQSWPIALQSKDIVAIAKTGSGKTLGYLLPAFITSSALIITPKWGPTILVLHQQGELATQIQDEAVKFSKTSRIACTCLYGGAPKGPQLRDIDRGADIVVATPGRLNDILEMRRISLHQVSYLVLDEADRMLDMGFEPQIRKIVNGVPARRQTLMFTATWPKEVRKIAADLLVNPVQVNIGNVDELVANKSITQHIEVLAHMEKQRRLESILQSQDQGSKIIIFCSTKKMCDQLARNLTRQFGAAAIRGDKSQADRDHVLNQFRSGRTPVLVATDVAARGLDVKDIRVVVNYTFPTGVEDYLHRIGRTGRAGATGIAYTFFGDQDAKHASDLIKILEGANQKVPPELRELSSRGGGGFGRSRRYGSGGRGDSGFGAKSYDSGSGYGGRGNDSGYGGRGSDSSYGRKGGYGSSAAFGRGGGRGFDYDSQRNERDRSPDRGSSWSDRFKTRERSRSPVKAAPSQYNAPVSFHQAMMERNGGGSDRNKSFNRERSRSHSPYRHDKGKRSPSPLAVVGPTVVQVLEETVVLILTMENWRKG

SEQ ID NO: 43111 - protein, 929 aa, Arabidopsis thaliana
MGLCLAQLAVTCLFLVPFVLSQVTEFVSIDCGCSSNYTDPRTGLGWVSDSEIIKQGKPVTLANTNWNSMQYRRRRDFPTDNKKYCYRLSTKERRRYIVRTTFLYGGLGSEEAYPKFQLYLDATKWATVTIQEVSRVYVEELIVRATSSYVDVCVCCAITGSPFMSTLELRPLNLSMYATDYEDNFFLKVAARVNFGAPNMDALRYPDDPYDRIWESDINKRPNYLVGVAPGTTRINTSKTINTLTREYPPMKVMQTAVVGTQGLISYRLNLEDFPANARAYAYFAEIEELGANETRKFKLVQPYFPDYSNAVVNIAENANGSYTLYEPSYMNVTLDFVLTFSFGKTKDSTQGPLLNAIEISKYLPISVKTDRSDVSVLDAIRSMSPDSDWASEGGDPCIPVLWSWVNCSSTSPPRVTKIALSRKNLRGEIPPGINYMEALTELWLDDNELTGTLPDMSKLVNLKIMHLENNQLSGSLPPYLAHLPNLQELSIENNSFKGKIPSALLKGKVLFKYNNNPELQNEAQRKHFWQILGISIAAVAILLLLVGGSLVLLCALRKTKRADKGDSTETKKKGLVAYSAVRGGHLLDEGVAYFISLPVLEEATDNFSKKVGRGSFGSVYYGRMKDGKEVAVKITADPSSHLNRQFVTEVALLSRIHHRNLVPLIGYCEEADRRILVYEYMHNGSLGDHLHGSSDYKPLDWLTRLQIAQDAAKGLEYLHTGCNPSIIHRDVKSSNILLDINMRAKVSDFGLSRQTEEDLTHVSSVAKGTVGYLDPEYYASQQLTEKSDVYSFGVVLFELLSGKKPVSAEDFGPELNIVHWARSLIRKGDVCGIIDPCIASNVKIESVWRVAEVANQCVEQRGHNRPRMQEVIVAIQDAIRIERGNENGLKSSSSSSSKAQSSRKTLLTSFLELESPDISRNSLAPAAR

SEQ ID NO: 43112 - protein, 643 aa, Poa secunda
MAALQPSFSSTTMAMNNSCNTMKFPKTALLPGFGGLSRTQDVQDRNASLTCSRPKAASVTDQSVAEPAKPRQKKQTVDPAAPEFLPLPAFEECFPRSTKESSEIVHEKSGHSLKVPFRRIHLTGDSGHFDNDTSGPQNISPRLGLPKIRKEWIDRREKLGSPRYTQMYYAKQGIITEEMLYCAKRENLTPEFVRSEVARGRAIIPSNKRHLELEPMIVGRNFLVKINANIGNSAVVSSIEEEVHKLQWATMWGADTVMDLSTGRHIHETREWIIRNSSVPIGTVPVYQALEKVNGIAEDLSWEVFRDTLIEQAEQGVDYFTIHAGVLLRYIPLTAKRMTGIVSRGGSIHAKWCLTYHKENFAYEHWDDILDICNQYDVALSIGDGLRPGSIYDANDSAQFAELLTQGELTRRAWEKDVQVMNEGPGHIPMHKIPENMQKQLEWCNEAPFYTLGPLTTDIAPGYDHITSAIGAANIGALGTALLCYVTPKEHLGLPNRDDVKTGVISYKIAAHAADLAKCHPYAQAWDDALSKARFEFRWLDQFALSLDPVTAMSFHDETLPSDGAKVAHFCSMCGPKFCSMKITEDIRKYADEHGYGTVEEAVRQGMSDMSAEFTAARKTISGEQHGEAGGEIYVPESYLAKK

SEQ ID NO: 43113 - protein, 969 aa, Arabidopsis thaliana
MELTSFQKSPSSNDVVSFSVSLVRNSRARRRRSSAAESLKRRNDGYESLCQVVQQDSDRRLITIFVIFFIVIPAVSIAVYKVKFADRVIQTESSIRQKGIVKTDINFQEILTEHSKASENSTRHYDYPVLAYITPWNSKGYDMAKIFNSKFTHLSPVWYDLKSQGSGLVLEGRHNADKGWIQELRSRGNALILPRVVLEAIPGEMLNKKKLREKAISLIVTECKEMEYNGIVLESWSRWAAYGVLHDPDLRKMALKFVKQLGDALHSTSSPRNNQQHMQFMYVVGPPRSEKLQMYDFGPEDLQFLKDSVDGFSLMTYDFSNPQNPGPNAPVKWIDLTLKLLLGSSNNIDSNIARKVLLGINFYGNDFVISGDSGGGGAITGRDYLALLQKHKPTFRWDKESGEHLFMYRDDKNIKHAVFYPTLMSILLRLENARLWGIGISIWEIGQDKGHFGKYAEASLEASSIFSGHTFDMQFRTNPRQLSRNGSMLLSLTLFFHFFFIIFNRWEKFDDTEWTILGVEGESERERVMEALKTATFSPMSVLSEKRSEPRKPFSLPNLFPPKSQRPISQESFLKRFNGGLALLTSVLSSATAPAKSLTYEEALQQSMTTSSSFDSDGLIEGISNFVTDNPLVIAGGVAALAVPFVLSQVLNKKPKSWGVESAKNAYTKLGTDDNAQLLDIRATADFRQVGSPNIKGLGKKAVSTVYNGEDKPGFLKKLSLKFKDPENTTLYILDKFDGNSELVAELVALNGFKSAYAIKDGAEGPRGWLNSSLPWIEPKKTLSLDLSSLTDSISGVFGESSDGVSVALGVAAAAGLSVFAFTEDRKQTLKQVDEFLNTKVAPKELVDELKEIGKALLPQSTSNKALPAPATVTAEAESATATTTTVDKPVPEPETVAATTTTVDKPVPEPEPVPEPVPVPAIEAAVAAQVITEPTETEAKPKPHSRPLSPYASYPDLKPPSSPMPSQP

SEQ ID NO: 43114 - protein, 294 aa, Zea mays
MEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILHGVAYCHSHRVLHRDLKPQNLLIDRRTNALKLADFGLARAFGIPVRTFTHEVVTLWYRAPEILLGARQYSTPVDVWSVGCIFAEMVNQKPLFPGDSEIDELFKIFRILGTPNEQSWPGVSCLPDFKTAFPRWQAQDLATVVPNLDPAGLDLLSKMLRYEPSKRITARQALEHEYFKDLEVVQ

SEQ ID NO: 43115 - protein, 600 aa, Shigella flexneri 2a str. 301
MVNNMTDLTAQEPAWQTRDHLDDPVIGELRNRFGPDAFTVQATRTGVPVVWIKREQLLEVGDFLKKLPKPYVMLFDLHGMDERLRTHREGLPAADFSVFYHLISIDRNRDIMLKVALAENDLHVPTFTKLFPNANWYERETWDLFGITFDGHPNLRRIMMPQTWKGHPLRKDYPARATEFSPFELTKAKQDLEMEALTFKPEEWGMKRGTENEDFMFLNLGPNHPSAHGAFRIVLQLDGEEIVDCVPDIGYHHRGAEKMGERQSWHSYIPYTDRIEYLGGCVNEMPYVLAVEKLAGITVPDRVNVIRVMLSELFRINSHLLYISTFIQDVGAMTPVFFAFTDRQKIYDLVEAITGFRMHPAWFRIGGVAHDLPRGWDRLLREFLDWMPKRLASYEKAALQNTILKGRSQGVAAYGAKEALEWGTTGAGLRATGIDFDVRKARPYSGYENFDFEIPVGGGVSDCYTRVMLKVEELRQSLRILEQCLNNMPEGPFKADHPLTTPPPKERTLQHIETLITHFLQVSWGPVMPANESFQMIEATKGINSYYLTSDGSTMSYRTRIRTPSYAHLQQIPAAIRGSLVSDLIVYLGSIDFVMSDVDR

SEQ ID NO: 43116 - protein, 111 aa, Oryza sativa (japonica cultivar-group)
MAAAEEKKKKKMIKIIEYCTKHAAVEGRSTAAAELKRFDEELIDVDTDTLYHLLMAGNLMGVEGVLELAVQRTAELIRGKSPEEIRDTFKIANDFTPEEEEIIKENAWALQ

SEQ ID NO: 43117 - protein, 264 aa, Oryza sativa (japonica cultivar-group)
MASGSSSGDMGSSGAKDVILDEPLLTSGSAESSQQRSTDADTKSRVEDIWKKMNSGMPAKMPKPVMNKLSTPAKEKKSTTGNNWMSVLGLSPSKASTNDQGSKNGQKQAQQETSEDAKKLAASALAAVRDAASAAAGRGKVEITEVRDFAGKDIEIKKLVDADSTEAIEKAKAAGAAPSALDHILEQIKKKQKLSVLDKTKKDWGEFKEENKGMEEELDQYKKSSNKYLDKVSFLQRADYREFERERDARLSMMSKRKSDTRED

SEQ ID NO: 43118 - protein, 352 aa, Myxococcus xanthus DK 1622
MARPSRSAAKKPRLRALPGRPAQPPAVLPDAEATLAYARSVLEAEARAILGVTERLGDDFLRAVQLVRDCRGQVIVTGMGKAGHIGQKLSATLASTGIRSVYLHPAEAVHGDLGRVGRGDVILALSNSGSTEELIRLLPSFKRMETPVIALTGDAKSPLGRGADVVLDIGAIAEACPMGLVPTASTAALHAIGDALAMTVLRSRPFGTEDYALLHPGGKLGRSVQRVFELMRTGNANPLVRDTSPLSAVVGVMTKTPGRPGAACVVDKAGKLVGIFTDGDLRRRVEAGLTDFTVPVRELMGKNPRCVTPETLVLAAATQMRELRVDQLPVVDVEGRAVGLLDVQDLLAAKFV

SEQ ID NO: 43119 - protein, 200 aa, Listeria monocytogenes str. 1/2a F6854
MDKQAILNNIHQTWQEEANAISRLPEVTSEEALVKTVETIAECTGKIVVAGCGTSGVAAKKLVHSFNCIERPAVFLTPSDAVHGTLGVLQKEDILILISKGGNTGELLNLIPACKTKGSTLIGVTENPDSVIAKEADIFFPVSVSKEPDPFNMLATASTMAVIASFDAVIVCLMTYMNYTKEQFSVIHPGGAVGNKLLNK

SEQ ID NO: 43120 - protein, 567 aa, Oryza sativa (indica cultivar-group)
MDAVAFPPPPAPFLDDDLDFGDFAFADPQPAAAAFFDAFGAYDDDWGDFVDSRLGSNPDGGSSAAAPAEKPPSWEKPRGPLPLSLFGADEDEEEEEGPAELPPTAADQRGASHASSNGSKPADLKDLIAGLYGSHPQPSSTDAAEVGTQEGSAAAAAEEEEEDGDGFEDDGWEFKAAAPSSSSDAVQDGGRQAHGDLTQDVPKSMSSDQEGWSLFTSVSENLNNVQTTDHVGTHENHSIKSASDRILIDFYHKLREESLTVISQYKKDLKESQKNSMLSDEKNEVMTETEREIQEICKELQDSSLAKGFCKDEHPSKDVCISELLNSAKEDHLKDFDKEYHLTEIIAMALEDMSSAVKLYKHSVSILRTLEIASKEEQCDYVSAWYSMLLSCAQELQHGAMIWQESCHANVGETVISQGAHYFIALGEIYRVAQILHISMLSFKPWVLADPGMLSKMLVCWNSCVNSWTSGLGMALTMVVDSKNLDAPVAKVLLESIININDIEVPNLQSFLPSDKMACKLTLLPTSLVPGMEVIIWDANHYFVKVANLWANQISSDTPQFSVSRVA

SEQ ID NO: 43121 - protein, 228 aa, Gossypium bickii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSVE

SEQ ID NO: 43122 - protein, 358 aa, Desulfovibrio vulgaris subsp. vulgaris str. Hildenborough
MSRTIIPFGPQHPVLPEPLHLKLVVEDETVVEAIPALGYVHRGLETLASIRDYNQMVYVVERVCGICSCIHAMCYCQSLECMMNVEVPRRAKVLRTIWSELHRIHSHLLWLGLFADGFGFESLFMQFWKVRERVMDINEATAGNRVVISTNIVGGVRRDLSPEHQKWILDEMNHLEREIRALMTTILDDYTVCKRTKGVGVLTAQQAIQLGAVGPMLRGSGVAQDARQLQYAAFDELDFEPIAVPDGDSWARCKVRFLEVLQSVDLVRQAISKLPDTELSVKVPGKPEGEVVARVEQPRGELMYYVKGNGSKHLERVRIRTPTFANIPPLLAIMGGLQLADVPVAVLSIDPCISCTER

SEQ ID NO: 43123 - protein, 352 aa, Streptococcus pneumoniae
MNNTEFYDRLGVSKNASADEIKKAYRKLSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEF

SEQ ID NO: 43124 - protein, 461 aa, Oryza sativa (japonica cultivar-group)
MEKKASILMNRYELGRMLGQGTFAKVYHARNLASNQSVAIKVIDKEKVLRVGMIDQIKREISIMRLVRHPNIVQLHEVMASKSKIYFAMEYVRGGELFSRVARGRLKEDAARKYFQQLIGAVDFCHSRGVYHRDLKPENLLVDENGNLKVSDFGLSAFKECQKQDGLLHTTCGTPAYVAPEIINKRGYDGAKADIWSCGVILFVLLAGYLPFHDSNLMEMYRKISKGDVKFPQWFTTDVRRLLSRLLDPNPNIRITVEKLVEHPWFKKGYKPAVMLSQPNESNNLKDVHTAFSADHKDNEGKAKEPASSLKPVSLNAFDIISLSKGFDLSGLFENDKEQKADSRFMTQKPASAIVSKLEQIAETESFKVKKQDGLVKLQGSKEGRKGQLAIDAEIFEVTPSFFVVEVKKSAGDTLEYEKFCNKGLRPSLRDICWDGQSEHPSLAQSSTLTQSSKSISRHAI

SEQ ID NO: 43125 - protein, 392 aa, Arabidopsis thaliana
MSSPEKKRKTTKKPSPTPQSTTPNPSLPDDLVVSCLARVSRLYYPTLSLVSKSFRSLIASPDLYKTRSLLGRTESCLYVCLQEKDSDPNPRWFTLCLKPNRTLTNDITEKKKKKKKKKKMSSGYVLAAIPVLHSRPAYWSGLVAVGSNIYNIGGPIDKAHSSIVSVLDCQSHTWHEGPGMRVERRYPAANVVEGKIYVTGGCKDCSNSSNWMEVFDPRTQTWESVSSPGAEIGGCSIHKSAVVEGEILIANSHGLIYKPKEGRWERMKWDMDIGWVWYSYCVVENVLYYYYKGVFKWYDTMARLWRDLKGVKGLPRFARCGGKMADYGGKMAVFWDKIVTSDDGCKNKMILCAVIALERRNSEEIWGKVEWHDAVLTVPLSYEVVYALSPTV

SEQ ID NO: 43126 - protein, 355 aa, Glomerella cingulata
MSRANPPNASGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDNLSKEQLKQLIYQEIMR

SEQ ID NO: 43127 - protein, 359 aa, Oryza sativa (japonica cultivar-group)
MATSSLLPLHLPTRPSAVKASAAATAAAAPTPQSLEESFGRKGLRFAADPATGAPTAELSVRNGSSLQLRLADGLVTSYRPKVYWKDDGCREVLHTVAGAGAGGEVKGGVGLALSEVSSSGAAESLLVGSEWSVVDADSDSYDAVQVELGCTKGSGTLEVTYVVTLYPLSMATAVMVKNNGKKPVSLTSAMLSHIKFDKRRGTAVEGLRGCPYCSHPPPAAGFALLTPAEAMKREDGGWFGGGGGEEPRQGVWTVEDNLYTILKKKVSRVYAAPPEERKKRIYSTAPSKFTTIDQNSGLGFRVVRMGYEDMYLCSPGEMYRKFGKDYFLCTGTASMLVPVVVNPGEEWRAAQVIEHDNL

SEQ ID NO: 43128 - protein, 248 aa, Azoarcus sp. EbN1
MQLKDRVAIVTGAGQGIGATVARAYAREGAKVAVIDLNIDAANAVAAEIVANGGEALGVACDVSNRDQVLAMAEQVTAKWGRVDILVNNAGITRTAMLNKMTPEQWQQVLGVHLTGAFNCLQAVVGGMIERQYGRIIYVTSTAGLLGTIGQINYSAAKAGILGMTKSTAKELARYNITANAIAPGAATPMTETIRTDERFKEKYLDRIPLGRWAEPEEIAPVFLFFASDASSYVTGQILAADGGMTIH

SEQ ID NO: 43129 - protein, 348 aa, Listeria monocytogenes str. 1/2a F6854
MKALKLYGKRDLRYEEADMPTIEEPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 43130 - protein, 474 aa, Haemophilus somnus 2336
MNKEIKTQVVVLGAGPAGYSAAFRCADLGLETVIVERFSTLGGVCLNVGCIPSKALLHVAKVIEEARSLSAHGIVFGEPTTDIDKIRGWKEKVINQLTSGLAGMAKQRKVQVVNGYGKFSGPNAIIVAGDEGETKITFDNAIIAAGSRPIQLPFIPHEDPRIWDSTDALKLKEVPENLLIMGGGIIGLEMGTVYHALGSKIDVVEMFDQVIPAADKDMVQIYTKRIEKKFNLLLETKVTAVEAKEDGIYVSMEGKAASETRRYDAVLVAIGRVPNGKLIDAGIAGVEVDDRGFIRTDKQMRTNVPHIFAIGDVVGQPMLAHKGVHEGHVAAEVIAGQKHYFDPKVIPSIAYTEPEVAWVGKTEKECKAEGINYEVAKFPWAASGRAIASDCADGMTKLIFDKDTHRVIGGAIVGTNGGELLGEIGLAIEMGCDAEDLALTIHAHPTLHESVGLAAEVFEGSITDLPNPKAKKKK

SEQ ID NO: 43131 - protein, 228 aa, Gossypium nelsonii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAEINPAAPLDKVCILSCGISTGLGAALNVAKPTKGSTVAIFGLGAVGLAAAEGARIAGASRIIGVDLNPNRFEEAKKFGCTEFVNPNDHNKPVQEVLAEMTNGGVDRSVE

SEQ ID NO: 43132 - protein, 886 aa, Haemophilus somnus 2336
  misc_feature (180)..(180): Xaa can be any naturally occurring amino acid
  unsure (1)..(886): unsure at all Xaa locations
MSDILKNDVDPVETNDWLLAIDSVIREEGIERAQYIIEQLMQHARANSVSLPTGVSTDYINTIPPSEEPNYPGNLDLERRIRSAIRWNSIMMVLRASKKDLDLGGHMSSFQSSATIYEVCFNHFFKARTEKNGGDLVFFQGHISPGIYARAFLEGRVTEEQLDNFRQEVKARGSFLSHPXLMPEFWQFPTVSMGLGPLNAIYQARFLKYLHNRGLKDTSEQTVYAFLGDGEMDEVESRGAIAFAAREKLDNLVFVINCNLQRLDGPVTGNGKIIQELEAQFNGSGWEVIKVIWGRRWDRLLQRDTSGKLLQLMMEVVDGDYQTFKSKDGAYVRKHFFGRYPETEALVAEMTDDEIFALNRGGHDPLKVFAAFNKAKQVKDKPVVLLVKTIKGYGMGEAAEGRNIAHQVKKMDMSGVKHVRDRFNVPVSDAEIDNLPYVKFAEGTEEYKYLHERRQALNGYLPTRLPRFTQQMDVPALEEFAQLFEEQSRPISTTMAFVRSLNVLLKNKSVGKHIVPIIADEARTFGMEGLFRQIGIYNPHGQNYTPQDREQVSYYREAIDGQVLQEGINEQGATASWLAAATSYSTNDMPMIPFFVYYSIFGFQRVGDLMWLAGDQRARGFMIGGTSGRTTLNGEGLQHEDGHSHIQSSVVPNCISYDPAFAYEVAVIIQDGVRRMYGPEQEDVYYYITTLNETYDQPAMPKGAEEGIRKGIYKFETVTGQGKGKVQLLGSGSILRHVREAAKLLADDFGVTSDVYSVTSFTELARDGANADRWNLLHPKAEAKVPYIAQVMNDAPAIASTDYVKLFAEQVRPYIPAQSYRVLGTDGFGRSDSRENLRKHFEVNAHYVVIAALTELAQQGTISKDVVAQAISKYGIDADKINPLYA

SEQ ID NO: 43133 - protein, 575 aa, Haemophilus somnus 2336
MISGITASPGIVFGKALVLKEEKIVLDTQKIKDEQIDIEVARFYSGRTAAIEQLIAIKDRALVSLGEEKAAIFEGHLMILEDEELEEEILDYLRSNKVNAGVAASKIIDQQVAMLSEIDDEYLQERAGDIRDIGNRLIKNILGMKIVDLGDINEEAILVAYDLTPSETAQLNLDKVLGFITDIGGRTSHTSIMARSLELPAIVGTNDITSKVNTGDYLVLDAVNNAIYVNPTQEEIERLKALERQLAEEKAELAKLKDLPALTLDGHQVDVVANIGTIRDCEGADRNGAEGVGLYRTEFLFMDRDQLPTEEEQFIAYKEVVEAMNGRLVVLRTMDIGGDKDLPYLNLPKEMNPFLGWRAIRIGMDRREILHAQLRAVLRASAFGKLAVMFPMIISVEEIRELKSVIESLKQELRDEGKAFDENLQVGVMVETPAAAINAKFLAKEVDFFSIGTNDLTQYTLAVDRGNELISHLYNPMTPAVLNLIKHVIDASHEEGKWTGMCGELAGDENATLLLLGMGLDEFSMSAISIPRIKKLIRNVNYQDAKLLAEQALQQPTAAGILSLVNDFLVEKALN

SEQ ID NO: 43134 - protein, 116 aa, Glycine max
KEKKGKEKTEEKREEQHHKEDTAPEKAEAAETAHAEEKKGPDKKEKPPGHKKTEVFFFTTPPPPPPDASLDHGEGAHHEGEAKEKKGILEKIKEKLPGYHSKTEEEKEKEKESGGH

SEQ ID NO: 43135 - protein, 228 aa, Gossypium australe
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGAALNVAKPTKGSTVAIFGLGAVGLAAAEGARIAGASRIIGVDLNPNRFEEAKKFGCTEFVNPNDHNKPVQEVLAEMTNGGVDRSVE

SEQ ID NO: 43136 - protein, 392 aa, Candida glabrata CBS 138
MVSVTFKNFKKEKYPLDLESSQSIVAVKEALSEKLSCDPSQIKLIFSGKVLKDGDSVESCNFKDGNEVIFMVSAKKATATKVTESSAPKAQSEETPSESTPATSTQPETNQNETTEPATNSSSENTEAPNAGTDDGFVVGSERNATIERIMEMGYERAEVERALRAAFNNPDRAVEYLLMGIPETLRPQEGQTSQEHEADVDMNEEESTEGNAEPPAEDDLFAQAARDSATPSAAQTAGGTTSESAGSATGGPPGSIGLTMEDLLALRQVVSGNPEALAPLLENLSNRYPQLREQIMANPEVFVSMLLEAVGDNLQGAMDFEAIAEGEGDTVEGADGFAEENAPITLSPEDEQAISRLCELGFERTLVIQVYFACDKNEEIAANMLFSDYAD

SEQ ID NO: 43137 - protein, 443 aa, Arabidopsis thaliana
MSELKERLLPPRPASAINLRGDAGSRPSPSGRQPLLGVDVLGLKKRGQGLKSWIRVDTSANSQVIEVDKFTMMRRCDLPARDLRLLDPLFVYPSTILGREKAIVVNLEQIRCIITADEVLLLNSLDNYVLRYVVELQQRLKASSVTEVWNQDSLELSRRRSRSLDNVFQNSSPDYLPFEFRALEVALEAACTFLDSQASELEIEAYPLLDELTSKISTLNLERARRLKSRLVALTRRVQKVRDEIEQLMDDDGDMAEMYLTEKKKRMEGSLYGDQSLPVYRTNDCFSLSAPVSPVSSPPESRRLEKSLSIVRSRHDSARSSEDATENIEELEMLLEAYFVVIDSTLNKLTSLKEYIDDTEDFINIQLDNVRNQLIQFELLLTTATFVVAIFGVVAGIFGMNFEIDFFEKPGAFKWVLAITGVCGLVVFLAFLWFYKRRRLMPL

SEQ ID NO: 43138 - protein, 347 aa, Ashbya gossypii ATCC 10895
MQAIFDLFNQVPRATWSLASSLRDSGAKEARVVENPDSVDFDANQFDIRHRIDLRGVLYPQERSALLILNQELRLSREFLQALWDSSGICVCADGGANRLHDFFIDERERAQHLPAYIVGDLDSLRDDVRAFYEGHGVVVLEQSTQYASDLMKSVQVSSLHFNHEPFRACARKGRVDTHNGVGEMIAARQAAGWTPEPLRLLVLNAIDGRFDLTVHSVAQMYTLREQHPYLTLFYITPTDLLFLVPADGTCVSYTSDMRAAMFGCCGLLPLGGSCTLRRTYGLKWDVCAWDTSIAAGRVSSSNYLVGDTGCYVDADRDILMSIELRWNGVDRWYTAAQLSNHSSHEC

SEQ ID NO: 43139 - protein, 513 aa, Pinus contorta
MEVSVLMWVLLFYSLLGFQVTTARLDRNNFPSDFMFGTASSAYQYEGAVREDGKGPSTWDALTHMPGRIKDSSNGDVAVDQYHRYMEDIELMASLGLDAYRFSISWSRILPEGRGEINMAGIEYYNNLIDALLQNGIQPFVTLFHFDLPKALEDSYGGWLSPQIINDFEAYAEICFRAFGDRVKYWATVNEPNLFVPLGYTVGIFPPTRCAAPHANPLCMTGNCSSAEPYLAAHHVLLAHASAVEKYREKYQKIQGGSIGLVISAPWYEPLENSPEERSAVDRILSFNLRWFLDPIVFGDYPQEMRERLGSRLPSISSELSAKLRGSFDYMGINHYTTLYATSTPPLSPDHTQYLYPDSRVYLTGERHGVSIGERTGMDGLFVVPHGIQKIVEYVKEFYDNPTIIIAENGYPESEESSSTLQENLNDVRRIRFHGDCLSYLSAAIKNGSDVRGYFVWSLLDNFEWAFGYTIRFGLYHVDFISDQKRYPKLSAQWFRQFLQHDDQGSIRSSSSI

SEQ ID NO: 43140 - protein, 228 aa, Gossypium australe
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAASLDKVCILSCGISTGLGAALNVAKPTKGSTVAIFGLGAVGLAAAEGTRIAGASRIIGVDLNPNRFEEAKKFGCTEFVNPNDHNKPVQEVLAEMTNGGVDRSVE

SEQ ID NO: 43141 - protein, 327 aa, Acidithiobacillus ferrooxidans
MDATDQKRLLREMLFARRFEERCAEAYHERQIGGFLHLYPGEEACAIGVLEKARTGSDYVVTGYRDHIHALKSGMDPKALMAELFGKETGCSKGRGGSMHLFDPDVHFMGGYALVGGPFPLAAGFAKAIQLRGSDEISICFLGDGANNQGTFHETMNMASLWNLPVLFVCENNLYGIGTAIERSTVEINQYKRVAPYRIEAAQCDGQDIDVVMDHAEKAVQYVREKRKPYFLELMTYRLRGHSMSDSGAYRSKEEVEEWAQRDPIGIYKHRLLEAGVVSEDEFHAMDKAILDEIENEIVRFAAESPEPRLEDIARYVYTEKEAGSHG

SEQ ID NO: 43142 - protein, 343 aa, Acidithiobacillus ferrooxidans
  misc_feature (163)..(163): Xaa can be any naturally occurring amino acid
  unsure (1)..(343): unsure at all Xaa locations
MAEMMYWQGILRAHDEEMARDPLVFAMGEDIGVAGGTYKATSGLFAKYGEQRVIDTPISENSYTGIGVGAAMIGARPIVEIMSVNFAWLAMDQLMNNAAKIHYMSGGRIRCPFVMRVPGGTAHQLGAQHSARMEKVFMGISGLRVVTPATPRDAYGLLKSAVXLNDPVVIIEHESMYNLKGEIPDEEFFTPLEGVEVMRPGKDVSIFAYNISVHWALDAAQKLAQDYGIDAEVVDLRALKPMDRAGIAASVRKTHRAVVVEEDEAPVGVGSEVMAILNEECFFDLDAAPVRVHALDVPIPYKSRLEKAAIPNAGEVVALCGRCWAGKIPAIRPLLNLGLTQQW

SEQ ID NO: 43143 - protein, 110 aa, Ehrlichia canis str. Jake
MKNDIMDKIKHDIENNDVVLYMKGDADFPQCGFSSVVVSILKKMKVNFKSINVLEDLELREAIKEFTNWPTIPQLYVKGEFIGGCDIVKEMYHSGELQELFSKNNLISTQ

SEQ ID NO: 43144 - protein, 223 aa, Oryza sativa (japonica cultivar-group)
MYAAMYPETFGFSAYPQQQQPPPDAASCIYTTALPLIADPPDILGNMAQPSFLSEYDLGGEGDLFKAPEPIIEEPVLSLDPVAAAISMMSGSENVMDETIEVADISDIQNDSLLSEVLYECEKELMEKSAIEETISELLDVKIPMLQVEEFPRETQVQLPAMEKEKPSVPECCSLQKSVSSGCLNSADWINGPARPNFLDFQGLDFETAFGLRRAYSEGDIQV

SEQ ID NO: 43145 - protein, 412 aa, Desulfovibrio vulgaris subsp. vulgaris str. Hildenborough
MHLFQYREGSLFAEDVSIIDLASTYGTPLYVYSAGTLERHYRAFDSAFGKAAHLTCFSVKACSNIHILKLLGSLGAGVDIVSGGELHRALLAGIPGRRIVYSGVGKRPDEIRSALEADILMFNVESLQELRTIEEVAASMGTTARVSLRINPDVDPHTHPYISTGLQKNKFGIEMTQALEGYMLARDLPHIDPIGIDCHIGSQLTSLSPFLEALDKVLEFREHLSILGLDISYLDLGGGLGITYGEETPPHPRDFGRAVLERTKGLNLTLVLEPGRVIAGNAGILVTEVLYTKTTPSKQFVIVDAAMNDLVRPSLYASYHRIAEVLPHGRTEQTVDVVGPICESGDFLARDRVLPAVEQGELLAVFSAGAYGFSMSSQYNSRPRAAEVLVRGDTAKSIRRRETYDDLTALEG

SEQ ID NO: 43146 - protein, 341 aa, Xanthobacter autotrophicus Py2
MTAELDAIAQKMVADGKGILAADESSGTIKKRFDAIGVESTEENRRDYRELMFRSEAMTKYISGVILYEETIRQKAKDGTPLVSLIEQAGSIPGIKVDAGAKPQPAFPGETITEGLDGLAGRLKEFYDLGARFAKWRAVIDIDTAKGIPSYGSIRANAHALARYAALCQEAKIVPIVEPEVLMDGSHDIDTCYQVTEWVLKTTFEELYYQRVRLEGMVLKPNMIVPGKKAAKQASVAEVAEKTVRVLKSCVPSVVPGIAFLSGGQSDEDATAHLDAMVKLGGLPWKLTYSYGRALQAAPQKAWAGKAENVAKAQAAFTHRAHMNSLAALGQWSSEEERKAA

SEQ ID NO: 43147 - protein, 273 aa, Flavobacteria bacterium BBFL7
MQKSILITGSTDGIGKLTALKLAKEGHNIYIHGRSEDKVNLVVSDIKQASNNENIKGYVADFSNLKAVKQLADLINKEIPSLDILINNAGIFKTPVSKTDTGLDIRMSVNYLAPYLLTENILPVLEKGTHTRIVNLSSAAQSTVKKGILTGDVSINASDSYAQSKLALTMWSFHFAQQHSNITTIAVNPGSLLNTKMAKEAYGQHWSPAEKGVNILFDLATSDAYQDATGKYFDNDKGETIGHFATAHPDAYDRDKILMLEAMTNEVLSDLGE

SEQ ID NO: 43148 - protein, 242 aa, Flavobacteria bacterium BBFL7
MTILIFVLVLWYGGLFFQSFFLHRYAAHQVFTMSKTMERITFILTWIFQGASYLSAYGYGIMHRMHHAYTDTEKDPHSPSYDANLFAMMWKTKTIYQDINKQRIEVDQRFTKDVPQWNGFDQFASSRFSRLLWITGYVLFFALFATAWWQWLLLPLTFLMAPVHGVIINWFGHIYGYVNFKMKNTSKNLFRFDFLMMGEGYHNNHHKHASRANFGVKWYEIDMTYVVIKLLHTMRIITLKNT

SEQ ID NO: 43149 - protein, 593 aa, Pseudomonas putida GB-1
MTADNAIFIPPYKADDQDVVVELNNRFGAEAFVAQETRTGMPVLWVKRAQLKEVLSFLRGVAKPYSMLYDLHGVDERLRTQRRGLPAADFSVFYHLLSVERNSDVMIKVSLSEGDLNLPTVTGIWPNANWYEREVWDMFGIDFAGHPHLSRIMMPPTWEGHPLRKDYPARATEFDPYSLTLAKQQLEEESARFNPEAWGMKRQGANEDYMFLNLGPNHPSAHGAFRIVLQLDGEEIVDCVPDIGYHHRGAEKMAERQSWHSFIPYTDRIDYLGGVMNNLPYVLAVEKLAGIKVPQKVDVIRIMLAEFFRITSHLLFLGTYIQDVGAMTPVFFTFTDRQRAYTVIEAITGFRLHPAWYRIGGVAHDLPRGWDKLVKDFVEWLPKRLDEYTKAALQNSILKGRTIGVAAYNTKEALEWGTTGAGLRSTGCDFDLRKARPYSGYENFEFEVPLAHNGDAYDRCMVRVEEMRQSIRIIDQCLRNMPEGPYKADHPLTTPPPKERTLQHIETLITHFLQVSWGPVMPANESFQMIEATKGINSYYLTSDGGTMSYRTRIRTPSYPHLQQIPSVIKGSMVADLIAYLGSIDFVMADVDR

SEQ ID NO: 43150 - protein, 961 aa, Photobacterium profundum SS9
MNNVFDLDELKLASNIPVVHELYDLTPDELLLSQEHYESEVRSYPRRLPLAIAKAAGVMVEDTRGQLFIDCLAGAGTLALGYNHPEINQAIIDQLQAGLPYQTLDLTTPTKDKFIREVMSFLPDEFANNACIQFCGPSGADAVEAAIKLAKQTTGRNTMAAFHGAYHGMTNGTMAMMGNLSTKSRRQGLMSDVHFLPFPYSLRCPFGLKGDEGAKQSLRYIERMLSDDESGVQKPAAIIVEPVQGEGGVIPAPAFWLQELRRITKEQGILLILDEIQCGIGKTGHNFAFEEAGITPDILCLSKAVGGGLPMSLLIFNKSIDTWLPGEHTGTFRGNQLAMATGATTLQIIRRDNLVDHAQKAGQYLREGIERIAQYTDCIAEVRGKGLMLGVEIVKPNGAKNKFGEPEADPELTVNIQRAALERGLIIEKGGRQGSVLRFLPPLIITFEQIDFVLDALSKAIIATAGPAKIVEPVTANDQDDWRSYFIHTGEGGADQFEKVLNQTTQVLKNVFEGTTAPYSGLDPEVLKSMIYNIDLDHQQLPIETVIEQTGELIAKNSIMVQHPHCIAHLHTPPLLPAVAAEAFIASLNQSMDSWDQASSATFVEQKVVDWLCGVYNLGEQADGVFTSGGTQSNLMGLLLARDWAADTISGHNIQKDGLPEYASKMRILCSKKSHFTVQKSASLMGLGEHAVECVDTNPDGTIKIAALIKTVETLKNEGLLPFALVGTAGTTDHGAIDDLANMADIAEQHNLWLHVDGAYGGALILSRHKTRLHGIEKADSVSVDFHKLFFQPISCGAVLLKDKENFKYLLHHADYLNREDDLLPNLVDKSIATTKRFDALKVLMTMQCVGTQALGGMYDHLLGQTQQVADLVNNRNEFELLADPALSTVLFRYVGETADTDTDLLNKKIRMEALVKGVAVLGETVVDGKVALKFTILNPCLTMADFELLLNNINQLALTL

SEQ ID NO: 43151 - protein, 361 aa, Oryza sativa (indica cultivar-group)
MWPCLSPRAAVLIALLLLPAAMAAAAAAAGGHGEEMKSIYAGPKVVPVRLGRPAFGPESLAFDHRGGGPYTGVSNGRVLRWRADRRRPGWTEFAHNYKHATVAECAARKKAAAAESVCGRPLGVQFDRRTGEMYIADAYLGLMRVGRRGGMAEVVAAEAGGVALNFVNGVDVDQATGDVYFTDSSTTYKRSDYLLVVLSGDATGRLLRYEPRTGNVTVLESGLAFPNGVAVSADGTHLVVAETASCRLLRHWLRGSNAGATEVLADLPGYPDNVRPAAADGGRGASYWVALNRDKAWTVNGTTPASVAAVRVVVDDGGGKVDVALRGFGGATVSEVVERNGSLWFGSVDTPYVGLLKLTSL

SEQ ID NO: 43152 - protein, 452 aa, Azoarcus sp. EbN1
MRKIDVHELIDKAKFNRFHWQVLFWCALIIIFDGYDLVIYGVVLPVLMKEWDLTPLQAGTLGSYALFGMMFGALIFGPLSDRFGRKRVIAICVMLFSFFTFINGFATTPTEFAICRFIAGLGIGGVMPNVVALMTEYSPKKLRTTLVAIMFSGYSVGGMLSAGLGMYLIPNFGWPSVFFVAGVPLLLLPVILYALPESIGFLLHAKRDAEAGVLLGRVEPNFAARTGDRYEMPTGKTSHVSLVALFKDGRALSTLMFWLAFFMCLLMVYALASWLPKLMTQAGYGLGSSLSFLLVLNFGAIFGAIGGGFIADRLHLKTVLMVFFVIAAFSISLLGFKSPTAVLYLLVAAAGATTIGSQILLYAYVAQFYPMAIRSTGIGWASGVGRSGAIVGPILGGTLLGMAMPLEYNFMFFAIPGAIAAFAVSLVARSAAHAPSEELPLPFAAETGAISD

SEQ ID NO: 43153 - protein, 479 aa, Oryza sativa (indica cultivar-group)
MAHRLLLPTNPLLPPGTGTATPRRRPVAATVRAALATSAEKARAAVGAEVVRSIRARQIVDSRGNPTVEVDLVAGDGRLHRSAVPSGASTGIYEALELRDGDGAAYGGKGVLNAVRNINEVIAPKLVGVDVRNQSDVDAIMLDIDGTPNKSKLGANAILGVSLSVCRAGAGAKEVPLYKHIQELAGTKELVMPVPAFNVINGGSHAGNNLAMQEFMLLPVGASSFSEALRMGSEVYHALKGIIKAKYGQDACNVGDEGGFAPNVQDNREGLVLLMDAIEKAGYSGKIKIGMDVAASEFLTKDGSYDLNFKNQPNDGAHVLSAQRLCDLYKEFVKDFPIVSIEDPFDQDDWSSWASLQSSVNIQIVGDDLLVTNPNRIAEAIGKKACNALLLKVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 43154 - protein, 170 aa, Oryza sativa (japonica cultivar-group)
MGEIRTLRDMDDDEVFAYAKRIAAPYDLVMQTKQLGRLPVVLFAAGGVATPADAALMMQLGCDGIFVGSSIFKSGDHARHARTIVQAITHCRSLRPSTLPPRRPRWHTFAVELCPVCRDREREEEMNGEKERKKKNGEREIDKWANLSLTKVSLSILTGNNKIMGGASNS

SEQ ID NO: 43155 - protein, 307 aa, Lotus japonicus
MAKEVEGFKFEQRHGKERVRVARVWKNNQGHHFVVEWRVSISLLSDCLNSYLRDDNSDIVATDTMKNTVYAKAKECSEILSVEDFAILLAKHFTSFYKQVTTAIVKIVEKPWERVNVDGQPHEHGFKLGSEKHTAEAIVQKSGALQLTSGIEGLSLLKTTKSGFEGFIRDKYTVLPETRERMLATEVTALWRYSYESLYSIPQKPLYFTEKYLDVKKVIVDTFFGHPKEGVYSPSVQSTLYQMAKATLNRFPDVASIQLKMPNIHFIPVNLSNKDGPIVKFDDDVYLPTDEPHGSIEASLSRILSKM

SEQ ID NO: 43156 - protein, 228 aa, Gossypium anapoides
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 43157 - protein, 380 aa, Pichia methanolica
MSTAGKTITCKAAVAWEAGKDLSIETIEVAPPKAHEVRVKIAYTGVCHTDAFTLSGKDAEGEFPVIFGHEGAGIVESIGEGVTSVKVGDHVVCLYTPECKECKFCKSGKTNLCGKIRATQGKGLMPDGTSRFTCKGKKLLHYMGCSTFSQYTVLADISVVAVDPKAPMDRTCLLGCGITTGYGAATNTAKISPGDNIAIFGAGCIGLSVIQGAVERKAGKIIVVDINDDKKEWADKFGATDFVNPTKLPAGVTIVDKLVEMTDGGCDFTFDCTGNVGVMRNALEACHKGWGESIVIGVAPAGAEISTRPFQLVTGRVWKGCAFGGVKGRSQMPGLVQDYLQGKIKVDEFITHRHPLEDINDAFHDMHAGDCIRAVITMDE

SEQ ID NO: 43158 - protein, 183 aa, Methanocaldococcus jannaschii DSM 2661
MLLEETLKSCPIVKRGEYHYFIHPISDGVPVVEPKLLREVATRIIKIGDFEGATKLVTAEAMGIPLVTTLSLYTDIPYVIMRKREYKLPGEIPVFQSTGYSKGQLYLNGIEKGDKVVIIDDVISTGGTMIAIIDALKRAGAEIKDIICVIERGEGKKIVEEKTGYKIKTLVKIDVVDGKVVIL

SEQ ID NO: 43159 - protein, 643 aa, Oryza sativa (japonica cultivar-group)
MHLGVSLVPPLPLHFPRRAPYGFRSAAPRRIAVCPLLSVGRRRRLGAPPRAARGGGEGPEEEMRRLLELLPGELRRRVEGHPELPALVEVVMDLGRPPLARFPSGDFLLSQSPISFDDLRHATSQVGDFGADNRAGISRTLHRISAIRNRKGAIIGLTCRVGRAVPGSANLLQDLVKDGGSLLLIGPPGVGKTTVIREIARMLADDYRKRVMIVDTSNEIGGDGDIPHPGIGNARRLQVPNQDMQHKVLIEAVENHMPQAIVIDEIGTKLEAMAASTIAQRGIQLVATAHGITIENLIMNPSLDMLVGGVQSVTLGDEEANRRGVQKTVLERKGPSTFTCAAEIVSKIELRVHRSLEDTVDALLAGKMPNVEIRKVGSKGPVQEVYVQKERLDLGPSEGATQLDTDSLSNARRSLDSAFNLDPAEGHIGRSTEAEPDLNLYAYGISESTALQAIKQLELEDIVTLTYNISEADAVIALQSKLKKNTQIQAVVKSQDIPVFFTKTNSLVQIRRALRALVDDHTDGLMDFEDTEVRSSEETDALEEARLAIEQVVIPKGESVQLLPRPPSIIASQVDLVESFKLKWESIGQEPNACLRILPQFVGVEEGGKSVKQEAATELTDSDNSDDMDYKQNGVSRLPFLPE

SEQ ID NO: 43160 - protein, 744 aa, Pseudomonas syringae
MSQLDKDAFEVLLANCADEPIQFPGAIQPHGLLFTLKEPELTILQVSANVQSVLGKVPDQLAGQTLDCVLGAGWAEVIRSTSANDSLVDVPRLLMSVEGVEFEALLHRSQEALVLELEIQDKAAQAISYSERTGNMGRMLRQLHAAADLQTLYEVSVREIQRMTGYDRVLIYRFEEEGHGQVIAEASAPAMELFNGLFFPASDIPEQARELYRRNWLRIIPDANYTPVPLVPQLRPDTQQQLDLSFSTLRSVSPIHCQYMKNMGVLSSMSVSLIQGGKLWGLISCGHRTPLYVSHELRSACQAIGQVLSLQISAMEALEVSRQRETKIQTLQQLHQMMATSDTDVFDGLAQQPQLLMDLVGATGVAIIEDRQTHCYGNCPEPSDIRALHTWMMAGGEPVYASHHLSSVYPPGEAYQTLASGVLAMSLPKPVDNGVIWFRPEVKQSVQWSGDPNKPLNLDASDNTLRLQPRTSFEIWKVEMTGIATKWSHGDVFAANDLRRSALENDLARQVSKEQQAVRARDELVAVVSHDLRNPMTVISMLCGMMQKSFSSDGPHTSRRISRQSTHAASCQPHERVARDLLDTSKIEAGRTPSRRSRWKSARYSKRPIRCSPRWRMDKSIEISFNAEPDIKVNADPERLFQVLSNLIGNAIKFTPKLGRIGVAAMSNGDEVVFTVRDSGEGIPPEQLPHIFERYWTVKEGNPTGTGLGLYISQGIIKAHGGELAAQSQVGHGSEFRFTVPIAH

SEQ ID NO: 43161 - protein, 440 aa, Oceanicola granulosus HTCC2516
MNRPLTPNDMSSFWMPFTPNRDFAADPRLVVAADGMHYTSSDGRQIIDGAAGLWCVNAGHNSPRIVEAVKKQVSTLDYAPHFNFGTPQAYELSARLAALFPAGLEHVFFTNSGSESVDTALKIALHYHRMRGDAARTRLIGRERGYHGVGFGGISVGGMVKNRMHFGTMLAGVDHIRHTHDPERNAFSRGCPEHGAEFADDLIRLAELHDPSTIAAVIVEPMAGSTGVLLPPKGYLQRLREICDRYGILLIFDEVITAYGRLGKASAAEKFGVTPDIITTAKGLTNGTIPMGAVMVSEKIYDSAMENADAPIELFHGYTYSAHPIATAAALATLETYREDQLFERADALAPVWEDLVHGLKGLPHVKDLRNLGLVAAIELESREGAVGARATEAMKAAWAKGLMVRVTGDTIALSPPLIVTEAQIAEIFDILSGILRDLA

SEQ ID NO: 43162 - protein, 349 aa, Arabidopsis thaliana
MEKPKLKTVQEVVAAGEKLPERYLYTPTGDGEGDQPFNGLLPEMKISIIDLNLLFSSSDDGREELSKLHSAISTWGVVQVMNHGISEALLDKIHELTKQFFVLPTKEKQKYAREISSFQGFGNDMILSDDQVLDWVDRLYLITYPEDQRQLKFWPENPSGFRETLHEYTMKQQLVVEKFFKALARSLELEDNCFLEMHGENATLETRFNIYPPCPRPDKVLGLKPHSDGSAFTLILPDKNVEGLQFLKDGKWYKASILPHTILINVGDTMEVMSNGIYKSPVHRVVLNGKKERIYVATFCNADEDKEIQPLNGLVSEARPRLYKAVKKSEKNFFDYYQQGRRPIEAAMI

SEQ ID NO: 43163 - protein, 491 aa, Ehrlichia ruminantium str. Welgevonden
MLHLQTTVLFFIITEFSFKVINMNKHEFLIIGSGPGGYIAAIRAAQLGYNVAIIEKENTLGGVCLNWGCIPTKSLLHSALIYHNIKKADVFGINVTNVTCNFTKIIERSRNVVEKLSNGISGLMKKNNIKVYSGTAKLLGEGTVEVLDNNNDKINITSKHIIIATGSHPRNLPNINFDNNIIWNAKNAMTPNILPKSLAIIGTGAIGIEFASFYNTFGTQVTMIELRDNILPLEDHEVSKSMHQILNQKGIKIYTKSSVTKLEKSNNNARIQISNTIDLEVDKVILAVGIQPNTDNLGLDNTKIQIDQAGFIITDKYCCTSESGVYAIGDVAGPPCLAHKASHEAILCVENIAAQEKKITDRNIHHINKENIPSCIFSIPQIASIGLTEHQAKSMGYDIKIGKFNANCSGKAIAIDETEGFVKVIINKTTGELLGAHMIGAEVTEMINGYIIGKQLEATDRDIISSIFPHPTLSEMIHEAVLASNNESLNS

SEQ ID NO: 43164 - protein, 349 aa, Zea mays
MAPDLVNGVLNWVGTPAMVASLLLFYPPYYLFKTCYSFLSWLFPEDLAGKVVLITGASSGIGEQLAYQYALNRASLALVARRESSLRHVADRALELGARDVVVLPGDVSAPDDCDRFVRTAISHYDRLDHLVCNAGVASVGAFEEIPDVTSYSSQLDVNFWGSVQTTFAALPHLKRSRGRIVVTASATGWNPVPRMSIYNAANAALINFFETLRTELGNQVGITVVTPGWVESEMSRGKFLKEHGQVEVDQEMRDAQIGLFPVEYAKNCAKAMVQAARQGERYLTVPAWFGAMYLWRLFAPEVVEACYRLLYMHGHGARQADAPSRTMAEAGGKQLLYPTSLRSEEIKE

SEQ ID NO: 43165 - protein, 396 aa, Xanthobacter autotrophicus Py2
MTAFRTLDDADLADKRVLVRVDLNVPMESGRVTDETRLKAILPTIRTITDKGGKAVLLAHFGRPKGRDESQSLAPVAKALEGQLGRKVAFASDCVGEEASSAISRLAAGEVIVLENTRFHAGEEKNAPDFVEALASLGDIYVNDAFSAAHRAHASTEGLARKLPAYAGRSMESELAALTKALEAPVRPVLAVVGGSKVSSKLELLGNLVKKVDILVIAGGMANTFLAALGKKVGKSLCEHDLADTAREILEKAKAAGCEIVLPVDAVVAKEFKANAANRVVSVDEVGDDEMILDAGPETVAVVAQKLDGAKTVVWNGPFGAFEMTPFDAATVAVARDVGKRTRAGTLLSVAGGGDTVAALNHAGVAGDFSYVSTAGGAFLEWLEGKALPGVEALRR

SEQ ID NO: 43166 - protein, 485 aa, Acidobacteria bacterium Ellin345
MEAIISPTPKSAPSNTPQLARDLRVSHATAVVVGTIIGSGIFLVPAEMMRAVGTAKLVYLAWIVGGILSFLGALTYAELGAMKPQSGGEYVYVRDAYGPLMSFLYAWSWFVIAKPGSMATIATGMMQILGGYPALSFLPKNVVSGVPFTYAQLAAVALIIFISAVNYIGVKKAGQFQVVFTVLKLAIIFGVIVVGFFAGHGSWSNFTTSFTGATGGIAGFMIALVAALWAYDGWNDINMVAEEIDHPERNVPIALIVGVGIVAALYMLLNAAVQYALPAQAIAMSKRAASDAVLVSIGAGAASIFAALMAIQMLATINGTTLSGARIPYALARDGYFFEAIGKVHPRYLTPANAIVFQGALAVILVSLVGKFQQLFSLTIFAEWLFYMIATSTVFVFRRREPNANRPYKTWGYPVVPAVFIAAAAMLLCYTFVDNLKYAMIPTTLIGPPLNSISTGGALVILLGVPVFWWFARQKSLTTKGTKEL

SEQ ID NO: 43167 - protein, 336 aa, Xanthobacter autotrophicus Py2
MSVKVAINGFGRIGRNVLRAIIESGRTDIEVVAINDLGPVETNAHLFRFDSVHGRFSGEVKVAGDTIDVGRGPIKVTAVRDPAQLPHKDLGVDIALECTGIFTARDKAAAHLAAGARRVLVSAPAEGADLTVVYGVNHDKLTSEHLVVSNASCTTNCLAPVAKVLNDAVGIEKGFMTTIHSYTGDQPTLDTMHKDLYRARAAAMSMIPTSTGAAKAVGLVLPELNGKLDGTSIRVPTPNVSVVDFKFIAKRATTKDEINAAVLAAAASGPLKGILGTTDQPNVSIDFNHDPHSSTLHLDQTKVLEGTLVRVLSWYDNEWGFSNRMADTAVAMGKLG

SEQ ID NO: 43168 - protein, 663 aa, Xanthobacter autotrophicus Py2
MLSRTSHDRMANAIRFLAMDAVEAANSGHPGLPMGAADIATVLFTKVLKYDPTRPFWPDRDRFVLSAGHGSMLLYSVLHLAGYEKVTIEEIKRFRKLGSLTPGHPENFVTEGIETTTGPLGQGIATAVGMAMAERALAARFGKDVVDHHTFVLCSDGDLMEGISQEAADLAGHLKLSKLIVMWDDNGISIDGATSISGSTDQLARFAASGWATTRIDGHDPDAILAALTAAKASDRPTLIACRTVIGFGSPKKAGSEKVHGSPLGADEIAATRAALGWEAAPFEIPADVLAGWRAAGAAGSAARAAWEARLAAAPEADRAEFERRIAGTLPQALEGAIVAVKQKAVADGGAVATRKSSELVLDFITPVVPEMLGGSADLTGSNNTKAKGAKAITPDDFAGSFVHWGVREHGMAAAMNGITLHKGLIPFSGGFLVFSDYCRPSIRLAALMGERVIHVLTHDSIGLGEDGPTHQPVEHLAALRAIPNLLVMRPADTVETAECWQIALQSEGRPSALILSRQNLPILRTDATAENRSAGGAYEIVAASAKAQASLFATGSEVSLAVEAAKLLEAQGVPTRVVSIPSFELFLERPAAERAKVIGDAPAKVAVEAAIRMGWDAIVGSDAAFVGMTSFGASAPGKDLFAHFGLTPDKVAAKALDQLRQV

SEQ ID NO: 43169 - protein, 269 aa, Mycobacterium tuberculosis H37Rv
MSEGPKKAGVLGSPIAHSRSPQLHLAAYRALGLHDWTYERIECGAAELPVVVGGFGPEWVGVSVTMPGKFAALRFADERTARADLVGSANTLVRTPHGWRADNTDIDGVAGALGAAAGHALVLGSGGTAPAAVVGLAELGVTDITVVARNSDKAARLVDLGTRVGVATRFCAFDSGGLADAVAAAEVLVSTIPAEVAAGYAGTLAAIPVLLDAIYDPWPTPLAAAVGSAGGRVISGLQMLLHQAFAQVEQFTGLPAPREAMTCALAALD

SEQ ID NO: 43170 - protein, 388 aa, Desulfovibrio vulgaris subsp. vulgaris str. Hildenborough
MAAFKLADRLATLPPYLFAGIDKVKAEVAARGVDIISLGIGDPDMATPGFIIEAMKEAIARPANHQYPSYVGMLAFRQEVANWYDRRFGVSLDPATEVIGLIGSKEGIAHFPFAFINPGDLVLVCTPNYPVYHIATGFAGGEVQFVPLLEENDFLPDLDAIPEDTWKRAKMIFVNYPNNPTAATAPLGFYEKLVDICRRFDVIIAHDTAYTEIYYDEDNRPPSILSVPGAKDVAIEFHSLSKTYNMTGWRVGMAVGNPTLVAGLGKIKENMDSGIFQAVQEASIVALRDGDDFCRELRGIYRQRRDTVINALHKAGIQCRVPQATFYVWARVPQGHTSADFVTRVLQETGVVVTPGNGFGTPGEGFFRISLTVDNARLEEAVSRIAKL

SEQ ID NO: 43171 - protein, 422 aa, Xenorhabdus nematophila
MRPSDIEFDLRHIWHPYTSMIRPFPAYPVVSATGVELVLSDGRKLIDGMSSWWAAIHGYNHPVLNEAAKSQIDKMSHVMFGGITHPPAVELCKQLVALTPDSLECVFLADSGSVAVEVALKMALQYWQARGEKRQRFLTLRHGYHGDTFGAMSVCDPDNSMHSLYNGYLPNHLFADAPTCQFDDEWQPEDIDSFKRLLRQYHAEITAVVLEPIVQGAGGMRIYHPEYLRQVRQLCDEHQILLIADEIATGFGRTGKLFACEHAQIEPDILCLGKALTGGYMTLSATLTTRHVAEIISQGEAGCFMHGPTFMGNPLACAVASASLKLLSESSWQQHIQSIETQLKTELLPLKIHHSVKDVRVLGAIGVVEMKQPVDVASLQRHFVQQGVWIRPFGRLIYLMPPYIIQSEQLSQLTTAIVDAIN

SEQ ID NO: 43172 - protein, 248 aa, Triticum aestivum
  misc_feature (82)..(82): Xaa can be any naturally occurring amino acid
  misc_feature (84)..(84): Xaa can be any naturally occurring amino acid
  misc_feature (217)..(217): Xaa can be any naturally occurring amino acid
  misc_feature (230)..(230): Xaa can be any naturally occurring amino acid
  unsure (1)..(248): unsure at all Xaa locations
MAESLDMSLEDIIKSNKKGNSSSGGGGRRREGRRGSAAAAGGVGPNRRAFKRSGNRAAPYQPPKAPESAWQHDMYSDASARXRXGGRVSAIETGTKLLITNLDFGVSTEDLKELFSELGDVKRCLIHYDRSGRSKGTAEVIFARRGDAVAALRKYNNVQLDGKPMKIEILGTNTPTAPAALPTNNGSYARNVAKSAPRGVSASLPQNRPRARGGRGXRGGGGGSGSGGRXGKERPRVLLKLWPEFGKP

SEQ ID NO: 43173 - protein, 338 aa, Glycine max
  misc_feature (170)..(170): Xaa can be any naturally occurring amino acid
  unsure (1)..(338): unsure at all Xaa locations
MSVRDHTQKIDLVETMKELWAQMGSLMATIVFMYTIFERFFPPHLREKLQAYTQKLTNHFNPYIQISFPEFSGERLKKSEAYTAIQTYLSANSSQRAKRLKAEVVNDSQTPLVLSMDDNEEITDEFHGIKLWWSANKVSNNPQRYNPFSYYGSSDEKRFYKLTFHKRHRXDIVTMSYIKHVLDEGKDIEMRNRQLKLYTNNPSSGWYGYKQSKWSHIVFEHPATFETLAMDRRKKEDILKDLVKFKKGKDYYAKIGKAWKRGYLLYGPPGTGKSTMIAAIANFMNYDVYDLELTAVKDNTELRKLLIETPSKSITVIEDIDCSLDLTGQRKKKKKKKR

SEQ ID NO: 43174 - protein, 487 aa, Mycobacterium sp. JLS
MTELIPHVIDGEETESASRACFDTVDPWTRQPWARVALGGHEEAARAVTAARRAFDDGPWPRMGLAERGAVLHRLADLIIEHRDELALADTTDMGKPITDTRGNDVPRSAQNFRFFADHARLSAGEALPMDTGHHAYTRFEPAGVVAAIAPWNFPLMLETWKVAPALAWGNTVVLKPAEDTPASATILARLALQAGMPDGVLNVVHGYGPGSVGSALTGDPRVDRITFTGETGTGRTIAAAAAAHLTPVSLELGGKGANLVFADADLDSAVSWSIRAIFSNAGQVCLAGSRLYVQREIYDEFLSRFVNAAESLIAGDPKLAGTQLGPLASEEHWKKVRSYVEGIPADGGTMRTGGPGEGWLIRPTVVTDLPATARLCREEIFGPVAVVAPFDTEADGIAAANNTPYGLNAMLFTENLSRAHRVAAALNAGTVWVNCFFVRDLRAPFGGVGDSGIGREGGTFSREFFTEPKAVVMAISDIASAHVQSD

SEQ ID NO: 43175 - protein, 143 aa, Zea mays
MPVPLAPYPAPPAPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCSFVTSVGTSPGAEQKPSS

SEQ ID NO: 43176 - protein, 97 aa, Glycine max
RYIESMVADIHRTWLNGGIFMYPADAKSPNGKLRLLYEVFPMSYLMEQAGGQAFTGKQRALDLIPKKIHERSPVFLGSYDDIEQMKELYAASKEDDA

SEQ ID NO: 43177 - protein, 260 aa, Solanum lycopersicum
MADSSREENVYLAKLAEQAERYEEMIEFMEKVAKTADVEELTVEERNLLSVAYKNVIGARRASWRIISSIEQKEESRGNEDHVNTIKEYRSKIEAELSKICDGILSLLESNLIPSASTAESKVFYLKMKGDYHRYLAEFKTGTERKEAAENTLLAYKSAQDIALAELAPTHPIRLGLALNFSVFYYEILNSPDRACNLAKQAFDEAISELDTLGEESYKDSTLIMQLLRDNLTLWTSDNADDVGDDIKEASKPESGEGQQ

SEQ ID NO: 43178 - protein, 657 aa, Zea mays
MMNYVIFGVLLLVVGGGLRPSPAAADVFCDNLKQVAATLPQNTSSSPVQFATAIVGQAPDVVYALAFCQGDYSATACRECVAQAFNVTPACNKDGIFSYKACPVLYAGDNFIDPSNATEQADDTPFVRWNINNVTGDADDVRLITGLIRELLVDTVDRAASTAPRRFATGVMDSGRPFPTMYSMAQCTPDLSASDCLACLRRLVGMVNSTMALRMGAQIHVIRCYFRYEAYSLYDSQPMLRVGPPSVPAPAPAPAIGARRKSKLWVIPVVVVPLAVAAAAALCFIFYSPWFRRYRKGETTMAKAGSQELQGELVLDGKNSEFRVFDFEQVLEATNDFSDENKLGEGGFGAVYKGQFADGLEVAVKRLASHSGQGFTEFKNEVQLIAKLQHSNLVRLLGCCSQEEKKILVYEYLPNKSLDSFIFDENKRALLDWSRLLSIIEGIAHGLNYLHKHSRLRVIHRDLKPSNILLDREMNPKISDFGLAKIFSSNNIGGNTTRRVVGTYGYMAPEYASEGIFSVKSDVFSFGVLVLEIITGKRNSGSHQCGDFINLIGYAWQLWDDGRWIDLVDAYLVPMNHSAEMTKCIKIALLCVQENASDRPTMAEVVAMLSLSNDTAMIVAEPKQPAYFNVRVGNEEAYTTTESCSINDVTISVTTPR

SEQ ID NO: 43179 - protein, 376 aa, Coccidioides immitis RS
MPSPCTAKTTLSIGIQRARGANRYTWKNPSFVLEAVKKVKFEDRPVPTIQHPHDVMINVKYTGVCGSDVHYWDHGAIGHLVLKEPMVLGHESSGIVISVGPGVRSLKPGDRVALEPGVPCRQCEACKGGKYNLCDDMRFAATPPYDGTLAKYYILPEDFCYKIPESMNLQEAALMEPLSVAVHITKQGGVKPGDQVVVFGAGPVGLLCCAVARAFGASKVIAVDVQQVRLHFARKYAATATFMPGSIPAAENAQRLKEQCGLGRGADVVLDASGAEPSAQTGIHALRPGGTYVQGGMGRAEFSVPIMVVCTREISVKGSFRYSSGDYKLALELVQTGKINVRDLITKVVRFTDAEQAIIEVKAGKGIKTLISGVED

SEQ ID NO: 43180 - protein, 358 aa, Oryza sativa (japonica cultivar-group)
MSALYLARGASKVVRRITSETSVELKILTEKWQLLLAGLVFQYIHGLAARGVHYLHRPGPTLQDLGFMILPELGKERGYISETLFTFIFLSFVLGMEVIVDLHIMNRSEKSSYRTTPQSRCAVLVATRAEEAAVKTLMVWTFHPFILQTKRFYTVLIWRRVLAFLCASQFLRIVTFYSTQLPGPNYHCREGSALARLPHPQNVAEVLLINFPRGVIYGCGDLIFSSHMIFTIVFVVTYQKYGNIRFIKMLAWCIAIAQSLLIIASRKHYSVDVVVAWYTVNLVVFFVDKKLTELPDRSAGSTSVLPVSIKEKDSKLKEDKTRMLNGNSVDSADWRPWTQMNGKHIENGNHLDTETTKT

SEQ ID NO: 43181 - protein, 253 aa, Glycine max
MGRKFFVGGNWKCNGTTEEVKKIVTTLNEAKVPGEDVVEVVVSPPFVFLPVVKSLLRPDFHVSAQNCWVRKGGAYTGEVSAEMLVNLGIPWVIIGHSERRQLLNESNEFVGDKVAYALQQGLKVIACIGETLEQREAGTTTAVVSEQTKAIAAKISNWDNVVLAYEPVWAIGTGKVATPAQAQEVHADLRKWVHDNVSAEVAASVRIIYGGSVNGGNCKELAAQPDVDGFLVGGASLKPEFVDIINAATVKKN

SEQ ID NO: 43182 - protein, 189 aa, Glycine max
  misc_feature (174)..(174): Xaa can be any naturally occurring amino acid
  unsure (1)..(189): unsure at all Xaa locations
MELTRLISVLFFLLVITVGSSASPQHWRKKRVREPCKKLVFYFHDIIYNGHNSKNATSAIVGTPAWGNRTILAGQNHFGDLVVFDDPITLDNNLHSPPVGRAQGFYVYDKKEIFTAWLGFSFVFNSTHHRGSINFAGADPLMNKTRDISVIGGTGDFFMTRGVATLSTDAFEGXVYFRLRADINLFECW

SEQ ID NO: 43183 - protein, 518 aa, Schizosaccharomyces pombe
MRDFQSRFADRYNQITNSYSYSSSRQGLITGMVNVGSFFGCLLSSPVADKIGKRLSIIVWTTVYLIGIIIQVTTVPSWVQILVAKIWTGLSIGALSVITPGYQSEVAPAIMRGAIVTTYQLFITLGIFIAACINMGTHKYSHGTTAQWRISIGINLLWGIITLVGIIFLPESPRYLIAIGKDDEALKIMCYNNDLPLEHEIIQTEYHTIKSDCDAELAGGPARWPEIFNANIRYRTFLGMAVMMFQQLTGANYYFYYGTQVFRGTGMDSPYLAALIPDAVNCGCTFGAIFVLEFFGRRSPLIVGGIWQYICFFIYAAVGDRALYHKNGTSNHRAGAVMIVFSCLFIFSFSQTWAPAAYVIVGESYPVRYRSKCAAVATSANWFWNFLISFFTPFITNSIGFKYGYIFASCNLTGAAIIFLFVHETKGRTLEEINTMYASNLKPWMPHPEGYREFGREQNNATLKSHIGLNGETTELIENTDNQGDSGSFQTSTPDDSRPEQNQASATYIRPDKREPRL

SEQ ID NO: 43184 - protein, 283 aa, Ashbya gossypii ATCC 10895
MLLLALSDAHIPDRSIDLPSKFKKLLNVPNKIGQVVLLGNCTRSYQFLKFVNEVSSNVVIVRGEFDNATIRTVQNVKEEIPMNTIIKQGDFKIGCCNGYTLVPKSDPLSLLILARQLDVDIMLWGGTHSVEAYTLEGKFFINPGSCTGAFSTDWPLQDDALQGEGSPSAKLNGAATAPQPTEGEAGDENGLQQELSTSSRTPREAEARVLGSPNNRRELEGGAADVEAEENSEDDEEVDEVDINGGCIPSFCLLDISGSTCTLYIYTFVSGEVKVDKVVYKKD

SEQ ID NO: 43185 - protein, 540 aa, Prochlorococcus marinus str. MIT 9312
MSKIRSKSINKLSKPQSPVVLAILDGWGYREAISDNAIKSAKTPIMDSLWHAYPHTLISASGSEVGLPDGQMGNSEVGHLTIGSGRIIQQELVRISNVVKNNQLCIVNELKEMADSLKRNKSTLHITGLCSDGGVHSHIDHLLGLIKWASDNGIKKVAIHIITDGRDTPAKSASKYLNQIESCIKKFDTGEIASICGRYWIMDRNLLWDRTEKAYANLTDPDIKVSNISPQDYIKQSYDKNITDEFIEPIRISENYLKDGDSLICFNFRPDRARQIIKSLSEKKFSDFKRKVVPNLDLVTFTQYDQNFSVKVAFPPESLNNFIGQIVSENGLKQYRTAETEKYPHVTYFFNGGVEIPLPGEERHLIPSPRVATYDMEPEMSAEELTISCSKAIKSGDYAFVVINFANPDMVGHTGNMNATIKAIETVDKCIGQIVNATGEMGGSILITADHGNAEVMKGPAGEPWTAHTINKVPLIFIEGEKRKIPNMGNEIYLRDNAGLADIAPTLLQLLNLPIPKEMTGKSLIKEIELKGYNKVVQHV

SEQ ID NO: 43186 - protein, 490 aa, Arabidopsis thaliana
MFKKALELSTLCNIEVCVIYYGRDGELFKTWPEDESKVRDMAERFTKLNERERRKKRTNLSLFLRKKILDDNKLSGKVLEMKDSLERGLRVLQDKLLLLQPENQTKSLTRSVSSLDYLRTGNMKKKRCILSSQIKLIVENEFCSKQNLTKKKSTKIFEKQNFLKCFFIYGVIFSYEIKPTAQFVSLGLVKSISNIIWKYKNFTILYNPEPCKKTKLSVRNQTCFKKSSLSSSSTAKKTTNLSMREQTMFKKALELSTLCNIDVCVIYYGRDGKLIKTWPEDQSKVRDMAERFSRLHERERCKKRTNLSLFLRKKILDDTKLSEKVLEMEDSLESGLRVLQDKLLLLQPEKNQTEFGQTRAVSSTTNPLSPPPSLIEDHRHQQWTEPLMSGVSNTEQDLSTSSLSQNQSRISVFLYNHDNRSFYQVPDSVSSFDQSALLGEQGSGLGSNFDLPPMVFPPQMQTQTPLVPFDQFAAWNQAPSFADPMMFPYN

SEQ ID NO: 43187 - protein, 216 aa, Desulfovibrio vulgaris subsp. vulgaris str. Hildenborough
MSSTLVLETTAYTLEQLIHLDAPQIALAGRSNVGKSSLVNALARRKQLAKTSSTPGKTRSVNYYRVEPEGFYIVDLPGYGYAQCSKEERKKWAKLIEKYIVSCKSLRGLAVLLDCRLDPQRLDVDLTSYARANNIPLLPVLTKGDKCKLRERSDRQKQWAVLLGGRKPLVTASMTGLGIADLWRELRALAAGGLSADDEAEDAPSDTSDAIDDVTA

SEQ ID NO: 43188 - protein, 286 aa, Oryza sativa (indica cultivar-group)
MCIAAWAWQSQPAHRLLLLFNRDEYHSRPTQPAGWWAAGKAEVKLILGGRDELGGGTWLGCTRDGKLAFLTNVREPGTLVGAKSRGELPVRFLQGNQCPLEYAEEIAKEADQYNGFNLVLADVQSGNMAYISNRPEGDPVVQKVLPGFHVLSNAAIDCPWPKMLRLGQSFNRFLATQDGAEVSLQQMVEELMMDPVKADKSAVPDTGVDPDWEYQLSSIFIDTEKGQARYGTRSMTALAVKFNGEVTFYERYLESNLWKENLMQFELEMSQWEDLRGTSNISPKSC

SEQ ID NO: 43189 - protein, 320 aa, Pseudomonas putida GB-1
MKDLLVGDIGGTNARFALWRDNQLHDVKVFATADYTSPEQAIEAYLEGQGIARGGLAAVCLAVAGPVDGDEFRFTNNHWRLSRTAFCKTLQVDQLLLINDFTAMALGMTRLREGEFREVCPGQADPSRPALVIGPGTGLGVGSLLRLGEQHWQALPGEGGHVDLPVGNAREAAIHQHIHGQIGHVSAETVLSGGGLVRLYQAICALDGDTPRHKTPAQVTDAALGGEPRALAVVEQFCRFLGRVAGNNVLTLGARGGVYIVGGVIPRFAELFLRSGFAASFADKGCMSGYFAGVPVWLVTAEFSGLLGAGVALQQALDHS

SEQ ID NO: 43190 - protein, 333 aa, Pseudomonas putida GB-1
MTLRIAINGFGRIGRNVLRALYTQGYRQDLQVVAINDLGDSAMNAHLLKYDSVHGTFDASVEADHESLTVNGDRIAVSAIRNPAELPWKAEAIDVVFECTGLFTDRAKAAAHLAAGAGKVIVSAPAKGADATVVYGVNHDILRASHQVISNASCTTNCLAPIAQVLHREFGIEQGLMTTIHAYTNDQVLTDMYHSDPYRARSATQSMIPSKTGAAEAVGLVLPELAGKLTGMAVRVPVINVSLVDLTVNLKREATAEQVNQLFLEASKHSKVLGYNALPLVSCDFNHNPLSSIFDANHTRANGRMLKVLAWYDNEWGFSNRMLDNCLALSNAR

SEQ ID NO: 43191 - protein, 426 aa, Mycobacterium sp. JLS
MPCERLEHRDRLMSGQTVVIVGSSVGGVRTAKALRSQDFSGRIVLIGGDRRLPYDKPPLSKQFLAGQWDESRLTMLTAEQADEAGIELRLGSAAEHLDLADRAVLLADGARVPFDILVVATGADARPSPWPVASGVHLLRTLDDSRGLARALAAAGPVVVVGGGFIGAEVAATAHAAGRNVTIVDPLTAPIGRIVGAELGAILTGVHARHGVQTRFGVGVESVDGCEGDLRVTLTNKETLPAATVVVGIGAIPNDGWLSSSGLLIDDGVVCDEFCRAVGHPGVYAVGDVARWHHPGHQEDVRVEHWTNAAEQAACVAHNISHPNELRSYAPTEYVWSDQYDWKIQIAGRPHRAVLDRIVGDLDAERPQGAAVFGDQSGILTAAVTVNWPKALMMCRRMIGAGTTVADCLSEVESLPRLTAAPAAGG

SEQ ID NO: 43192 - protein, 243 aa, Triticum aestivum
  misc_feature (95)..(95): Xaa can be any naturally occurring amino acid
  misc_feature (193)..(193): Xaa can be any naturally occurring amino acid
  unsure (1)..(243): unsure at all Xaa locations
MTLGPFLGAPFRPSLDQKSQVGTVPGIPRDFVDPRVRDWSTRTLTWTGPSRKAKLAIASPPSNSRTPPWPQPVMASSATTVAPFQGLKSTAGLPXSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTXATQVLNEVEEVKKEYPDAYVRVIGFDNMRQVQCVSFIAFRPPGCEESGKA

SEQ ID NO: 43193 - protein, 215 aa, Oryza sativa (japonica cultivar-group)
MDKAGGNQGGKVLKKGKKKHAKDELDRQKQAEKKRRRLEKALANSAAIISELEKKRQQKREEQQRLDDEGAAIAEAVALHVLIDEDSEEPCHLMLNNLRICNHWEDFVGFGFAPDSQGVDAYPSGKPTSVSHAYVPQLRWTNWGMSQTFSSWEQLTDCEAPLYQEALAQSDIHPGPIAIVSPLQKRREDPFTIQGEAVAAASSATESESGQWNQQ

SEQ ID NO: 43194 - protein, 483 aa, Alkalilimnicola ehrlichei MLHE-1
MFESPLLSNLHGYIDGSWTPADSGERFPVHNPVNGDELGRVAAMGAEETRRAIDAAHAALRRGSELEERQAWLDGIVDALKAHKSELGRVLTMEHGKPLKEAQGEVLYAAGFFEFCAKNVYSLGPRTLPERPREATWTIHNRPAGVVGLVTPWNFPIGMIAKKLSAAIAAGCPSVIKPSSKTPLTMLALFTLMEREVDLPPGFVNLVTGPSGPIGDTLMADDRVRVVSFTGSTEVGRKLITASAPGVKKLALELGGNAPFIVFADTDLDRAADHLIANKFRGGGQTCVCANRILVEASVEESFADKVAERAARLKVGDGMAPDTDLGPLIDRNGYEKVRRHFNNALEQGATAVLGEDPGPIPNDWGGFFPPAVLRGVKPGMDCTREETFGPLVPIMPFRDEAQALEMANDTEFGLAAYLFTADEARAQRLIAGLEFAHVGHNTGTGPTPEAPFGGMKCSGWGREGGTEGLFEFVEPQTVPRGN

SEQ ID NO: 43195 - protein, 138 aa, Brassica napus
IVRSVSVSMAAEGVRVEQRHGKARVRVGRVWRQGGDGSHHFVEWNVSISLLSHCLSSYHRDDNSDIVATDTMKNTVYVKAKECGDRLSVEEFAILLGNHFSSFYPQVYTAIVNIIEKPWERVCIDGKPHLHGFKLGSE

SEQ ID NO: 43196 - protein, 417 aa, Alkalilimnicola ehrlichei MLHE-1
MGRRSPVIRSRCIGGSGMVADPVELEYSETPEPMWNPALRALPIPGIRRMVNMAAEMDDVIHLSIGQPDFPVPDHVIEAHIDALRHGQTGYTMDAGLPELLETIAEYYADRYQRPIAPENVLVTTGATEAIYLALAATAAPGRQFLVPDPSFPLYAPLIRMNGGEVKAIPTRAENGHQLDPQEVIDNIGMRTFGIILNSPSNPTGTVYPRETVEAIVQEAAYRGVYVYSDEVYDHLLLDDLQYASVLNCTSDLDHVMMMSSFSKTYSMSGLRIGWIISSQGAIKKLRRFHIFTTTVANTPAQWAGVAALRGEKTCLDSMVAEYRRRRDRVVQLVSDAPHLTGYWPQGAFYIFPSLPPNTDATTVAIRMLQETGVCVVPGDAFGDSCPNSLRISFSASMDDIEEAFERVIPWLAKQRF

SEQ ID NO: 43197 - protein, 407 aa, Arabidopsis thaliana
MTMMSDLSEDLVEEILCRVSITSLGAVRSTCKGWYVLSKTRVLCKAETKHQFLGFMKKNYKLCSMRFDLHGNFNEEGGEEFMNPSIKKSGNLLDQLDICKVFQCDGLLLCVTKEENTRLVVWNPYSGQIRWIKCNNSYHRYEGYAIGYNNNRKHKILRFSDMSFSTYKIYDFISNSWRVLDIAPNWHINPDQRGASLKGNTYFFAREKREDEEDEDILWQPVEYLLCFDFTTENFGQLHPLPFEQYIDDAGALSSFGEEKLAALFQSFASSVVEIWVTSMIEANAVSWIPFLKVDMKPHCSFRFRLPFDGGSFFIDEEKKVAVVIHVDVVAESEMNRYEDVAYIIGENGYVKKVCLVEAVNQGGSLNLSKRSCCNYPHVCCSSYVPSLAQINQSVEFENEREEEEAN

SEQ ID NO: 43198 - protein, 231 aa, Trichodesmium erythraeum IMS101
MTLKAVLFDFNGVIINDDFLHEKLIAQLLLEENLLLKAGEYQKFCLGRSDKAGLEDLLIHRGRYVKQEYLERLIKRKTLSYQQQLESLEKLPIYSDTIDFISQLSQTDLKIALVTGAVRADVELVLNKANLVDFFKVTITGDDIKASKPEPDCYLLAVDILNQQYIDINLKPSECLVIENTFPGIKAAKLAGMPVVAVAHTYPFHMLQRLANWCVDYLSDLELDRIQKVYQ

SEQ ID NO: 43199 - protein, 218 aa, Oryza sativa (japonica cultivar-group)
TARLGSFRVLTNKAVEANDGKPLPLFQKAGIGLTAGAIGACVGIPADLALIRMQADSTLPPAQSRNYKNAFHALYRIAADEGVLPLWKGAGPTVVRAMSLNMGMLASYDQSVELFRDTLGAGEFTTVLGASAVSGLCASACILPFDYVKTQIPKMQPDASGKYPYTGSLDCAMKTLKSGRPFKFNTGFPVYCVRIAPHAMMNWIFLNEIQKLEKGLGL

SEQ ID NO: 43200 - protein, 454 aa, Zea mays
  misc_feature (56)..(56): Xaa can be any naturally occurring amino acid
  misc_feature (75)..(75): Xaa can be any naturally occurring amino acid
  misc_feature (111)..(111): Xaa can be any naturally occurring amino acid
  misc_feature (123)..(123): Xaa can be any naturally occurring amino acid
  misc_feature (147)..(147): Xaa can be any naturally occurring amino acid
  unsure (1)..(454): unsure at all Xaa locations
MALVQFNGALVPQLGEKPRLLSSSPAIAKATYSDARFLTPKTGSRGRGKQLLSPSXSLHSQTSSEQLNHVPSSRXFRQKRGSRFYRFRAEADFYSVLGVSRNASKSEIKSXAYRKLARSYHPXDVNKDPGAEQKFKDISNAYEVLSXDDEKRSIYDKYGEAGLKGAGMGTGDYSNPFDLFESLFEGFGGMGGKGWGCRAARNRPMQGDDESYNLVLNFKEAVFGVEKEIEITRLEGCNTCDGSGAKPGTKATTCKTCGGQGQVVSSTRTPLGIFQQVSTCNTCGGTGEFSTPCNTCGGDGRVRRTKRISLKVPAGVDSGSRLRVRSEGNAGRRGGPPGDLYVFIDVLSDPVLKRDGTNILYTCKVSYIDAILGTTVKVPTVDGTVDLKIPSGTQPGTTLVMSKKGVPLLGKSNARGDQLVRVQVEIPKRLSSDEKKLIEELANLNKAQTANSRR

SEQ ID NO: 43201 - protein, 71 aa, Triticum aestivum
  misc_feature (10)..(11): Xaa can be any naturally occurring amino acid
  misc_feature (16)..(17): Xaa can be any naturally occurring amino acid
  misc_feature (23)..(23): Xaa can be any naturally occurring amino acid
  misc_feature (42)..(42): Xaa can be any naturally occurring amino acid
  misc_feature (50)..(50): Xaa can be any naturally occurring amino acid
  misc_feature (62)..(62): Xaa can be any naturally occurring amino acid
  misc_feature (65)..(65): Xaa can be any naturally occurring amino acid
  unsure (1)..(71): unsure at all Xaa locations
AKPNRTCANXXADSVXXDDDEEXGSRKVIKGCSRAASCAGCXKCVCFGCXMCRFTDCGCQTXVDXYRNSKE

SEQ ID NO: 43202 - protein, 141 aa, Heliobacillus mobilis
MERTYLMIKPDAVQRGLIGEIVSRFEKKGFKLVAMKFLRLTKEMAEKHYAEHVGKPFFAGLVEYIISGPVVAMCWEGKDVVTVSREMMGATNPAKAAPGTIRGTFAVDLPLALRRRVLRRFLEPENPGSEKTDAILEQLQQ

SEQ ID NO: 43203 - protein, 666 aa, Flavobacteria bacterium BBFL7
MTETSPQNLTELYQSNLPVDRLIQLYQRMLLPRMIEEKMLILLRQGRISKWFSGIGQEAIAIGVTAAMQKEEYILPMHRNLGVFTSRDIPLWKLFAQWQGKEEGFTKGRDRSFHFGTQDYNIVGMISHLGPQLGVADGIALAQKLKNTGRATAVFTGEGGTSEGDFHEALNVASVWSLPVLFCIENNGYGLSTPTREQYNCDHLADRALGYGMESHIIDGNNIVEVYTKISEILNDIRENPKPVLIEFKTFRRRGHEEASGTKYVPNELLEYWEQRDPLTRFEQYLLEQDIISNEDIESWSTQYKNDINEGLDIAFAKALPESTPQQELADVYAPHDFVEVPSSDYTTNIRLVDAIKDGLDESMDRYDDLVIMGQDVAEYGGVFKITDGFIEKYGRERVRNTPICESAIVEAGMGLSIAGMKAVVEMQFADFVSSGFNPIVNYLAKSYYRWSQRADIVVRMPCGAGVGAGPFHSQTNESWFYTIPGLKIVYPAFPMDAKGLLIASIEDPNPVLFFEHKALYRSVYGDVPQGYYNLPLGKAATVQSGKELSIITYGAGVHWAMSLIDEMQYDIDLIDLRTLSPLDTESIVNSVRKTGKVIVLTEDNLTGSVAADIAGFIGEECFEYLDAPVRRVGSLNTPIPFEKGLENNYLPTSQLKDCVKELLDY

SEQ ID NO: 43204 - protein, 329 aa, Flavobacteria bacterium BBFL7
MHLLTLLSTQFLIMTNIPSVDLADFLSDDPSRKQKFINEIGKAYEDIGFVALKNHFLSDQLVENLYSEVEKFFKLPVETKKGYERPEIGGQRGYVSFGKEHAKGKKEGDLKEFWHFGQEVAPDANIEEDYPENVIVNELPDFNKTGMEAYRMLEKTGIYVLRALALHIGIDEHYFDHWASNGNSILRPIHYPPITSEPDNAVRAGAHGDINLITLLMGASAPGLQVQNRQGEWLDAIAQEDELVINVGDMLQRHTNNKLKSTIHRVVNPPRELWHTSRYSIPFFLHPRSDMKLDCLEECIDENNPKQHDDITAGDFLHQRLVEIGLIKK

SEQ ID NO: 43205 - protein, 104 aa, Zea mays
  misc_feature (54)..(54): Xaa can be any naturally occurring amino acid
  unsure (1)..(104): unsure at all Xaa locations
MSGRGKGGKGLGKGGAKRHRKVLRDNIQGITKPAIRRLARRGGVKRISGLIYEXETRGVLKIFLENVIRDAVTYTEHARRKTVTAMDVVYALKRQGRTLYGFGG

SEQ ID NO: 43206 - protein, 392 aa, Gloeobacter violaceus PCC 7421
MKTAARLDRIPPYLFAEIDRRRDEAVARGVDIINMGIGDPDKPTPPVVLEAMHAAIDDPSTHNYPPYKGTKAYREAAAAWFERRFGVGGFHPDTEVISSIGSKEAIHNTFLAFVDPGDYTLIPDPAYPVYRTSTIFAGGEFFAMPLLPENQLLPDLEAVPETVARKAKLLWLNYPNNPTGAVASLEFFEKVVHFAKKHDILVCHDNAYSEMAYDGYKPPSILQVPGARDVAIEFLSCSKAYNMTGWRVGFVIGNRTGIAGLGQVKTNIDSGVFKAIQQAAIAAFGLDDERLHALMAVYQNRRNIIVEGLRSLGWPLEAPKATLYVWAPIPKSFGSSVEFVGALLDKCGIIVPPGNGYGEHGEGFFRIALTVPDERMREAIGRMEAAGIRFEG

SEQ ID NO: 43207 - protein, 251 aa, Desulfovibrio vulgaris subsp. vulgaris str. Hildenborough
MKKLIAANWKMYKTIDEARATGRELVSAVAGSLPADREVLVCPPFTALHALHDTFKDVEGFAIGGQDVYPATEGAYTGEIAPGMLLDAGCGWVLTGHSERRHILGEDDETVARKTAFSLKAGLRVVLCIGEKLDEREAGRLEDVLAHQLQVGLADVDATYVPQSLVVAYEPVWAIGTGKVAGPAEVVEAHALVRSLLEARYGRDGAAIRILYGGSVKPDNAAELLSLDNVDGLLVGGASLQAVSFSRIILA

SEQ ID NO: 43208 - protein, 417 aa, Oryza sativa (indica cultivar-group)
MHGCALHPAAYRRIFHNPRSTRSHGLVAAASPPLHQPAAACGETHRIIQMHALFAVARDTAFSSSPAADERLPNEHPGGHLWNQSVLSREEEHGSNDDSFRESLVSLLDNTRDYVMAPEVFEGVPVACDYLKGMDSDGMAASAVAAYSLDNNGQHAGVSSIEHGIASSPLLAYQLGKNSAVVQRSIQQQEVGSPMAAFLQQLIPTSVLDQSGIGFGGVCLDGSGLEASFCMRTSPDVSSFSGHRSATAEELMSTDTREQEITRLARSCSSSGSDRNKKKLSEVRGGKAKKFKSETSHSTSSPKHQSPKVKLGEKITALQQIVSPFGKTDTASVLLETITYIKFLHEQIQLFSQPYMTNSTNKGHIHWGGEGKRKAGLEHDLRGRGLCLVPVSWTSQEYCDSILPECWAPAYRNYFYR

SEQ ID NO: 43209 - protein, 337 aa, Thermobifida fusca YX
MPTTAREFHLIARPQGEPAVTDFALVTRTLPDPGPGELLVRNLVLSVDPYMRGKMSGVRTYTDPYELNAPMEGGAVGVVEASTDPAVPTGTLVVHNAGWRSHALLPASRVRPLPADSPVDPSVYLGALGMPGLTAYVGLRHKAGIREGDTVFVSGAAGAVGSMVGQLAALYGARRVIGSAGSPEKVAYLRDELGFDAAFDYRAAPVREQLADAAPDGIDVYFDNVGGDHLEAAIACANDFARFAICGAISGYNATSAPRAPRNLFQIVTKRLTLRGFIVSDEPHLAEEFQREVAPAVADGRIKVRETVVEGLERTPEAFISMLRGGNIGKMVVRVAE

SEQ ID NO: 43210 - protein, 468 aa, Photobacterium profundum SS9
MTEGITMKLLYTLNERPPHGLTFLLALQHMLASIGGIVAVPLIVGTSIGLPVDEVVTLINAALLASGIVTIAQCVGIGPVGIRLPVVMGSSFAFLGVAISIGKEGGVSSIMGASLVGSFVVILASFYMDKIRKLFPTVVSGVVVTLIGLTILPVAMNWVGDAPAVSEEFATLPKLFLAMISLAIVIAVSVYCKGAIAASAIVIGLAGGYIVALSMGMVNLEQVASAEWISGPEPFKYGFTFSFGAIISMSLVYIVVIAEATGDFMALGSNCHAKVTGRDLKRGLLGDGLGSTLSAILTAMPLASFSQNVGIVGITGVASRYVVAGTGGLLILGGLFPKLAALAVTIPKPVLGGVGFVMFGMIAYAGIRMLIKAADTKRNALVICVGLASGLAVTFEPRLIQHLPHDIANFFHSGITTGTIITVLLHQILPESSAKEELEDNEVYEEVRLSPDSDLDEEAEPLATQKNS

SEQ ID NO: 43211 - protein, 421 aa, Ostreococcus tauri
AMTSAKPARAPRASDEDVRELRRAVFETDASTNARGAGDAIKSKDAAIEALAEALASRDDAMAFKELFTELRPSFEKAPKAKTAKIVRGLIEIMGKIRGHDALQVELCEEHVEWARRERRTFLRHRVELRLATLHLGMRDYPEALRVIGGLAREVKKLDDKLLLVDIHLLESRIHYALRNLPKSKASLTAARTNANAIYVPPSVQCQIDMQSGILHADEKDYKTAYSYFFEAFEQLNSLDEKETAVTALKYMLMCKIMCGQAEDIGALIASKGGLQHQGEALDAMKAVAEAYKARSLKDLQSVLRGYDSQLGNDPIIAAHLGSLQDSLMEENLKRLIEPFSRVEIAHIASLIELPLPEVEMKLSQMILDRKFEGILDQGTGCLIVYDDPSPETTYKASIDCLVEVGKVVDSLAAKSSKIVA

SEQ ID NO: 43212 - protein, 393 aa, Arabidopsis thaliana
MNFQVEPPEKKKTKNSSPPHSPPSSSSPSLSLLPEEIVVHCLARISRLYYPTLSLVSKSFRSILSSTELYATRSHLGSTEQCVYLCLWDPSYQFPQWLRLLVNPNRTLANSIIKKRRKKKKTTGQMLVPLTSSKFTSVSKATVVVGSEIYVLGGPVDSAVRVLDCCSHTWRDAPSMNVSRMNAWACFHDGKIYVMGGCQGLKDEPWAEVFNTKTQTWEGLPEPGSEVRKCSIDRSGVIEGKIEFGNVNEMCAYDTKLCKWEYCVNKSAALRSECMIENVSYGFWNMRLLWYDNDIQKDYWKRLEGLESLDDKYMRNGGSSGNTTKLVACGGKLLLLWEGYMKHNPNNRKKIWCAVIAIEKCDGGGVWGIVESVDVLYTVPISCQLLHCLVVSV

SEQ ID NO: 43213 - protein, 370 aa, Rhodopseudomonas palustris CGA009
MATHKLLLLPGDGIGTEVMAEVSRLIDWLNKAGIASFETEHGLVGGAAYDADKVAITDATMALAQASDAVIFGAVGGPKWDGVPYDARPEAGLLRLRKDLGLFANLRPAVCYPALADSSSLKRDVVEGLDIMIVRELTGGVYFGEPKTITDLGNGQKRAVDTQVYDTYEIERIGRVAFDLARKRRNKVTSMEKRNVMKTGVLWNEVITAVHDREYKDVQLDHQLADSGGMNLVKWPKQFDVIVTDNLFGDMLSDIAAMLTGSLGMLPSASLGEVDAKTGKRKSMYEPVHGSAPDIAGKGMANPVAMLASFGMALRYSLDMGALADKLDEAIAAVLAKGLRTADIKSEGTTVISTSQMGEAIVTELQALHA

SEQ ID NO: 43214 - protein, 117 aa, Alkalilimnicola ehrlichei MLHE-1
MNIIEQLDKEQMAAREAKIPEFGPGDTVTVQVWVKEGGRERLQAFEGVVIAKRNRGINSAFTVRKVSHGEGVERVFQTYSPIIESVKVKRRGDVRRAKLYYLRERSGKSARIKEKVK

SEQ ID NO: 43215 - protein, 328 aa, Oryza sativa (japonica cultivar-group)
MASDRRVCTVHHMSHAAIVLVSVLLLCSAHPSAGARRLMELYKPPPSEQLTYHNGTVLRGDIPVSVVWYGRFTPAQKAVVSDFLLLLTVASPAPTPSVSQWWNTINQLYLSKAAAQGKNGGGGGKITTQVRLAGQLTDDQCSLGKSLKLSQLPALAARAKPKKGGIALVLTAQDVSVEGFCMSRCGTHASNAKARTAYVWVGNSATQCPGQCAWPFHQPVYGPQTPALVPPSGDVGMDGMVMNIASMVAGVVTNPFGDGFYQGPKEAPLEAATACPGVYGSGAYPGYAGNLAVDPATGASYNANGAHGRKYLLPALFDPATSTCSTLV

SEQ ID NO: 43216 - protein, 445 aa, Bifidobacterium longum DJO10A
MDKQQEFALRTVEERDVRFIRLWFTDVLGTLKSVAIAPAELEAAFEEGLGFDGSAIEGMTRVSEDDMIVQPDPSTFQILPWRGGPQGTARMFCDILTPDGEPSLGDPRHVLKRTLAKAKDKGFTFYVHPEIEFYLFESQDDWSKAPTPIDEGGYFDHVPRSPGMDFRRATVNMLEQMGISVEYSHHEAGPGQNEIDLRYADALTMADNIMTFRTVVKEISLERGIHASFMPKPLADAPGSGMHTHLSLFEGDSNAFYEAGQEFNMSLTARQFAAGILYHAAEICAVTDQYVNSYKRLWGGNEAPSYICWGHNNRSALLRIPQYKPGKGNSARMEFRALDPVANPYLAYSVLLAAGLDGIDKQMQLGEPTSDDVWELTDGERQAMGIQPLPRSLDEALKIMEKSDFVADVLGEHAFGYFLDNKHQEWEEYNQQVTPYELKKYLPKL

SEQ ID NO: 43217 - protein, 400 aa, Arabidopsis thaliana
MKRQAKPPEKKTKRTTNASSPTPSSSSPSLSSLPDEIVENCLARISRSYYPTLSIVSKSFRSIISSTELYVARSHLRNTEECVYVCLSDKSFEFPKWFTLWVNPNQANSMVEKKRKKKKTIGKLLVPIPSSNLSPVSKSAIAVGSEIYVIGGKVDGALSSAVRILDCRSNTWRDAPSMTVARKRPFICLYDGKIYVIGGYNKLSESEPWAEVFDIKTQTWECLSDPGTEIRNCTIYRIAEIEGKIHFGYTQKTYAYDPKQGEWECCEGEVAFPRSQCVMESVLYTFANNYTWEDDYGCKWWSTDGYGEKVKGLESLLEIHKRNGGSSDNTTKLVACGGKLLLLWEGYMKHNPNNRKKIWCAVIALEKRDGGKVWGIVEWVDVVHIVPTSCKLLHCLVVSV

SEQ ID NO: 43218 - protein, 214 aa, Rhodopseudomonas palustris CGA009
MTSFPKSLIDGYEAFRTQRLPTEQSRFRELSERGQSPEVMVIGCCDSRVSPEVIFDAGPGEIFVVRNVANLVPVYEPDGGAHGVSAALEFAVQVLRVKHIVVLGHALCGGIKAFTDKTPPLTESDFIGRWMQMFTKPGEVVEKRDHETVQDFRTRIEKAAVFRSIENLMTFPCIKILVERGKLQLHGAYFGVADGDLFVLDQENKQFVPAAEVV

SEQ ID NO: 43219 - protein, 410 aa, Oryza sativa (japonica cultivar-group)
TNGLRGRGSDTMFKRDAPSTDMISGLPEGVLHRIMSFLTLREAVQTCVLSRRWRNLWLSMPLINADYKQFFEMTDTKAGYDEALAVAVPMFKRFVNRLLELRDPVASIDKFCLWYSISDDNEDDTESQDAAANRWISQALQKKARVVEVYGDLVFADLYPLVIDHSVFTSSYLTKVVFSSVLLEDGFFKQLESGCPALEDLSLDDCVISGDEISSQTLKVLTIKDTKFSMEHKTSINTPSVTSLTLWRPAHGIVVLKDMASVVTASVKPSEFIDEFDARGLRQYLWALSGVKNLEFYYLGELTIEGNLQLCPKFNNLVNLTLGRWCLDANFYALILFMQNTPRLEKLTLKLHPFRYQQQRIIGELTERSFTCGHLKIVEVICSENDPLINHLVDFFVSSGMTTAQIHIKH

SEQ ID NO: 43220 - protein, 458 aa, Oryza sativa (japonica cultivar-group)
MEEPPGKKGPAMDPAQDSGRDWLSGLPEGVLHRIMSFLDSRQAVRTCVLSRRWRDLWRSVPRVHADICDLIPDRIIDVEGEKAKMVVFNSFVNRLLERRDPTASIETFFCRCCIPDEDGHGSADANRWISYGLQKNAWFLEVVMLLKPLELDPSVFSSIYLRRIAFDNVFMDQGFFKQLQMGCPALERFDLDGCIVADDEISSNTLKVLTFDTTKFCYEYRISISTPTVTTLGLRNTIGGKPVLKDVASLVSASVVLYCVETSDFDANDLRHYLWSFSHVKDLIFSYQGKKLTIENNLQWCPKFFNLVGLTLGKWCLNANFYALIVFLQNSPRLEKLTLILAEDNWKTTEVFIGDLEERSFTCEHLTSVEVKCWEDDPLVNVVDFFVGSGMSSAQIHIEYEDNDEDQFHIESDNMVGFELEDEDEDEDEDEDEDEDEDDEDEDGDEDEQRSLFQSKDV

SEQ ID NO: 43221 - protein, 918 aa, Kineococcus radiotolerans SRS30216
MARRDEAGNAPAGKGPILDGLLSQLPDIDPEETAEWLASLDGLVDERGSTRARYLVLQLLQRARERQVGVPSLTTTDYVNTIGPESEPTFPGDEEVERRYRAWIRWNAAVMVHRAQQPGIGVGGHISTYASSATLYEVGFNHFFRGKDHAGGGDQVFIQGHASPGVYARAFLEGRLSEEQLDGFRQEVSKAPNGLSSYPHPRLMPDFWEFPTVSMGLGPANAIYQAQFNRYLHDRGFKDTSQQHVWAYLGDGEMDEPESRGFAQLAAYEGLDNLTFVVNCNLQRLDGPVRGNGKIVQELESFFRGAGWNVIKVLWGREWDTLLAADHQGALVDLMNATPDGDYQTFKAENGAFVKENFFGRDPRTAKLVEGMSDDEVWNLKRGGHDYRKVHAAYQAAVNHTGQPTVILAKTIKGYGLGPHFAGRNATHQMKKLTLEDLKLLRDSLRIPISDEQLEKDPYRPPYFHPGEGDEAIQYLRKRRTDLGGPVPQRRVQHAPLHLPGEDSYKIAAKGSGKQEIATTMAFVRLLKDLMRDKEFGKRVVPIIPDEARTFGMDSLFPTIKIYNPHGQNYTSVDRELMLAYKEATDGQILHVGINEGGSIAAFTAAGSSYATHGQPMVPIYVFYSMFGFQRTGDNIWAASDTMARGFMIGATAGRTTLTGEGLQHADGHSLLLAATNPAVVSYDPAYAYEIGHIVKDGLRRMYGEDPENVIYYLTVYNEPMVMPAEPADVDVEGILRGMHRISVGEGDGPRTQLLASGVGVPWALEAQQLLKDDFGVVADVWSVTSWNELRRDGLACDEHAFLNPGEEARVPYVAQKLGGTTGPVVAVSDWMRQVPDQIAQWVPGEFASLGADGFGLSDTRAAARRYFHIDGPSVAVRALEMLAKRGEVDWRAPGQAIEKYRLHDVRAGRSGNAGGES

SEQ ID NO: 43222 - protein, 351 aa, Oryza sativa (japonica cultivar-group)
MEGRPGRRRRRRVKAPTRAAGMDWISGLPDEILHHIMSFLNARQAVQTCVLSRRWSDLWRTVPCINADFNEFDFIDYQGDDEDYNDEVAFKRFVNRMLELRDPATMMDKFWLKYKISDGYNEYKDSNVDANRWISHALQKQARVMEVVVFSFPLELDHSVFTSCYLRKIGFSCVSLHQGFFKQLDAGCPELEELFLHDCTIADEEIFSQSLKVLTIDDTEFSKANKAYISIPSVTSLTLSSPENSTPMLKDMALLTTTSVSVKFYTFSYGFDANDLRQCLWSLSGVTNLELNYEGTELTFENNLQWCPEFINVVNLTLGQWCLDANFYALIVFLQNSARLEKLTLNLAKDR

SEQ ID NO: 43223 - protein, 182 aa, Brassica napus
  misc_feature (146)..(146): Xaa can be any naturally occurring amino acid
  misc_feature (159)..(159): Xaa can be any naturally occurring amino acid
  misc_feature (174)..(174): Xaa can be any naturally occurring amino acid
  misc_feature (178)..(178): Xaa can be any naturally occurring amino acid
  misc_feature (181)..(181): Xaa can be any naturally occurring amino acid
  unsure (1)..(182): unsure at all Xaa locations
MASLSFVSSSHLTLRAPSPNLRSSSPRPTSVSFSVKAQSVALSQDDLKKLAAEKAVESIKPGMVLGLGTGSTAAFAVDQIGKLLSSGQLHDIVGIPTSKRTEDQARSLGIPLVALDTHPRIDLAIDGADEVDPNLDLVKGRGGALXLRREEMVEAVAEXFIVVADDTKLVKGLXGGSXLAXP

SEQ ID NO: 43224 - protein, 290 aa, Arabidopsis thaliana
MSGGLDMSLDDIIKSNRKPTGSRGRGGIGGGNNTGGRGGSGSNSGPSRRFANRVGARTAPYSRPIQQQQAHDAMWQNDVFATDASVAAAFGHHQTAVVGGGSSIETGTKLYISNLDYGVSNEDIKELFSEVGDLKRYGIHYDRSGRSKGTAEVVFSRRGDALAAVKRYNNVQLDGKLMKIEIVGTNLSAPALPILATAQIPFPTNGILGNFNENFNGNFNGNFNGNFRGRGGFMGRPRGGGFGGGNFRGGRGARGRGGRGSGGRGRDENVSAEDLDAELDKYHKEAMETS

SEQ ID NO: 43225 - protein, 480 aa, Azoarcus sp. EbN1
MKEYKLFIDGEWVGSSTETILDDLNPATSEVWGRVHQASAADLERAIAAAYRARESWGNTLANEREAILLRAADALQKRIPDVAAVLIDEAGSTYGKAMFEASFVVNLLRSAAGECRRITGETMPSDSPGVFSMSVRRPLGVIAGIAPFNFPFLLATKKVALALAAGNTFILKPASYTPVTGLKIAEIFEAAGLPKGVLNVVPVQGSVLGNTFVADPRVRMITFTGSTEVGRELSAEAGRHFKRITLELGGKSPMIVLKDADVDYAVNAAAFGIFLHQGQVCMANSRLIVEAPIFDVFCDKLATKIAGFKVGDPRDPQTVIGPLIDRKQCAVLDRHVADAVAKGAKLLHGGKSDGAFYQPTILAGVTPDMVVFREESFGPAVSVIRAADSEDALRLANDSCYGLSSGLITNDLQKAFDLSLRLEAGMVHINDSSIMDEPHVPFGGVKDSGFGREGGHHSMDEMTELKWITVQMGQRQFPF

SEQ ID NO: 43226 - protein, 564 aa, Thermobifida fusca YX
MPSAPTPTGRPARKTTRPRRGEGQWALGYREPLNKNEEIKKNDDGLNVRKRIIDIYSKQGFDSIDPADLRGRFRWYGLYTQRAPGIDGGKTAVLEPEELDDRYFMMRVRTDGGQLNVAQLRVLAEVSTAYGRDTADITDRQNIQMHWVRIEDVPTIWERLESVGLTTTEACGDTPRGLLGCPLAGIAEDEIIDATPQLRQIVADHIGSPLFSNLPRKFKTAIDGCAVHCTNYEVNDVAFVGVIGPDGTPGYDLFVGGGLSTNPMFAQRLGAFVRPEQVSEVWAGVCSVFRDYGYRRLRHRARIKFLIKDWGPQKFREVLEKEYLGYSLPDGPEPVLDPGTRRDHVGIHRQKDGRFFVGFAPRVGRVSGTILGRIADIAEAHGSNRVRTTADQKLAILDITEDRLDSVVAALEAEDLQVNPSVFRRQTMACTGIEYCKLAIVETKNRAMALIDELERRLPDFTEPLTINVNGCPNACARTQIADIGLKGQLVTDAHGNQVEGFQIHLGGGLGLQAGFGRKVRGLKTTAAELPDYIERVVRRFAEQRQAEETFAEWVARADEADLK

SEQ ID NO: 43227 - protein, 260 aa, Camellia sinensis
MATSTPREESVYMAKLAEQAERYEEMVEFMEKVSSTVVESEELTVEERNLLSVAYKNVIGARRASWRIISSIEQKEESRGNADHVSTIKDYRSKIENELSSICDGILKLLDTKLIPSATAGDSKVFYLKMKGDYHRYLAEFKTGSERKEAAENTLNAYKAAQDIANTELAPTHPIRLGLALNFSVFYYEILNSPDRACSLAKQAFDEAIAELDTLVEDSYKDSTLIMQLLRDNLTLRTSDTQDDGAEEIKEAPKHEEEKQ

SEQ ID NO: 43228 - protein, 99 aa, Taxus cuspidata
SILGQCCEMPIGYVQIPVGVAGPLLLNGFEYMVPMATTEGCLVASTNRGCKAIHMCGGATSILLRDGMTRAPVVRFQSAKRAADLKYYIEDPTNAENLS

SEQ ID NO: 43229 - protein, 101 aa, Bartonella quintana str. Toulouse
MIARIYSPAKTAMQSGRGNTGFWILQYEPIQAKMLEPLMGYTATSDMNNQVRIRFNRKEEAIAFARKNAIPYRVEKTHRPIRRAVSYSDNFRSDRQQSWTH

SEQ ID NO: 43230 - protein, 129 aa, Rhodopseudomonas palustris CGA009
MNLIQTLEKEQFDKLSAGKTIPEFGPGDTVIVNVKVVEGERSRVQAYEGVCIGRSGGGINESFTVRKISYGEGVERVFPLLSPMIDSIKVVRRGKVRRAKLYYLRNLRGKSARIVEKKQDRTAAVAAAE

SEQ ID NO: 43231 - protein, 502 aa, Oryza sativa (japonica cultivar-group)
LELWRENEASPLYFGAGNTKRLFVFLLFTAQTPRDEHQTNRAGFHARHLFDERRLSGCSAAMEEPPGKKGPAMDPAQDSGRDWLSGLPEGVLHRIMSFLDSRQAVRTCVLSRRWRDLWRSIPRVHADIYDFTPDGTIDGEGEEDVEEAEVVVVFNRFVNRLLERRDPTASIETFFFRCCIPDEDDDGSADANRWISYGLQKNAWFLEVVVQLNSLELDRSVFNSIYLRRIAFGNVFMDQGFFKQLQIGCPALERLYLDDCIVADDEISSNTLKVLTFDTTEFCYEHRISISIPTVTTLALRNTICGKPVLKDVASLVSASVVLYCVESGNFDAYDLRHYLWSFSHVKDLIFSYQGRKLTIENNLQWCPKFFNLVGLTLGKWCLNANFYALIVFLQNSPRLEKLTLILAEDNCKTSEVFIGELEEKSFTCEHLTSVEMKCWEDDPLVINVVDFFVGSGMSSSQIHIEYEDDDEDQFHIESDDMFGFEFEYEDEDEDEDEDEDE

SEQ ID NO: 43232 - protein, 673 aa, Methanocaldococcus jannaschii DSM 2661
  misc_feature (131)..(131): Xaa can be any naturally occurring amino acid
  unsure (1)..(673): unsure at all Xaa locations
MEFKIVNTICPYCGVGCGLGLVVKDGRVIGIHPNKRHPINEGKLCAKGNYCYQFIHSKDRLTKPLIKKESGFVETTWNKALEVIAENLKTYKDEIGFFSSARCTNEDNYILQKFARVALKTNNIDHCARLXHSATVTGMSACFGSGAMTNSIEDIELADCILIIGSNTFEQHPLIARRIMRAKDKGAKIIVIDPRRTITAKNSDIYLQIIPGTNVALINAMINVIIKENLIDKEFIKNRTEGFEKLKEIIKKYTPEYASKICGVDKELIIESAKIYGNAERASIIYCMGVTQFTHGVDAVKALCNLAMITGNIGKEGTGVNPLRGQNNVQGACDMGALPNVFPGYQKVEDGYKLFEEYWKTDLNPNSGLTIPEMIDESGKNIKFLYIMGENPIVSDPDVKHVEKALKSLDFLVVQDIFLTETAKLADVVLPAACWAEKDGTFTNTERRVQLIRKAVNPPGEALEDWIIIKKLAEKLGYGDKFNYNKVEDIFNEIRKVTPQYRGITYKRLKIDGIHWPCLDENHSGTKILHKDKFLTDNGRGKIFPVEYREVAELPDKDYPFILTTGRIIFHYHTGTMTRRCKNLVEEINEPFIEINPDDAKSLKIENGDLVKVISRRGEITAKARITEDIKKGVVFMPFHFVEANPNVLTNTALDELCKIPELKVCAVKIERI

SEQ ID NO: 43233 - protein, 308 aa, Oryza sativa (japonica cultivar-group)
MSQPAELSREENVYMAKLAEQAERYEEMVEFMEKVAKTVDSEELTVEERNLLSVAYKNVIGARRASWRIISSIEQKEESRGNEDRCTLIKEYRGKIETELSKICDGILKLLDSHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEALPIYVVLGNLAADSLLGWWILELHFLWGEPQGGTFMSLIGSIVFGMSVVSLISRVHSPAKCPA

SEQ ID NO: 43234 - protein, 1092 aa, Zymomonas mobilis
MPKRTDLQSIMIIGAGPIVIGQACEFDYSGTQACKALREEGYRVILVNSNPATIMTDPDMADATYIEPITPEVVARIIEKERPDALLPTMGGQTALNTALALASDGTLEKFNCEMIGADATAIDKAEDRLKFRQAMDKIGLESPRSSVAHSLEEALDGLDYVLPAIIRPSFTMGGTGGGVAYNKEEFIDIVSGGLSASPTQEVLIEESVIGWKEYEMEVVRDRHDNCIIICSIENIDPMGVHTGDSITVAPALTMTDKEYQIMRNASIAVLREIGVETGGSNVQFALNPENGRLVVIEMNPRVSRSSALASKATGFPIAKVATKLAIGYTLDEITNDITGATPASFEPTIDYVVTKIPRFAFEKFKNAKPLLTTAMKSVGEVMAIGRSFPESLQKALRGLENGLSGLDPVEALVGANPSVIEAELARPTPDRLLVAAQALREGLPAEKICEITHYDPWFIARLAEIIAAENEVISNGLPLEAAAFRRLKAMGFSDKRLADLALQSAHLRGLGKAQAKGSGIVHDALQAMTGGVTEAEVRTLRHSLNIRPVFKRIDSARLNLKPKRLICIPLMKRLSLVNLFAILCQAIRKKVVILGGGPNRIGQGLEFDYCCCHACFALEAAGYETIMVNCNPETVSTDYDTSDRLYFEPLTGEDVLEILHTEQKNGTLVGVIVQFGGQTPLKLAAEIEKAGIPILGTSPDAIDLAEDRERFSALVSELGLLQPANGIARSRDEAISVADKIGYPILIRPSYVLGGRAMEIIDGPSQLDDYIHTAVKVSGESPVLIDQYLRDATEVDVDAVADGDDVVVAGILQHIEEAGIHSGDSACSIPPYSLPASIIEEIKSQTDKLARALKVQGLMNIQFAVKGDKVYLIEVNPRASRTVPFVAKADGRPVAQVAARVMAGEKLRNLPEISWPEGYTAVKEAVFPWARFPGVDIDFPMAFAKAQLAAGNALPRAGTFFISVKDSDKAQIVEPIKALTDLGIKLVATDGTARYLQSKGVPVERVNKVREGRPHIVDLIKDGAISLVVNTTEGWQSLQDSASIRSSVVLAPVPYFTTAAAAIVAAEAIVAIKARELEVRSLQSYHSMKHA

SEQ ID NO: 43235 - protein, 908 aa, Prochlorococcus marinus str. MIT 9312
MLNLEEYFPFPLDDFQLEAIQAINSGNSLVLTAPTGSGKTLIGEFAIYRGLSHDSRVFYTTPLKALSNQKFRDFASQYGENKVGLLTGDISINREAPILVMTTEIFRNMLYGEFDEFDDPLENLESVILDECHYMNDPQRGTVWEETIIHCPSRTQIIALSATIANADQLQNWIEKVHGPTVLINSDKRPVPLDFIFCSVKGLHPLLNNKGNGIHPNCKIWRAPKGQKKRGKVGRIMQPKSPSIGFLISKLAERNMLPAIYFIFSRRGCDKAIENIKDLTLVSYSEANMISQKLDLYLKNNQEAIKDKSQCEALKRGIASHHAGLLPAWKELVEELFQQGLIKVVFATETLAAGINMPARTTVISSLSKRTEDGHRLLFSSEFLQMSGRAGRRGKDTQGYVVTLQTRFEGAKEASALAISKPNSLESQFTPSYGMVLNLLQSYTLEKSKELIKRSFGSFLYLDESSGDNAILENLDKDLIELKKITSNVSWNDFDAYEKLKNRLKEERRLLKILEKQAAEKLSEEITNALPYIKDGSLISIKAPQIKRKIVPGLICKKIYESQKIKSLLCLTIDNLFILIKASYIVSIFNDLDAIDVLGLEAPKMYFSGEVVRGDDMSQCFADRILEVSKKNDLQTPQYDLTTEVLAQRQQINALEEKVTDHTAHRFGDSRKLKKYRKRIVDVEQEINIRKKLLRDKENHNWRTFTDLIQILNHFGCLNDLELTEVGQTVCAIRSENELWIGLVLVSGYLDDLDPPELAAIIQAICVDVRRPNLWCNFKPSLKVLDVFNELDGLRKLVASQQNKFHIEIPIYLEIELTGIISAWARGEKWKDLVFNTSLDEGDVVRIIRRSIDVLSQVQYCIGVSNKLKSKAKLALKAINRFPVSESNDLIKVSEDINPATKRIDNNS

SEQ ID NO: 43236 - protein, 707 aa, Thermobifida fusca YX
MPMVEVWPGHAYPLGATYDGSGTNFSLFSEVATGVELCLFDDDGAETRVPLTEQDGHVWHGYLPTVGPGQRYGYRVHGPYDPERGLRCNPNKLLVDPYAKAIDGQIHWHESLFDYHFADPGRVNNHDSAPYVPTCVVVSPFFDWGAEQHPNIPYHETVIYEAHVRGMTIRHPDVPPPLRGTYAGMAHPAIIEHLLSLGVTAVELMPIHHFLPEHALVARGLTNYWGYNTLAFFAPHSGYAATGTRGHQVQEFKTMVKALHQAGIEVILDVVYNHTAEGDHMGPALSLRGIDNLAYYRVREDNPRYYLDYTGCGNSLNVRHPHSLQLIMDSLRYWVLDMHVDGFRFDLAAALAREFHDVDRLSTFFDIVQQDPVISQVKLIAEPWDVGPGGYQVGNFPPLWTEWNGKYRDTVRDFWRGYPVLPELASRISGSSDLYQADGRRPVASINFVTCHDGFTLADLVSYDRKHNEANGEDNRDGTDDNRSWNHGTEGPTTDSAIATLRRRQMRNMLTTLMLSQGVPMLSHGDEIGRTQHGNNNAYCQDNPISWVDWELARRNADLLDFVRTLSRLRREHPVFRRRRFFQGALPGRGKQRDIAWLRPDGTLMEDADWGRGWRALGVFLNGDAITEPDRMGRRIRDDSFLLLLNAGINDVQFTLPGPSYSAAWETVVDTADPEVAGRPYLPAGSDVTVIDRSFLVLKGVTKALPS

SEQ ID NO: 43237 - protein, 86 aa, Arabidopsis thaliana
  misc_feature (11)..(11): Xaa can be any naturally occurring amino acid
  misc_feature (24)..(24): Xaa can be any naturally occurring amino acid
  misc_feature (40)..(40): Xaa can be any naturally occurring amino acid
  unsure (1)..(86): unsure at all Xaa locations
MGESRKSRATXFDEVDRTVKAVFXAVANLVSELNIQAMNXHQKLSFRAGEREGLEKVYRWIWRQQEGGSRVIARDIVNHIQNELEW

SEQ ID NO: 43238 - protein, 468 aa, Synechocystis sp. PCC 6803
MNPSSSPSQSTANVKFVLLISGVAALGGFLFGFDTAVINGAVAALQKHFQTDSLLTGLSVSLALLGSALGAFGAGPIADRHGRIKTMILAAVLFTLSSIGSGLPFTIWDFIFWRVLGGIGVGAASVIAPAYIAEVSPAHLRGRLGSLQQLAIVSGIFIALLSNWFIALMAGGSAQNPWLFGAAAWRWMFWTELIPALLYGVCAFLIPESPRYLVAQGQGEKAAAILWKVEGGDVPSRIEEIQATVSLDHKPRFSDLLSRRGGLLPIVWIGMGLSALQQFVGINVIFYYSSVLWRSVGFTEEKSLLITVITGFINILTTLVAIAFVDKFGRKPLLLMGSIGMTITLGILSVVFGGATVVNGQPTLTGAAGIIALVTANLYVFSFGFSWGPIVWVLLGEMFNNKIRAAALSVAAGVQWIANFIISTTFPPLLDTVGLGPAYGLYATSAAISIFFIWFFVKETKGKTLEQM

SEQ ID NO: 43239 - protein, 555 aa, Symbiobacterium thermophilum IAM 14863
MSSPYAAKPWLKAYPPQVPPQLVYEDRALYDLLVRAAQRHGDATATVFYGARLTYRQLHEQARRVASGLIRLGVRKGDRVAVMLPNCPQAVIAYYGALMAGAVVVMVNPLYMPRELRHQVDDSGARVMIAIDLAYPKVNQLNLEHVVYTGMQDYMPAPVRWIAPLKLKPPRIAYRKGVLPWASLVGAEPIAEPVPVNPADDLALLQYTGATSGLPKGCMLTHRNLVANVLQTEAWLYRARRGPALVTLAALPFFHVYGMTTLMNFTIHVGGTMVLQPKFEAREAVKLIQKYRPSIFPGAPTMYVALNNLPDVQKYRLDSIEACISGAAPLPVEVQAEFERLTGGRLVEGYGLTEASPVTHANPIWDRRKEGSIGLPWPDTECRIVDPETGEDVPVGEVGELLVRGPQVMKGYWNLPEATAETLRDGWLHTGDMARMDEEGYFYIVDRKKDLIIAGGFNIYPREVEEVLYLHRGVKEAAVVGVPDPYRGETVKAFIVPREGVTLDPEEIKQFCRQHLAAYKIPRIIEFRDELPKSLVGKVLRRVLLEEEQSRKGVV

SEQ ID NO: 43240 - protein, 221 aa, Leuconostoc mesenteroides subsp. mesenteroides ATCC 8293
MTRLVTATEMQQIDNYTIETIGMPQDVLIERAAMAVLDVIGAGRFDLSHVLVLAGLGNNGADGVAIARLLYAQGVNVSLQFVGNVSRAKDSVKRQLAIIEKHGLVRSEKSDFNEATLIIDAIFGVGLNNVLPEGLQKMIKAANHIDKPVIAVDVPTGIDATTGEVRGAALKAHTTVTFGFTKVGLTQQNGCYLSGNVILKDVGMLIPDDFEFSLQETLPVA

SEQ ID NO: 43241 - protein, 122 aa, Glycine max
GTQCIHQLTFTDDPDLENTFIYNLSKDGYVPYHSARIEPCPAASLDFSKRGKIFLEMLNNCLDQIQAHTNDRVVMRCDINFNTSSYGRNLNTLIGRTAHIDFLESDIFAKFIMWSFPDLFRQ

SEQ ID NO: 43242 - protein, 477 aa, Thermobifida fusca YX
MDTTPHTVVVGGGVSGLAVAHRLARSGHRVTVLEAAARPGGKLAVEKVAGVSADVGAEAVLARRPEALSLIDELGLTERVTHPGTVTSQIYSRGKLRDFPEGHVMGVPSDFAALARSGVLSPLGVLRAARDLVWPATPVKADVPVATYIGIRMGRETVDRLVEPLLGGVYAGRADQLSLDATLPQLASAARTQRSLAAIARDTHSRTARPTAEPPPPLFATLRGGLATLIDALAAQPGVTVRTATPARDLRRTEQGWQLAVGDPPAETVDADAVVLACPAPEAARLLRTIAPSAAVELGGVRYASMAVVTLAYPLSAFPAPPTASGFLVPSVEGRTIKAVTFSSVKWPWLAAELRDANPGEEIVLLRCSLGRFGDDAVVDYDDDTLVARATSDLADLCGVSGPPVDSHVTRWNAGLPQYTVGHRDRVARIRSALDGIDGLAVCGAVYNGVGIPACLSSAEEAARRITHTTGGQRSHR

SEQ ID NO: 43243 - protein, 386 aa, Oryza sativa (indica cultivar-group)
MAAQASPPTKKVLVPIVAGTEPVEAAVPIDVLRRAGADVTVASADDGELVVEVMYGVRIVADALVAGGDCAAAHFDLIVLPGGVPGAANLGGCAALEAMVRRHAATGGLYAAICAAPPLALASWGMLNGLKATAHPLFVDKFPPEVAAVDASVVVDASAVTSRGPATSTEFALALVEQLYSKNKAEQIAKEMLVRYDAGYTIDEVNSVQWKCNGTPKVLVPVANGTEEMELITIIDVLRRADADVVVASAENAGVEIVARHGMRIITERLNTFSPRLKQQGGTPGAKTMSSNEKLVTLLKKQAAASKPYGAIGAATAHVLEPHGLLEGKKAADQDGGDECESRVVVDGNVITSGGTGTAMEFAVAAVEKLLGRDVAQRVAEGLLFA

SEQ ID NO: 43244 - protein, 427 aa, Oryza sativa (indica cultivar-group)
MARRAASWPRLLLLSRAFAAAAAEPKRVLVPVADGTEPVEAAATADVLNRAGARVTVATADPAGDDRGLLVEAAFGVKLVADGRVADLEGEAFDLIALPGGMPGSANLRDCKVLEKMVKKQAEQGGLYAAICATPAVTLAHWGLLKGLKATCYPSFMEKFTAEIIPVNSRVVVDRNAVTSQGPATAIEYALALVEQLYGKEKSEEVAGPLYVRPQPGVDYVIDEFNSVEWKCSGTPQEGIPGQGLLSKHKVLVPVANGSEEMEALNLIDILRRAGANVTVASVEDKLQVVTRRHKFNLIADIMVEEAAKREFDLIVMPGGLPGAQKLSSTKVLVDLLKKQAESNKPYGAICASPAYVLEPHGLLKGKKATSFPPMAHLLTDQSACDSRVVVDGNLITSKAPGSATEFALAIVEKLFGREKAVPVTCE

SEQ ID NO: 43245 - protein, 102 aa, Zea mays
MSVEGSKSGPTVLDTMSAQEPFVHIPEETIREALKVVLDVRNQPVLIHCKRGEHRTGCVVGCLRKLQKWCLSSVFDEYLHFAAAKARTTDQRFMELFDAQSL

SEQ ID NO: 43246 - protein, 6222 aa, Ostreococcus tauri
MSVSAKKTLEVDSVTVAEPIAEDDWTWHFLDTGSTADGLLRIACARADGREDLAAAAVEIVDSQRLERSVAFSYMELFDLAVHTATFMRDTLGAEPGHVVGVLSRNSHEVFVLHHACAMARVKLLNLNTHLVARELSYIVRDAGCRFIFARASHADTIQEAMRSHERPDWNAVVWLDSDVNKYPRAVRNFDWELDVASHQSPTRALVVYNRELASVKDAHLYYTSGTTGNPKGVILTHDIVRTHAHATSNEMRLNASDVWLHAAPMFHLVDAFAIYSITEVGGRHVFLPTFEASTLLRVIAFERITVSNLASSMVTILSHNPVAEVCDLSSLRVMSCGGSPLPPTVVARAISLFGCEFFVSYGMTECCGKISMSILTDEFRESSSPESQLDSICTSGRPFSLMSVKITSIDNPNEHVPFDGKTVGDVRVRGPTVFAGYLNDREATRRAFDDDGWFSTGDLGVMRPDGFIVIVDRKKDMILCGGENVYCVEVERVLHAHNLVQQAAVFGVPHPIMGESVHAAVTLRSISDMRDVKALESRIITHCTGFLSQYKCPTEVHIMEKFPMNASGKILKTNLRKIVTDEAYRRHAHDTSTLRRQFFPTVLSRASRCEVRSKDTSEDIRGVESYISVLKPVESRGDDRMTPYGSRWFVVGAMGGLRNSLQSLGVEVRAFDSASIAVTEDWFEHASRYRSLLREAKSGDTVLLAECLASVEDVSLDHVDRSVASATYLSCGLVISLMRAIDSLELTGVRVIVLTSNAFVASDESELEGIPNGRVINAPVIGICRVLRREHPSLDLFTIDIPRDNDMTPEMLKVVFSRMFENDGTLAEREMVINSSSISVPRLVRAKLPLSASNGGSVVIKGASCVIIGGLGALGLLHLKFLSDTYGIRRFILTGRTVRDETIENLRRTANEGSSTVVIDIAAADCCDADQARAVFALAEPVAITMHLAGVLSEGLAVDETRASFVVGTEAKIIGSLNMFRELSKRSSLIAVTSTSIFGLIGQSCLTAYAAANAFQDALCVVSDRLAENGPRRVIAIQWGTWDEDGMAMRSGSIFRTYWISLGMGFLAPRSALEFVSRVIDSSTVAPSIACFPPTDWTRFHDNTRAIGLLPALIEECLLPFEESSSESVSSDCRSDAPLLSLGNVSVVRSVVLDMLGEKHIDDDAPLMSVGLTSARAIQLAHKLATALGIDVPTTLAFDHPTLRLISKHFSSRSMETVPINEPVVNERKYERVFLVASAGCAPDSADHGIFPIGGDAVRSVPKTRWDTCDVNNQGALLCGFGAFVHNAAMFDSTLFNVSIAEACIIDPQQRLVLHSVASLPKFGSNVSVHVGVSQVEYPRMHFIARSEALSPYYATSAHLSVASGRIAYVFALTGCAESIDTACSSSLVAIARGYVSRESAVAGGVNLTLDVTWSLACNAANMLSADGRCKTLDCSADGYVRAEHASMMLIAVRVEADVIVAGVAVNQDGRSSTLTAPNGPSQTRAIITAYGNDCDVEVVSMHGTGTALGDPIEVSALRNAVRSEVVTRVLANKSLMGHAEPASGVSSLLLAADAIQLESSVAMTHVRSINPYLTSCDAELMLAIPRQRVAMSMERSASASAFAFMGTNAHCVVRLNVYPGKTVAVSSITPIHDQASRWCTRASHAWIKTGGIAPWGGRVMYTATIIGVPSSASLLDHAIHGEPIAPGTSLIELFLESFTQSVSDGGHHGRDIVVPHAMRLVSDQKQRAVFMNVITRRDGRVSVTSGPLCRAQTHLYGRVDRVRVVIRSLTNSASYVNVTGQRHLLARLTRPSDTMDEQSGSVNVNAYVLDAAIHLAEGVLQFDGGCAARVPAALDSVFCAHRRRGDAWREPRTISSTCSIAQNAHIVRGQRVCHDHIVPGTSLRRLDIRPPFGSRSRALFRTVAPNKNATKYAAARLTATPKYPRNIRMCVRSNVDDGYRTKDSVTRGMSAFTQYLSEDVVLRTTGACCNVFDLSSALLGASRCATHELFSKTSVACVDRHIACVDRASDSITNEDAFQAMSLAHGTQSSRTLVVDSYIESVRTLDRRRHFKSKVLSLCFADQASFNSLLVYGGTGALGARAAKDFAECYSSGHVALIGRSGRSALDINSYASIMRALRLDATALEDSVIAQTFTVQSNVAYASGVLADASWSNLTSRSLLATCAPKLNTARDWMDLSAPIGCRTYFSSATAFVGNTGQTVYGAANATLDRRAGAAATAGVNSVSIQWGAFAGGGMASGVEDRMMRTGIGLLPPDRGLTLLRTVFSRIILSAHQFCISAFDWQVYVSKHPVSSSSPFFANVIEQTRGHSKESTKSSFGDFSAPTRRASVLSKRVDVQRAINDALKSVLGREVTVESPFFELGMDSISSVEFVTSLETALDRRLPATLVFDYPSPKALAIFIDSLDTSAVSVLRTHEPSVESRAGKSMTDVIITASSDVPGCRALNRGIGAIPWRADDRVSTITRERWDVERCIQVPRFAGIYFGNDWHSFDGDAFGLKLNEIAVMDPQQRLTLRHAAEALRTRPCVDAQSLTCGVFIGAATNDYKSLVIDAGVFESPFVSTGCAFISVIAGRISYTLDLSGPSLSIDTACSSGLCATHFAHEDKSSTIRIIGSVNSLLDANSSFMFAQAGMLAADGRCKTLDASADGYARAEACAVVVIVRDSTMTNIGVVAVDGSAVNQDGRSSSLTAPNGPAQARVIRASAAKSGVSRTISSLHGTGTALGDPIEIGAMNDARDDDVPIVVLVATKTSCAHSESPAGLIGLIGAASVLSAKCAAHMLHLRRANTYLERALAEKSNIAARTSCAISDIRASGASAFAFQGTNACASTIISLIDGHRSAFYTCKRSVVRHAHHRTLPLVIAPACVRASTYLRSRETHEVQLTPGTSMFDHRVRDRPVLPGAAYLCITAQCAGLLTYMSVCRFTVDCVAFCAPLALTTDENTSLSIAFRLGRAEFTSLSARAVMFAKAQISKMRCITTSPSLKWKYPDISEAHVVVVGNISPSSNFLEESKAWAELDSSFHFLSATWEREANLLRIPSSVDAFVHMSRIESRGVALVPSVVTSEHTSRGSSVRGLRTTAIRPPKSQTDALTGTYVLTAARRISSRPDAQFQYVDVRDERGIVAAMQTTTPFDSALLTPRCHSFGIVASMRSAAMETRTASEVRVSTAYARCIARTSHHHDSSRRDFASLVRSERDEYAQVCIIGGAGALGQAMTNYFSSSEYHRVAWTSTTGRARVILSLDCEKELHISLCSTIASEHIASTFIMRASGVLKDAVIANFTVRDARSVMAAKCAGRTMFDDGIIPTWRDRTFTSIAGMLGSLGQAAYAGANELMDYRCRNRMYYGLDAKSIQYGPWAGGGMGNDSVVRSRMRTLGVSYMNPTDALVATSALNRLDAPIVTCVAAINWKTYALSTHRVDDEMFNIITNRVKQSDRPATVNEVQLKPAHRREMNSLRLETLERVIECVEQATGLRSDSEMPFMESGVDSVSSMDLSSELSRTFSITLPATFLFDNPTPKAAAEFIVGAFRAKASDSQLTRAAKQPVRTDVNDRFVLINTHVASEAKPAEMLDGTQRIPHNKWNLDDLRRERLAASFMNFIRDLDAFDGEAFGVRMEEARRIDPQQRLALRAAMIAVDASKSGLAVFLGIASRDYCDLVNRNGIFSASTYDAVGSFGSVASGRISFAYDFKGPSTSIDTACSSALVSAHQCRTEMLMGTVCAALVGGVNVILHPRVTEQFNRAGMLSPSGRCQTLDASADGYVRAEACRFIRMELVNKCAGVNLRSSAINQDGRSSALTAPNGPSQRDVIAMCQHDPRGACFFLHLHGTGTPLGDPIEISALSALAGETSSIDLDASKSWFGHGEPASGVVAMTHLLSELATRCAIGMRNLAHFNPYVVTSARWMYVARVPSSRECTRCGTSSFAFQGSNAHVGVDFNSQEDAAVKLDCWQTLNARRAWCEPRTFQSVPRVHLTIGRDMRFVGDVRVVAGVEDHRVSGKILFPAAGMLHAALCSGLACADCATLCASATIPSSLEIVKESTSYELVVRRLDGSCALVARSRTRFKAYLRAAVPCQRNANNMDETLVITHERARAVHATPVDPETVYEALRRRGLDYGPYFRVLRNIRRGLRSRIAVIADVKCVVGQIAAMDGIMQLAAPMDVETPLAIPIGAEACFGGISDVARACAWAHASSLTSSSHAMVSENISNWSCIQRLRAKTLNSRSTTSTLSATRYFTKRCAESHPPEKYFGVSTADYSRVAVSCAQCFSRCRAQDTDVQVAGVHIDHTLGAVKSAASEFGSAIDASESRVHESYAHVERLEVERPLRKRAQRLSECIRTKSTHSKETHVIGAFGSLGLVTTKTTLIIRSSTVLMSGRLGRGNFNMASESMILPRLIRATSRDAATRTPQRTIEDSRNIFVAGALADGLISRLTARSFRIVFAPKTESALKFSANAHKSTAVYFSSVASLLGSAGQFNYAAANGAMDFIARSRRRLGVDEVSIQFGPWAEGGMAVRHSDTLRRLREMGMAALSADEGASVLRASLQRAVTCVAALSLRTLAANAVHLKNQLLFEHRSASAPTRMTQPSKKYIVKEDLAIRDIDVERKLSSAVAAALGRVVDRDAPLMQAGIDSLSAMDLTSAASSMFDVDLPSTVLFDHPTIASASREITRLRFDVHDQPCAKVVTSQRTPGSNVRQRAFAAPRIVSQAGEMSRRALDRDTVQRIDPEREAAIFLGAPSAFCGFTLSYERLVAFDACVIGPTSSSELLHLDPRQRLLIDATAKCVAALKYSVDTHGQCGVYVGCAGKDYSRLLEGLGLERGAFHGVGNETSVVSGRISFVFAINGPALSIDTACSSSLCAVSISLAGFESNVISRAYVAGASLVLTDDMHRVLGGAGMLSPAGRCRSFDEAADGYGRSEGVELLVFAASTKDASAVAVLAGAAVNQDGRSSSLTAPSGSSQEEVIKLATNLCASLNRDRDGKVLHTHGTGTALGDPIEINAAIRALVHSRDPLVLQASKSHCGHAEPAAGAVAIVFAIEHSLRSSIACGICHLRRLNKHVRLANAVAPRIPVPVVLDVNAHVSAFAFQGTNSAIVVAPSDNEMAVMENDMYAITHARRYWPTRAPEVRSVTCSRGARMMFDVSVGCMSFPFVLSRAVERALDDDVVVVSDYVAGCDDGTEYAQITVDKDIIRSSFGCVARAQGLGKASPVAVSFVISYETQMSYALTSKSGAAFGLPIACKCLAVRRSSMRSDGFFSSETCRGVTERHRSDGSMTFLAIGVQRDGCRRRRNVQCIKGRITYSVIDSSLPSVRPVSVRPVSVRSASTAMMLAQTSFSSTRHDHLIGCELEVIFRSGGIGNRQSVQSQLRYLKIDDVSSERSAPVQALVLGGTGALGRIICRRLLGDVIACSRVGRSWDTRPNSYSMEVLRCDHSLREDAFVSQVSPRLALHSGGVLADATLQNQRTHGIARVFAPKIVASTNAHKSESPCRSVLFSSIAALVAPFAQANYASANTALDTFAERSQERGDLVTSVRWGAFQAIGMASCNVDMARDLATYGIAMLSLDAGLDVLRKIMLGAATPAMFVVSPLNVMKRKKHDVGPLTEGTNVSMTPEVCAKVIERIVAELVGSPLPRTAPMMAAGLDSVSSVELLSAVERKFDVVVPSTLAFDYPSIDAMAAFVSCTLNKNAENNACDSAINSLKFAHREKQSHLYAHSRSGRVFTGDDNDSALISDRSIGTTCIPLWRWNIDESLGLELPVRFAACLSDIDTFDRAVFSVSAPEAMAMDPQQRGVLERVCACRPGDLSDSAVGVYVGIQHFEYALLDVSGELGSHAATGRALSVCAGRVSYIFGFTESSLAVDTACSASLVTVHLALMDEARASAHACVGINFILTRKTCDAARAAGMLASDGRCKAIDATADGYGRGEAVACVVLARDSRGCVAFVVLGGACAQDGRSSALTAPNGPAQRRVIADAWQLLQCAKDVVRYVSMHGTGTALGDPIECSSLKDIYHERSQGDTINLLASKSAVSHAEAAAGSVGMFHLVACFASNATPSIVGLRTINPHVALSDILRAPRQMAAAVMPCDGETIAGCSAFAFMGTNAHIVLRKATDALPVRQFAFERESLWPTFVPTGCFTLGRVTCLPSPMRDIMEVCVTNFREYVTCITFARLACDCARVCNGVGRRGFRRNTAQQIVVYSSVTDFPSADFTLRMRLSGEMRMDAIDHMS

SEQ ID NO: 43247 - protein, 176 aa, Oryza sativa (indica cultivar-group)
MSGRGRGDPLVLGRVVGDVVDPFVRRVALRVAYGAREVANGCELRPSAVDDQPRVAVGGPDMRTFYTLVMVDPDAPSPSDPNLREYLHWLVTDIPATTGVSFGTEVVCYESPRPVLGIHRLVFLLFEQLGRQTVYAPGWRQNFSTRDFAELYNLGLPVAAVYFNCQRESGTGGRRM

SEQ ID NO: 43248 - protein, 280 aa, Brassica napus
  misc_feature (33)..(33): Xaa can be any naturally occurring amino acid
  misc_feature (52)..(52): Xaa can be any naturally occurring amino acid
  misc_feature (167)..(167): Xaa can be any naturally occurring amino acid
  misc_feature (209)..(209): Xaa can be any naturally occurring amino acid
  unsure (1)..(280): unsure at all Xaa locations
FYIPVYFLRNGGPVVEAKNRCALGYIVNIASLXGVEEEKLNRPLNRDFVPSXLENANKKKINVAKKPEAVQKKARAVVKPQVILISPDTDVVAKAKQDQRHDVASKKKVTYSSILNARSKAAASRTLDIDSTDKDNDLGAVEYVEDMYAFYKEVEMYMQTHIEINEXMRSILLDWLIDVHVKFDLSPETLYLTINIIDLFLSLKTIPRXELQLLGVSALLIASKYEEIWPPQVNDLLYITDNSYQSMQILLMEKTIMGSLEWYLTVPTQYVFLARSIKAA

SEQ ID NO: 43249 - protein, 174 aa, Triticum aestivum
AYLGDTIEQVCTKKQAGTGPEFPGYRRPTRPQIDWKRKYGKYKPIVEPAKCQKCSKRNVRQAYHNVCTGCSKELGICAKCCTSVKQLVGRDAEEANSERKELEEAIRYARERERRTLLRLMNKNKDESGPSVPKIADRDREGDLFPVASLDEYAEQAVQKDESDEEDARDFVKD

SEQ ID NO: 43250 - protein, 213 aa, Trichodesmium erythraeum IMS101
MQISDRLSSSTAPILNLPVRRASVKRKTGETDVTVNLNLDGVGNCQANTGIPFLDHMLHQISSHGLIDLDVQAVGDIEIDDHHTNEDVGITLGQALKQALGDRKGIVRFGHFLAPLDEALVEVALDFSGRPHLSYGLEMPTQRVGNYDTQLVREFFVALANNSLMTLHIRQLGGINSHHIIEAGFKAFARSLRMATEIDPRRVGEIPSSKGVL

SEQ ID NO: 43251 - protein, 228 aa, Gossypium nobile
  misc_feature (93)..(93): Xaa can be any naturally occurring amino acid
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSXNGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 43252 - protein, 122 aa, Triticum aestivum
  misc_feature (97)..(97): Xaa can be any naturally occurring amino acid
  unsure (1)..(122): unsure at all Xaa locations
MAGTGRSMLLSLLLFAVTLSLLEMYRGWFAASELKTIAGGFVSSLLFLLLLTFIGNYQEASGVRTGWGAVVVAQLVALIVAGTVHRVCITTCFLFSXAGILYEVDKLSGMILARSESKARRY

SEQ ID NO: 43253 - protein, 107 aa, Zea mays
MGECEDGKEYRCWEELLPDALGLIFRNLPLQEVLTVLPRVCKSWGRVVAGPYCWQEIDIEEWSQQQSKPEQIARMVELLVGRSAGSCRRISVSGLPCDPRFSFIGDK

SEQ ID NO: 43254 - protein, 519 aa, Ashbya gossypii ATCC 10895
MLAALYGKRAVSGTRRAVQVGLRTFAAQSEVRVGEAERPKARTSSFKPAKVIENRMDDKPNVVILGSGWGAISFLKHIDARKYNVTVVSPRNYFLFTPLLPSTPVGTVDEKSIIEPVVNFALKKKGNVSYYEAEATSINPQRNTVTIKSVSTVAQLSHPDNHLGLTQQDSAELKYDYLVSAVGAEPNTFGIPGVEEHGNFLKEIPHSFEIRKRFLSNVEKANLLPKGDPERKRLLTIVVVGGGPTGVETAGEFQDYVDQDLKRFMPSIAEEVQIHLVEALPNVLNMFEKKLTSYAQDVLQKTNIKLMLRTAVGKVEKDHLIAKTKKEDGTVVEQTIPYGTLIWATGNKARPIVCDLFKKIPEQNSSTRGLAVDNYMLVKGTNNVFAVGDNAFAGLAPTAQVAHQEAEYLAKVFDKMAKIPDFHEQLTQRKEKVDLLFEEHGFKPFKYVHLGALAYLGAERAIADITYGKKSFYTGGGLITFYIWRVTYLSMLLSARSRFKVIADWLKLTFFKRDCFKEM

SEQ ID NO: 43255 - protein, 110 aa, Bartonella quintana str. Toulouse
MTTVHDFIDNEIKTNDVILFMKGIPEAPQCGFSGQVVQILDYLGLKYKGINILTSDELRQGIKEYSNWPTIPQLYIKGEFIGGCDIVKEMFQSNELQELLKEKKISFNLL

SEQ ID NO: 43256 - protein, 316 aa, Zea mays
MASRPPLHRRRRLPLVPLLVLLCLSPGCAAGRVPVSVYYETLCPFCSAFVVNDLSRIFRDGIFSIADLRLVPFGNGRVSADGTVTCQVSSVPDTVSFSLFLELGMWLCAFLKKSNCKFERHQLDHSNGQLLVLQHGEDECQLNAIEACVIRIWPDAEQHFPFIQCVEHLALTRKWDAWQSCFHETGLAYQPAIDCYNSGYGRQLVLQYAAETNALQPPHRFVPWVVVNGKPLGDKSSLIQRLQDYMNFEAYICSAYDGKLPKACKGKHLAIAQETKASRGDKKNIKCKHFMLIFTSIFRKKKYYCAIKFLVPSSYN

SEQ ID NO: 43257 - protein, 453 aa, Oryza sativa (japonica cultivar-group)
GSSEPFPGAREANREFDISSSHALHLFDETPARAVSSFYARDLFDETPLRACSAAMEGSPSKRRGVTAPAHTDDGDWFSDVPDDVILNIMSFLTTRQAVQTCVLSRRWLNLWRSVPCINADVGEFQRSDTEWEEYDQERESAFKMFMDRVLELRNPAAPIRTFRFRCCRLDGFEGTSDEADMNRWITHAMQKQPWVLDILVLYDALKLDHSAFTCRYLTRIKFINVLMMPGFFQQLEMGCPVLENLFLDESIVADVEISSRTLKVLTIKSTQFSYKFRTTISTPSVTYLKLWRPVNGIYVFNDMPLLVTSILVLYDVQDSSDFCQNLRSLSAAKRLEFDYFGRKLTMENNLQLYPKFNNLVSLTLGQWCLDANFYGLVVFLQNAPKLEKLTLELEKNTPERIIGKLEDRSFTCEHLTRVEVVCSEGDPLVKDVVNFFVNSGLTSAQVQIIRWC

SEQ ID NO: 43258 - protein, 502 aa, Xylella fastidiosa Ann-1
MHNGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVSANPERAAHAFDIVSTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDLYTENHFALNANLLAQIEVLANGQLSDNPHRVYPGGNPSTLILLDALTPQALGGLIAMYEHSVYVQSVIWGINAFDQFGVELGKHLAVQLLPALKGESVEVADPVTRAVLLRLRG

SEQ ID NO: 43259 - protein, 391 aa, Pseudomonas viridiflava
MEQQCDVAVLGLGAMGAATLYQLAREGADVLGIDQYAPPHTLGSSHGDTRITRLSVGEGPQYLPLVRNSHRIWRELEALTGESLFEQCGVLVMTSSPAYDPNDPEDFTHKTIALAREYGVKHEVLSAGAIRERFPQFTPVLDTAIGYFEPDGGFVRPERCIAAQLQLAGKLGARIRLNETVTRLQAHGDQVRITSDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGTSDVDLSAFSLKRFGKTA

SEQ ID NO: 43260 - protein, 348 aa, Prochlorococcus marinus str. MIT 9312
MKNLLGSSIKDLENIALDYGQAAFRGRQIYSWIYNYRNKNKNIDQIEVLPLDFRKKLKDDGFKVSELSFQEKKLANDGTLKLLLSTNDNESIECVGIPTEKRLTACLSSQVGCPMDCKFCATGKEGLKRSLKASEILDQILFIENEMNRKVTNIVFMGMGEPLLNIDELLLSIRSINEDFQISQRKITVSTVAVPKMMSKLSARSFQILGNCQFTLAISLHASNQKTRETIIPSAKNYEIKNIIEDSKQFVKDTGRRVSFEYLMLSGVNDKLEHANELSNLLRGFQCHVNLIQYNQIDEVEFKRASLKNLQLFQSRLSNNGITVSFRKSRGLDKNAACGQLRQNARNK

SEQ ID NO: 43261 - protein, 130 aa, Leuconostoc mesenteroides subsp. mesenteroides ATCC 8293
MSKKVVSTTTAPKALGPYSQAILNDNTLYISGQIGIDPETDEFAGATTAEQAHQIFDNIDNILHEAEFSRNDIVKAALFFDDIADFALVNDIYAQYFDTTSVEEFPARSAVQVAALPKNAKLEIEITAMK

SEQ ID NO: 43262 - protein, 391 aa, Pseudomonas viridiflava
MEQQCDVAVLGLGAMGAATLYQLAREGADVLGIDQYAPPHTLGSSHGDTRITRLSVGEGPQYLPLVRNSHRIWRELEALTGESLFEQCGVLVMTSSPAYDPNDPEDFTHKTIALAREYGVKHEVLSAGAIRERFPQFSPVLDTAIGYFEPDGGFVRPERCIAAQLQLAGKLGARIRLNETVTRLQAHGDQVRITSDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGTSDVDLSAFSLKRFGKTA

SEQ ID NO: 43263 - protein, 222 aa, Alkalilimnicola ehrlichei MLHE-1
MRAARIEGVLFDLDGTLLDTAGDLATALNRVLAEQGRSPLPEARIRPTVSHGAVVMLCHAFALAPDDPAMPALHEAMLRHYEADIAGRTRPFPGMETVLARVEALGLPWGIVTNKPARLTHPLLAALGLDRRAAAVVCGDTAPRPKPHPDPMEAACATLGVAPARCLTAGDALRDIQAGQHAGCPTLAALFGYLGAGDHPAGWGADGLLNTPQDLLRWLPPA

SEQ ID NO: 43264 - protein, 338 aa, Sordaria macrospora
MVVKVGINGFGRIGRIVFRNAIEHDDIQIVAVNDPFIEPKYAEYMLRYDSTHGNFKGTIAVEGSDLVVNGKKVKFYTERDPSAIPWSETGADYIVESTGVFTTTEKASAHLKGGAKKVIISAPSADAPMYVMGVNNESYDGSANVISNASCTTNCLAPLAKVIHDNFTIVEGLMTTVHSYTATQKTVDGPSSKDWRGGRTAAQNIIPSSTGAAKAVGKVIPDLNGKLTGMSMRVPTANVSVVDLTVRIEKGASYDEIKEVVKKASEGPLAGILAYTEDEVVSSDMNGNPASSIFDAKAGISLNKNFVKLVSWYDNEWGYSRRVLDLISYVAKVDASKA

SEQ ID NO: 43265 - protein, 401 aa, Methanosarcina acetivorans C2A
MFFYRGVCLRPPCDPSKFVAEAVKSIPPSGIRRFFDLVSGLEDIISLGVGEPDFITPWHIREMCIHSLEKGQTSYTSNYGLPELRDELARTYYKRYGLDYDPASEILVTTGVSEALDIAVRAVVNPGEEVIVVQPSYVAYVPSVILAGGKPVIVSTSRDDDFSLTAEALKPAITSKTKAIILNFPNNPTGAIMEQEGMEDIADLVVENDLFVISDEVYECLTYGGTHVPFSSLEGLKDRTVMLNGFSKAYAMTGLRLGFAMGAPDIIHSMMMIHQYSMLCAPITAQVGAIEALRNGKEEMERMVREYDRRRRFIVKGFNSIGLECGNPKGAFYAFPYIGGTGLSSSDFAERLLEEKKVVTIPGDVFGEAGEGFLRCAYAASLDDIRKSIERMGDFVEELKQ

SEQ ID NO: 43266 - protein, 391 aa, Pseudomonas viridiflava
MEQQCDVAVLGLGAMGAATLYQLAREGADVLGIDQYAPPHTLGSSHGDTRITRLSVGEGPQYLPLVRNSHRIWRELEALTGESLFEQCGVLVMTSSPAYDPNDPEDFTHKTIALAREYGVKHEVLSAGAIRERFPQFSPVLDTAIGYFEPDGGFVRPERCIAAQLQLAGKLGARVRLNETVTRLQAHGDQVRITSDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGTSDVDLSAFSLKRFGKTA

SEQ ID NO: 43267 - protein, 389 aa, Rhodopseudomonas palustris CGA009
MIAFQDPAMLREARRTPVRAQTQGLNLTSEQALLVLGIETTCDETAAAVVERRADGSGRLLSNIVRSQTDEHAPFGGVVPEIAARAHVDVLDGIIAAAMNEAGVAFASLSGVAAAAGPGLIGGVIVGLTTAKAIALVHGTPLIAVNHLEAHALTPRLTDSVEFPYCLFLASGGHTQIVAVLGVGNYVRLGTTVDDAIGEAFDKIAKMLGLPYPGGPQVERAAEAGDPNRFAFPRPMLGRQDANFSLSGLKTAVRNEAGKLTPLDPQDINDLCAGFQAAVLESVADRLGAGLRLFKERFGPPKALVAAGGAAANQAIRRMLREVAAKVQTTLIVPPPALCTDNGAMIAWAGAERLALGLTDTMDTAPRARWLLDANATAPAKFANTRAGF

SEQ ID NO: 43268 - protein, 476 aa, Arabidopsis thaliana
MLEIITVRKVFLIGFLILILNWVWRAVNWVWLRPKRLEKYLKKQGFSGNSYRILMGDMRESNQMDQVAHSLPLPLDADFLPRMMPFLHHTVLKHGKKCFTWYGPYPNVIVMDPETLREIMSKHELFPKPKIGSHNHVFLSGLLNHEGPKWSKHRSILNPAFRIDNLKSILPAFNSSCKEMLEEWERLASAKGTMELDSWTHCHDLTRNMLARASFGDSYKDGIKIFEIQQEQIDLGLLAIRAVYIPGSKFLPTKFNRRLRETERDMRAMFKAMIETKEEEIKRGRAGQNVTSSLFVWTLVALSQHQDWQNKARDEISQAFGNNEPDFEGLSHLKVVTMILHEVLRLYSPAYFTCRITKQEVKLERFSLPEGVVVTIPMLLVHHDSDLWGDDVKEFKPERFANGVAGATKGRLSFLPFSSGPRTCIGQNFSMLQAKLFLAMVLQRFSVELSPSYTHAPFPAATTFPQHGAHLIIRKL

SEQ ID NO: 43269 - protein, 630 aa, Candida albicans SC5314
MLKVARLQIRFNSSTAASAAAVAAKTAEVRTRTVKTPVGIKAAIESLKPKATRLSMDGPVECALSGFSLLNSPQFNKGSAFSKEERESFDLTGLLPSQVNSLDEQVERAYRQFSYLKTPLAKNDFCTSMRLQNKVLYYELVRRHIREMLPIIYTPTEGDAIASYSDRFRKPEGCFLDINDPDGIDKRLSAYGEDKDIDYIVVSDGEGILGIGDQGVGAIRIAIAKLGLMTLCGGIHPARVLPIALDVGTNNDRLLNDELYMGNKFPRVRDEKYWDFVDKVIQAIKKRFPSSVLHYEDFGVSTGRDLLYKYREELPSFNDDIQGTGAVVMASITAALKFSKRDLKDIQVLVYGAGSAGLGIADQITNHLVSHGATEEQARARIHCMDRYGLITNESTNASPAQLKYADPASEWDGVDTKSLLACVNKIKPTVLVGCSTQPGAFTEEIVREMYKHNPQPIIFPLSNPTRLHEAVPSDLMKWTDNNALIATGSPFEPVDGYYISENNNCFTFPGIGLGAVLSRCTTISDTMISAAVDRLASMSPKMENPKNGLLPRLEEIDEVSAHVATAVILQSLKEGTARVESEEKPDGGFVEVPRDYEGCLKWVQSQMWKPVYRPYVKVEYVSEIHTYQY

SEQ ID NO: 43270 - protein, 950 aa, Ostreococcus tauri
MNTIGLAILGASALVDGVSAANLYGTRDLFTSAATPASVLVDVTNVHSPNGLQTLNAFLTDSESKNDAILSGTACSSRSFFATCFDTPAIGSGLTLHSVASDGTIHLMGITDRGPNQDCGDIADDFNTTGQQYTYPTGFTGPSVSKGKGFPVPKFSPTIVKGYLDKTNNRFVLDKTCNLKRATAPENFTTDVTGLPTNTNDDTPYDGWCRNKLPYDEGGQDAEDIQPIPGTNYAVIVDEYNPSISVVDIDFASTNCGMVKVRYVPESISLPNAGYDVKNILPRSFDQRRANRGLEGVAVSPDGKTAAAFMQSCMVVTDATYRTEAGLGAGSTEDGKDCEFTLVAFLNITDPLNAKMIGTKLYPLDSYQEWGFTSFGKMDRVKVSAAFWLGPEYGVTNNKQVIAVLERDPSVRIHIADFSAAEYIDESKNSAASLNVLVKKVNVTAKLGFNAFATKKLVVDTATVDGYVARGEGAKVEGFAFLNNYTMVIANDNDFGLEGNKVSTVDIIRLNASVAELIDPTINDVPNQVQRRLRRLEPWSPSSPSAPPSSSRERRSVLDVSPRARGSRALHPPAAPTAVIHGTHTGVGGVCGASNRASFNASRPFGSASGFQKPARARRATRDMGALSYLPIPYVRALVRDTVVDACVSHVLALYGLVALLTYWVPKVAVQMMPSQDLKKKYDAQWALVTGGSTGIGRSLAFALAEQGLNVAVCALDDEHLETTCRALREKFGATSEIRKIGCNLGDQSGAYVETISKALEDVDVQVVFNNAGFMLTGFFDKQPLEKLNANNECNATSAMRITHVFVRRMLAKKLRGCVVFTSSAAACQPTPFSAMYGATKAYISSFAANIGVELKSRGIDVCAVHPSPVASNFYDKAHKLDSLNFFMNFAVKPEELPTEMFRPIGRVLWHDVGGVAIGFRMLLKLFDYGFFATLISRFAHLMGDYKKNV

SEQ ID NO: 43271 - protein, 228 aa, Gossypium pilosum
  misc_feature (152)..(152): Xaa can be any naturally occurring amino acid
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAXGSTVAIFGLGAVGLAAAEGARIAGASRIIGVDLNPNRFEEAKKFGCTEFVNPKDHNKPVQEVLAEMTNGGVDRSVE

SEQ ID NO: 43272 - protein, 931 aa, Ostreococcus tauri
MALARGRGRAFASTPVTTRRGRARARVRASAARDVSPDRVAASATGAKTGKRVFRFGAGAADGARDAKGSLGGKGANLAEMSRVGLSVPPGFTVTTETCADYHENGSELPPGAWEEMVEGLGHIEQALDKKLGDAENPLLVSVRSGAAVSMPGMMDTVLNLGLNDACVEGLAKKAGGRFAFDSYRRFLDMYGNVVMGVDHHKFENALERMKKDVGAKSDEDLTEANLRDLVEIYKGVYASEGVAFPQDPYEQLKLATFAVFDSWNSDRAKKYMSINKITGLRGTAVNIQAMVFGNMGETSGTGVLFTRNPSTGENKLYGEYLVNAQGEDVVAGIRTPSDISTMAEALPQAYDQLVKNCELLESHYKDMQDIEFTVQEGTLYMLQCRSGKRTGAGAVKIAVDLVKDGFVTEEEAVQMVEPTHVDQLLHPQFKDEKAYKPDVIGSGLPASPGASVGQIVFTTEDAEVAKAEGRKVILVRVETSPEDVGGMDAAEGILTARGGMTSHAAVVARGWGKTCVSGCTDLTVDERGKTLTLGGVTLVENDWLSLNGTTGEIIRGRAELAPPSVTEDLGLFMSWVDKFRTMKVFTNADTPEDAAAARANGAEGIGLVRTEHMFFGSGERIRAVRRMIMAKDTPSRETALDELLPYQREDFKGIFVAMSGLPVTIRLLDPPLHEFLPDGELDDVISLLSEDTGEDEDSIVDRIEKLAEVNPMLGFRGCRLAITYPEIARMQVRAIFEAAIEAEKEGSTAIPDIMVPLVGTVAELEDQVALIRQTASVVFAEQGKTIDYRVGTMIEIPRAALLADQIAAHAEFFSFGTNDLTQMTFGYSRDDVGKFLPTYLEKGILKHDPFQVIDRDGVGQLIKMSVKNGRSARSDLKVGICGEHGGEPMSVEFFAQSGLDYVSCSPFRVPIARLSAAQAAIRAKKDVSPP

SEQ ID NO: 43273 - protein, 548 aa, Oryza sativa (japonica cultivar-group)
MSAAHLLRHSRKLRTLRDALDYDRSALVRYFSAASASFPTKGGAAAGVEKRIGGARFPQCKQPGKELETFKVSLGGLNGRYACRRAPNNCIPTTITGLNGSLSCGQVSSARSFSSSADLPPHQEIGMPSLSPTMTEGNIARWLKKEGDKVSPGEVLCEVETDKATVEMECMEEGYLAKIIHGDGAKEIKVGEIIAVTVEEEGDLEKFKDYKPSTSAAPAAPSEPKAQPEPAEPKVKETEPSRTPEPKAPKTEEASQPGGRIFSSPLARKLAEDNNVPLSSVMGTGPDGRILKADIEDYLASVAKGGKREALAAPGLSYTDVPNTQIRKVTANRLLSSKQTIPHYYLTVDARVDNLIKLRGELNPLQESSGGKKISINDLVIKAAALALRKVPQCNSSWMSDFIRQYHNVNINVAVQTEHGLFVPVIRDADKKGLGTIAEEVKQVAQRARDNSLKPEDYEGGTFTISNLGGPFGIKQFCAIINPPQSAILAIGTAEKRVIPGSVDGQYEFGSFMSATMSCDHRVIDGAIGAEFLKAFKGYIENPNSMLL

SEQ ID NO: 43274 - protein, 662 aa, Pasteurella multocida subsp. multocida str. Pm70
MNTIKSGKPSPLGCSKQTEEGQDGYNFALFSQAARRVELCLFSEGQERRVDLQPSDDGIWHIWLSDVSVGTEYAYRISGKTDRTLANSNKLMLDPYAKAVVGKPDLSTPEKRAWFDLNDPRDNAHLAPKAVIIDEAFDWQGDKPLRTPWAQTVIYEMHVKGFSQLREDLPEALRGTYAGLAHPNMIAYLQDLGVTAVELLPVQYQADEVHLQEKGLANYWGYNPLAMFALEPRYSSQHSSMGALHEFKTMVKALHQAGIEVILDVVFNHTAESEKYFPTFSQRGIDDETYYWQDAQGYYHNWTGCGNTLNLSQPITRRWVLDCLCYWVEACHVDGFRFDLGSVLGREGEGGFNPQAQLFADIQAEPRLQGCKLIAEPWDIGDFGYQMGNFPAYFAEWNDRFRDDVTRFWLWKSGESGAFAQRLAGSSDLFQQTRQVHNSINFITAHDGFTLRDLVSYNEKHNWANGENNRDGRNHNYSYNHGVEGIDNVPSAVENGRILSSIALLMNLLLANGTPMLLAGDEFGNSQFGNNNAYCQDNEIAWLKWQDFNPVLFNATKQTIALRKQIASLQQDCWWSEVNVQWLNTKGEPMTIADWHNQESKALQVLLDNKWLFLINAKQKLQTFSLPEGDWEVMYCATNLTTQGGFIELDDVTFGVLQQLNK

SEQ ID NO: 43275 - protein, 439 aa, Pasteurella multocida subsp. multocida str. Pm70
MEVIMNSSIVKLPNKYELVKDTLVLILAGGRGSRLYELTDKRAKPALYFGGNRRIIDFALSNCLNSGLNRIGVVTQYAAHSLLRHLQNGWSFLPAERGEFIDMLPARQQIDDSTWYRGTADAVYQNMAIIRDHYCPKYILILAGDHIYKQDYSQMLLDHIHSGAKCTVGCIEVEREKATEFGVMAVNENLKVKSFVEKPKDPPAMVGKPNTSLASMGIYVFDADYLYDVLEREVSSPYTSHDFGKDILPKALEEGVLYAHPFSRSCMGRNTEGEIYWRDVGTLDSFWQSNIDLVCENPQLDIYDQSWPIRGNPVQTYPSKFFYKKENARPVDNSLISGGCVITDASISYSVLFDRIKINEGSQIDHCVVLPQVTIGKNCKLKRCIIDRHSVIPDGMEIGVDLELDRQRFRVSSGGVVLVTPSMLKKLNGEEVASEAHLD

SEQ ID NO: 43276 - protein, 368 aa, Symbiobacterium thermophilum IAM 14863
MAQPTYHIACLPGDGIGPEVTRGAVTVLQAAAAAYGFRLEFSEYLVGGAAYDAVGTPFPDETRDACDRADAILFGAVGGPRYEGLPWDLRPEAGLLAIRKRYDLYANLRPILLYPPLKDASPLKNEIIGGGVDFIIVRELVGGIYFGEPRGIETLPDGTRRGVNTEVYTDAEIARIARMGFEIARGRRRRLTSVDKGNVMEAGKLWRTVVDEVAREFPDVEVEHLLADNAAMQILRRPGDFDVMLASNLFGDFLSDEAAMLTGSIGLLPSASLGAARNRFGLPKGFYEPIHGSAPDIAGQDRANPLAAILCGAMLLRHSLGREDAARAVEQAVAAVLEEGLRTADITVPGTAVLGTAAMARAVADRVH

SEQ ID NO: 43277 - protein, 237 aa, Prochlorococcus marinus str. MIT 9312
MNSQTQMKQIVAEAAIEEVKSDMILGLGSGSTAVLMIKSLADAIRSGKLQNIKGVATSFQSEVLALELDIPLIDLASVSQIDLAIDGADEVDPGFQLIKGGGACHVREKLVASKANQLLIVVDETKLVRKLNQSFPLPVEVLPNAWKQVQEVISEMNGISTLRMATKKAGPVVTDQGNLILDVLFNDGIKNPKDIEKSINNIPGVLENGLFIDLTDKVLVGKIENNIPVAYSPAKVG

SEQ ID NO: 43278 - protein, 257 aa, Zea mays
  misc_feature (19)..(19): Xaa can be any naturally occurring amino acid
  unsure (1)..(257): unsure at all Xaa locations
MAREENVYMAKLAEQAERXYEEMVEYMEKVAKTVDVEELTVEERNLLSVAYKNVIGARRASWRIVSSIEQKEESRKNEEHVNLIKEYRAKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 43279 - protein, 436 aa, Bacillus circulans
MKKGGDLRMNLDQAEITALTKRFETPFYLYDGDFIEAHYRQLRSRTNPAIQFYLSLKANNNIHLAKLFRQWGLGVEVASAGELALARHAGFSAENIIFSGPGKKRSELEIAVQSGIYCIIAESVEELFYIEELAEKENKTARVAIRINPDKSFGSTAIKMGGVPRQFGMDESMLDAVMDAVRSLQFTKFIGIHVYTGTQNLNTDSIIESMKYTVDLGRNIYERYGIVCECINLGGGFGVPYFSHEKALDIGKITRTVSDYVQEARDTRFPQTTFIIESGRYLLAQAAVYVTEVLYRKASKGEVFVIVDGGMHHHAASTFRGRSMRSNYPMEYIPVREDSGRRELEKVTIAGPLCTPEDCLGKDVHVPALYPGDLVCVLNSGAYGLSFSPVHFLGHPTPIEILKRNGSYELIRRKGTADDIVATQLQTESNLLFVDK

SEQ ID NO: 43280 - protein, 374 aa, Prunus dulcis
MTFKLGKKEILIDILARLTAKSLVRFLCTCKSWSDLIGRSSFVSTHINRNVTKHAHVYLLCLHHPTFERQNDNDDPFVEEELLWSLFSNETFEQFSKLSNPLGSTEHYGIYGSSNGLVCISDEILNYDSPIHIWNPSVRKFRTPPISPNNIKFVYVALQFGFHSGVNDYKAVRMMRSNKDTFAVEVYSLRTDSWKMIETIPPWLKCTWQHHTGTFFNGAAYHIIEKGPLFSIMSFDSGSEEFEEFIAPDAICNSRGLCIDAYKDQICLLFRFYGCEEEGMRKVDLWVLQEKRWKQLCPFIIPWKYCRTIGTSIDNELLLQKKDFNKGAADLCLCNYESKQVLETGIKLAIMTYGEIDFLFSFTYIESLVLLNNY

SEQ ID NO: 43281 - protein, 391 aa, Pseudomonas viridiflava
MEQQCDVAVLGLGAMGAATLYQLTREGADVLGIDQYAPPHKQGSSHGDTRITRLSVGEGPQYLPLVRNSHRIWRELEALTGESLFEQCGVLVMTSSPAYDPNDPEDFTHKTIALAREYGVKHEVLSAGAIRERFPQFSPVLDTAIGYFEPDGGFVRPERCIEVQLQLARKLGARIRMNETVTRLQAHGDQVRITTDQGSIIANKVVVSAGMWSSQLLGEPFTDLLRVCRQQLFWFALEDTAAFAPISPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGTSDVDLSAFSLKRFGKTA

SEQ ID NO: 43282 - protein, 185 aa, Oryza sativa (japonica cultivar-group)
MDAGDQSPKEVYSVWALPPEPVRARLRGVMAGLRAAHGGPAFEPHATVVGAIRLRRSAAVEALRAAAAGVRPYTARVVGVARGDFFYQCIYLLLEPTPEVVEASDHCCGHFGYERSTPYMPHVSLLYGDLTDEEKEVARKKVEEIDKEICGLQFEISELALYRTDTEDKSLESWELVEICHLERK

SEQ ID NO: 43283 - protein, 391 aa, Pseudomonas viridiflava
MEQQCDVAVLGLGAMGAATLYQLAREGADVLGIDQYAPPHTLGSSHGDTRITRLSVGEGPQYLPLVRNSHRIWRELEALTGESLFEQCGVLVMTSSPAYDPNDPKDFTHKTIALAREYGVKHEVLSAGAIRERFPQFSPVLDTAIGYFEPDGGFVRPERCIAAQLQLAGKLGARVRLNETVTRLQAHGDQVRITSDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGTSDVDLSAFSLKRFGKTA

SEQ ID NO: 43284 - protein, 325 aa, Prunus dulcis
DDEHNLNFVVEDIKFPLSSGQFIGLEDVESPSILGHCNGIVCLSPCSDNLVLCNPAIKEIKLLPKSGLPDWWGCAVGFGYDPKSKDYKVSRIASYQVEIDGLIPPPRVEIYSLSTDSWREIKNNSLETDTTCFFPDYFQMYFQGICYWVGYEQPKQSVEYEDEEQKPMVIFFDTGDEIFNHILFPDSFYMYEEGSSYAYEMSYLMYCDLRIILWNGSIALFGFNRFSVFPDSYGVWVLDDFDGAKGSWTKHLTFEPLMGIKRVLEFWRSDEILMVTEDGDIVSYNLATQKLENLPMNSLSDFETIVYVNSLVSITRGNKLESVDI

SEQ ID NO: 43285 - protein, 391 aa, Pseudomonas viridiflava
MEQQCEVAVLGLGAMGAATLYQLARQGADVLGIDRYAPPHTRGSSHGDTRITRLSVGEGPQYLPLVRHSQRIWRELEALTGESLFEQCGVLVMTSSPTYDPHDPEDFTHKTIALAREYGVKHEVLSAGAIRERFPQFSPILETAIGYFEPDGGFVRPERCIAIQLQLAEKLGARIRMNETVTRLQPQGDQVRITSDQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFKTQVSGKIAGLKAEVVKSSVCAYTVTPDYHFIIDDHPHLKNVTVVSACSGHGFKHSAGLGLALAQRCLHGTSDVDLSAFSLKRFGKKA

SEQ ID NO: 43286 - protein, 391 aa, Pseudomonas viridiflava
MEQQCEVAVLGLGAMGAATLYQLARQGADVLGIDRYAPPHTQGSSHGDTRITRLSVGEGPQYLPLVRHSQRIWRELEALTGESLFEQCGVLVMTSSPAYDPHDPEDFTHKTIALAREYGVKHEVLSAGAIRERFPQFSPILETAIGYFEPDGGFVRPERCIAVQLQLAEKLGARIRMNETVTRLQPQGDQVRITTNQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFKTQVSGKIAGLKAEVVKSSVCAYTVTPDYHFIIDDHPHLKNVTVVSACSGHGFKHSAGLGLALAQRCLHGTSDVDLSAFSLKRFGKKA

SEQ ID NO: 43287 - protein, 745 aa, Methanosarcina mazei Go1
MAPVETTERLGRSLGFFSTFAIGTGTMIGAGIFLLPGIAMANAGSGAIISFLLGGLITIATSISMAELATGMPLAGGSYYYISRTMGAAFGAVIGLGSWLALIFKGTFALIGLAEYAQIFHPMPIYLVAAVTGVLLLIINFRGAKSSGSLQNFIVVILLLILFVFIGKVSFEVRPENLLPVAPHGVVSIFTTAGMIFISYLGLAEAAAVAEEVKNPSKNLPRAFIASAVVVTLFYAGIMAVVAGFSGPEGGASTVTPLADIAGFIAGDSGKFFIAFSALLATLSTANGAILSSSRFPFAMSRDALMPKWFVSIHKKYETPHNAILVTGSVMVLLLFLFDIEQLARLGGAFNILIFILLNMAVIILRKRTLPGYEPTFRDPFFPFTQIFGVVGSMLLLPLLGGLPLLFSVLMIFAGAGWYMFYGKDKAMPAYNLFDLLENNVERVSAEPEPVGRVLVPVSNPGHERDLLKLADLLGNEIICLHVVEVPSQISLTVGQELYHEKQIEIDSRFRDYFEQYPAKFGNKRDYIVAFDHTISNSIIEQAEIENADIIIMGWHDSKRFKYSFGDVTNDVLLSSKSQIALLKGHLPDSIKKVLVAYNGRENSVHGLSLAKKIAENTGASIRIISIVSPDEDPEKKAKIAEELEGLVKKIPSTPASFKLLERYSIEDAILEVSNGYDLTIIGDSSERFKISLLGTLSQRIARHARKPVMIVKKSKPISKESLNYLLKKYARKAYAKFRKEKGRD

SEQ ID NO: 43288 - protein, 147 aa, Oryza sativa
MSSIGAGAGGAVVGAAVAAVAVGGGAPPHVLAVDDSSVDRAVIGGILRSSRFRVTAVDSGKRALELLGSEPNVSMIITDYWMPEMTGYELLKKVKESSKLKKIPVVIMSSENVPTRISRCLEEGAEDFLVKPVRPSDVSRLFSRVLP

SEQ ID NO: 43289 - protein, 368 aa, Ashbya gossypii ATCC 10895
MSSVSMRLLALIAGWYVCSISLSLYNKWMFDPHRGLKIPYPILVTSLHQLLLWALAYLYLRARRQPQSEQAMGWRVYAYAVLPAAVACAGDIGFGNLSLQFVSLSVYTIIKSSSIAFVLVFGCLLHLERFHPKLAVVVVVMFFGVVLMAYRPDSAERGNSDETLGSLFVVLSSAMSGARWGFTQLLLRQPAGAAAKRNPVHTVLQLAPPVAVLLFPIALLIEKPFPAITETSLLSWEGHSTLQALARGALLLLFPGVAVFLMTICEFAILQAAPLLTLSIAGVVKELLTILISLLIFKDSLTLYNCIGMTVVLLDVCYYNYYRYTHPNADAKPYLPLENDPTVVWELSQIPPGDPAHQHTDVLPSVVK

SEQ ID NO: 43290 - protein, 181 aa, Oryza sativa
  misc_feature (131)..(131): Xaa can be any naturally occurring amino acid
  unsure (1)..(181): unsure at all Xaa locations
HEASCRIRHEVGCIFAELLTLKPLFQGVEAKATPNPFQLDQLDKIFKVLGHPTVEKWPTLANLPCWQNDQQHIQGHKYENTGLHNIVHLPQKSPVFDLLSKMLEYDPRKRITAAQALEHEYFRMDPLPGRXAGEKIVQYPVRPVDTTTDFEGTTSLQPTQAPSGNAAPGNQSVVPRPIPRQ

SEQ ID NO: 43291 - protein, 368 aa, Bartonella quintana str. Toulouse
MKSPTSSISFKIEKHPSPLSDEKRESILKNPGFGRFFTDHMGIIKWTKDKGWHNAVISQYKSLEINPASTVLHYAQEIFEGLKAYRAKDGRILLFRPDANAQRFIESARRLAMPELPKDIFLDAVHQLVRIDQKWVSGNPNASLYIRPFMFGNQNFLGVRPSEEYLFCIIASPVESYFKGEEKPVSVWIETDHSRAGPGGTGTAKCGGNYAASLLAQKNATENNCSQVLFLDMVEHKWIEELGGMNVCFIMADNTLVTPALNGTILPGITRHSILKLAQQMGLMIEERPYSFESLQEDAHKGHLKEVFACGTAAVVTSIGRFKYKGGEFVIGNEMIGKITQKIRTQLVDLQKGNIEDKNGWVHFVQLS

SEQ ID NO: 43292 - protein, 922 aa, Bradyrhizobium japonicum USDA 110
MTKITFELDGKQVEASPGETIWQVAKRQGREIPHLCYSPAPDYRPDGNCRACMVEIEGERVLAASCKRTPSVGMKVKTESARAVSAQKMVMELLVADQPARETSHDPDSKFWHWAETTGVTESRFPAAERWATDASHPAMRVNLDACIQCGLCVRACREVQVNDVIGMAYRSHGSKIVFDFDDPMGESTCVACGECVQACPTGALMPAVMLDENQTRVTYADKKVDSLCPFCGVGCQVTYEVKDEKVIYAEGRDGPANHNRLCVKGRFGFDYIHHPHRLTKPLVRLPNAKKDANDQVDPANPFTHFREASWEEALDIAAKGLVKIHDTNGAKALAGFGSAKGSNEEAYLFQKLVRTGFGSNNVDHCTRLCHASSVAALFEGLSSGAVSAPFSAAMDAEVIIVIGANPTVNHPVAATFIKNAVKQNGAKLFVMDPRRQTLSRHATKHLQFKPGSDVAMLNAMINTIITEGLTDDQYIAGYTEGFEDLKEKIKEFTPEKMEAICGVPAQTLREVARTYARAKSSIIFWGMGISQHVHGTDNARCLIALALITGQVGRPGTGLHPLRGQNNVQGASDAGLIPMFLPDYQPVGRDDLRGAFEKLWQQDLDPVRGLTVVEIMNAIHAGEITGMYIEGENPAMSDPDLQHARHALAMLDHLVVQDLFVTETAFHADVILPASAFAEKEGSFTNTDRRVQLARQVIKPPGDARQDLWIIQEIGKRMGLPWNYAGAGDVYTEMAELMPSLKNISWERLVREGAVTYPADDPNKPGNEIIFTTGFPTASGRGKIVPAKVIPPDELPDAEYPMVLSTGRVLEHWHTGSMTRRAQVLDQIEPEAVAFMSPKDMHKKQLAPGDFIRLETRRGAVEVKVRSDRDVPENMVFMPFCYAEAAANLLTNPALDPFGKIPEFKFCAARAERVEMRDAAE

SEQ ID NO: 43293 - protein, 242 aa, Synechocystis sp. PCC 6803
MRKIIIAGNWKMHKTQAEAQAFLQGFKPLIEDAAESREVVLCVPFTDLSGMSQQLHGGRVRLGAQNVHWEASGAYTGEISAAMLTEIGIHYVVIGHSERRQYFGETDETANLRVLAAQKAGLIPILCVGESKAQRDAGETEQVIVDQVKKGLVNVDQSNLVIAYEPIWAIGTGDTCAATEANRVIGLIREQLTNSQVTIQYGGSVNANNVDEIMAQPEIDGALVGGASLEPQSFARIVNFQP

SEQ ID NO: 43294 - protein, 267 aa, Oryza sativa (japonica cultivar-group)
MLGRAIRSMEVMVHSSTFLLPKLHQPANSPAKKYALVVLNQNLPRFVPRLWTHAKLRICADGGANRIFDEMFQMTNDPDYESTRKRYIPEIIEGDMDSIRPEVKQFYSSQGSKISDKSHNQETTDLHKCISRIHRCTPDHEKTNLCVLVTGALGGRFDHEAANINILYLFSDMRIVLLSDDCLIRLLPKTHKHEIYIESSVEGPHCGLFPVGAPSGSTTTTGLKWNLSEAKMRFGSMISTSNIVHAEKVTVQSDADLLWTISLRNLT

SEQ ID NO: 43295 - protein, 376 aa, Prunus dulcis
MTFALRKKEILIDILVRLPAKSLVRFLCTCKSWSDLIGSSSFVGTHLHRNVTGHAQAYLLCLHHPNFECQRDDDDPYFKEELQWSLFSNVTFEESSKLSHPLGSTEHYVIYGSSNGLVCISDEIMNFDSPIHIWNPSVKKLRTTPISTSINIKFSHVALQFGFHSGVNDYRAVRMLRTNQNALAVEIYSLRTDSWTMIEAIPPWLKCTWQHHQGTFFNGVAYHIIEKGPTFSVISFDSGSEEFEEFIAPDAICSLWRLCIHVYKEQICLLFGYYSCEEEGMENIDLWVLQEKRWKQLCPFIYDPLDDFYQIIGISTDNKLIMARKDFSKGGVELQLGNYESKQVLETGIKLAIMRYGESEFLFAMTYVESLALLNN

SEQ ID NO: 43296 - protein, 459 aa, Petunia x hybrida
MMRRIKSIASGRSSVSDPGGDLNLKRAKVEQDVDNMVDGETQSEERCSIANKQDVSSKSKRSTASTLNVDNELPKELNEMKIRDEKSGDHEDDTKDMEPAVVSGNGTETGQIIVTTMSGRNGQKKQTLSYMAERVVGTGSFGVVFQAKCLETGESVAIKKVLQDRRYKNRELQMMRMLEHPNVVKLRHCFYSTTEKNEVYLNLVLEYVSETVYRVSRHYSRVNHHMPIIYVQLYTYQLCRALNYMHNVVGVCHRDIKPQNLLVNPHTHQLKICDFGSAKMLVPGEPNISYICSRYYRAPELIFGATEYTTAIDMWSAGCVFGELLLGQPLFPGESGVDQLVEIIKILGTPTREEIRCMNPNYKEFKFPQVKAHPWHKIFNRRIPSEAVDLASRMLQYSPTLRCTALEACAHPFFDALREPNASLPNGRPLPPLFNFTPQELSGAPTELRQRLIPEHARK

SEQ ID NO: 43297 - protein, 446 aa, Zea mays
  misc_feature (423)..(423): Xaa can be any naturally occurring amino acid
  unsure (1)..(446): unsure at all Xaa locations
MGRHSNYKTSCLLRSKASPVSTLPLLPRRAPSKVITTEELSNPYMREDLHISVQRGTGGNWKLEFRPRRPHRPCNEPGFGGALARMVMPISSGGDHHGAEPLLPEKQRGGGAGADDAGDDFHGASFSGAVFNLSTTIVGAGIMALPATMKVLGLVPGLALIALSALLTDASIELLVRFNRAAGVRTYGKTMGDAFGVLGRGLLQLCVVVNNVGILVVYMIIIGDVLSGTSSSGVHHHGVLEGWFGENRWNGRFAILAIATLGVFTPLACVKRVDSLRYTSALSVALAVVFVVITAGIAMFKLARGQILMPRLFADVHDWPSIWRLFTAAPVLVTAYICHYNVLPIYKELKDSSQITPIVRTSLLLCSVVYVTTSFFGFLLFGDSTLDDLLANFDSNLGIPYSLLFNDAVRVSYVLHLMLVFPXVMFRALRLNMDGLLFPSARPLAC

SEQ ID NO: 43298 - protein, 373 aa, Saccharomyces cerevisiae
DYRPGGYHPAFKGEPYKDARYILVRKLGWGHFSTVWLAKDMVNNTHVAMKIVRGDKVYTEAAEDEIKLLQRVNDADNTKEDSMGANHILKLLDHFNHKGPNGVHVVMVFEVLGENLLALIKKYEHRGIPLIYVKQISKQLLLGLDYMHRRCGIIHTDIKPENVLMEIVDSPENLIQIKIADLGNACWYDEHYTNSIQTREYRSPEVLLGAPWGCGADIWSTACLIFELITGDFLFEPDEGHSYTKDDDHIAQIIELLGELPSYLLRNGKYTRTFFNSRGLLRNISKLKFWPLEDVLTEKYKFSKDEAKEISDFLSPMLQLDPRKRADAGGLVNHPWLKDTLGMEEIRVPDRELYGSGSDIPGWFEEVRDHKRH

SEQ ID NO: 43299 - protein, 519 aa, Rickettsiella grylli
MTMSQQNPSPLLLLILDGWGFNEKKDHNAIAMAHTPHWDHLLETCPHTLLDASGQAVGLPVGQMGNSEVGHLTLGAGRIIHQDLTRINNAIETRAFFKNSCLLAGFKKILSNHQSVHLIGLLSSGGVHSHENHWTALLELAAQQGIISCYLHPFLDGRDTPPQSAKIFLKRLEAKCTQLGIGKIASLMGRYYAMDRDKRWQRTKIAYDCLTLGKTNYQATNALQALQFAYDRGETDEFVSPTRITEINPSHLTINDGDLVIFMNFRADRARQLSHAFLDKSFNAFHRQLHPRLAGFISLTEYATTLPSQVAFPQQNLRNSLGDYLAQHHLSQLRIAETEKYAHVTFFFNGGNETPLINETRVLIPSKKVSTYDRVPDMSALEITHHLLKVIKEKKYDVIICNFANPDMLGHTGNLPATLHAIQCIDDCIGKITHCLKQYGGEALITADHGNAECMFDENTQQAHTAHTNKPVPFIYVGRPAKINPIKHPSLANIAPTLLYVLNLPKPQEMTGQSLLTLI

SEQ ID NO: 43300 - protein, 489 aa, Burkholderia pseudomallei K96243
MTTAHETLALKDPALLRERAFVAGEWQAADGGATLEVRNPATGALIGTVPAMGAAETRRAIDAANAAWPAWRKKTAKERAAILRKWHDLMIAHADDLALILTTEQGKPLVEAKGEIGYAASFLEWFAEEGKRVYGDTIPTPAADKRIVVTKEPVGVCAAITPWNFPAAMITRKVGPALAAGCPIVVKPAEATPFSALAMAVLAERAGVPAGVFSVVTGEPKAIGGELTSNPIVRKLSFTGSTPVGRLLMAQCAATVKKVSLELGGNAPFIVFDDADLDAAVEGAIASKYRNSGQTCVCTNRFYVHEKVYDAFAEKLTAAVAKLKVGPGTEAGVVQGPLINGAAVRKVEAHIADALDKGARVTTGGQRHPLGHGFFEPTVLTGVTPDMKVAKEETFGPLAPLFRFSTEEEAIRYANDTEFGLAAYFYSRDIGRVWRVAEALEYGMVGINAGIISNEVAPFGGVKQSGLGREGSHYGIDDYVVIKYMCVAV

SEQ ID NO: 43301 - protein, 529 aa, Ostreococcus tauri
  misc_feature (529)..(529): Xaa can be any naturally occurring amino acid
  unsure (1)..(529): unsure at all Xaa locations
GMDDALVRTASTEPAKVKVVGFDVGGKGDVGRSSAKPPVGLLRAELAGDFTCDVFDSDAYRRAMTVAPEIFAEPTVRDAFDFAAKSHAGPGLGPHFDRCVETAVTLAKLGMDTKTVAVGLLHDTLDVTSCEVDELRERFSDEIVSLVVDLSRVHRVSKLHRASGRRLEVEERAQFRAMLLAMTDARVVIVKLTARLIKMRNLQSTSASQQQKFAEETLNIYAPLAARLGIFAVKNELEDLTFKWMNPAAYAEISQVLDQREMIVSALTKLDEGLASRNAQVVDLCGRQKSVYSVYKKMMDKGHKLDEIMDLRAIRIIIADGDDDDESERTCREVLESVHSIFTPVKGRLKDYIANPKENGYQSLHSCVRDEAGTTFEIQIRSASMHRTAEYGVAAHWRYKENEKSTTSPKVDQQIQWARFMLSWQNELDDQQKIRPLRTAAAVDCGASLMPCMFPTHAHDCMFNTAEGFCQTCDAEDASPHYVIVVVDGAVSIREVKPENTLADLDFEDNRVPGGARSTEFVRISGIKX

SEQ ID NO: 43302 - protein, 567 aa, Gibberella zeae PH-1
MVFTSPDWVPKLPIDPPDSIPIAEFMKNEKYGRCPIAKSRHPFTCGITKRSYSAPQVFERSEFVARALAKRLQWQPNEGTPWDKVLAVFSLNTIDYITPIYGVHRLSGIVTPANAAYSVDELTHQLKASGAKALFTCTPLLETALEASKNVGIPEENIFLFEIPRAEPVSKFTHASIEDLVREGSELDRLDELQWVQGQGARQTAFLCFSSGTSGLPKAVMISHYNVISNVLQHTTYDSVARAKRGVTTQAVTGYLPLSHIYGLIIAAHTSPWRGDQVIILPRFELKDFLQSVQDFKIRQLLVVPPIIIQILRFKDICAKYDLSSVKFVYCGAAPLGEETIRDMSTLYPDWTIAQAYGEAHYRYKLINADTSSAKAKIIDTEGREITERDQPGELLLQAPSIVLGYLNNEKATSETFVYHHDGRWIRTGDEAIFTLAPSGNEHVVIVDRIKELIKVKGHQVAPAELEAHILAHPHVFDCAVIQVPDERAGEVPKAFVVKSSSAESLPDEEVARDIEKHVADHKAAYKQLKGGVEFLDVIPKSPSGKILRRLLRDTEREKRRGQGAKL

SEQ ID NO: 43303 - protein, 191 aa, Glycine max
MESNAPVLAEKVWSMVRVLLFMLRKGISKGKLMMDLNMMLKRRGKLAGKAIANLMSHNHNHRGSHKSQLRFSAPREYEFSCSNTPHNLFPTAGKRHRHFFACVHAPPTQDDDVVTVNAMKAVLEMLNNNDVVKVEASPALPGFGRSPIVRQLRVTDSPFPLRDSDHDNDHQVDKAAEEFIKRFYKDLKKQD

SEQ ID NO: 43304 - protein, 349 aa, Fulvimarina pelagi HTCC2506
MKSLVLERKDELSLRDFPIEREEEVLGPRDVRIKLHTVGICGSDVHYYTHGRIGPFVVEAPMILGHEASGTVMEVGSEVTTLSVGDRVCMEPGIPDPNSKATRLGMYNVDPAVRFWATPPVHGILRPTCVHPEAFTFKLPENVRFDEAAMVEPLAVGVHAATKARVKPGDIAVIMGAGPIGLVTALAALAAGCARVYVSDLAEKKLQIAESLSPAITGVDARKESIAQRVRADTDGWGCDIVFEATGSPKAAAQVFEPLAPGGCVVMIGGQPDPISYDAGAAMIREARVENIFRYAHVFPRCVAMLASGAIDVKPLITRKFSFEESVHAFETAAAAPPADVKMQIELPQ

SEQ ID NO: 43305 - protein, 376 aa, Gibberella zeae PH-1
MSFLFGRARTRTVADLPKQAREHVLKLEGPQGPSKVVTAEELARVLSQMKTILQGTPDISQEADTSPEQILQLVTGLIDEDLLHLLAVNLFRLPFESRKDTQVIFSYVFRFRPATAAPKSDPLALSYVVCNRPQVLVELCRGYDHKESATPAGSVLRELLKNEAAAAIILYDDGDEPGSSSKGLNAIDRDRPQSGRGVFWRFFDWVDKSSFEVAADAFTTFRELLTRHKDLVPRYLSANFELFFDKYNNILVQSNSYVTKRQSIKLLGEILLDRSNYSVMTAYVDRGEHLKICMNLLRDDRKMVQYEGFHVFKVFVANPHKSVAVQKILLMNRDKLLTFLSHFLEDRTDDEQFIDEREFLIKQIRNMPAVPVPPQR

SEQ ID NO: 43306 - protein, 444 aa, Xylella fastidiosa Ann-1
MNHSRSHALFVQAQTRIPGGVNSPVRAFRSVGGEPFFVARADGPYLFDVDGHRYIDYVGSWGPMIVGHNHPAVREAVQVAISNGLSYGAPCAAEVTMAETIARLVPSCEMVRMVNSGTEATLSAIRLARSATGRNYIVKFEGCYHGHGDSFLVKGGSGMLTLGIPSSPGVPTELSKLTITLTYNDFDAATALFEEMGHHIATVIVEPVIGNANCIPPRPGYLQHLRTLCTQYGVLLIFDEVMTGFRVALGGAQALYGVTPDLTTFGKIIGGGMPVGAYGGRRDLMQHIAPTGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPNIIEATLEAARTAFQTIANEAAILSKSETPIKMR

SEQ ID NO: 43307 - protein, 345 aa, Fulvimarina pelagi HTCC2506
MGRSAAPARHQPGGLRRKTMMATLSPDSLGPTICVGEILVEIMATTIGDGFREPIDLIGPFPSGAPAIFISQCARIGGMAAMIGAVGEDDFGRINTERLADDGADISAIAVDLDYPTGSAFVRYRSDGSRDFVYNIATSAAARFGWIGNVEALVSRAGHLHVMGSGLSMQSAVDVIERALPIIRERGGSLSVDPNLRKEITYDADTKKRFRNLIATADLLLPSGEELELAAGIEGEDAAIERLFEMGVKEIALKRGSAGATVFRPGAEPVSAAAFEVEEIDPTGAGDCFGGAYVASRRLGLSVEEALTYANAAGARNVTRRGPMEGAGTREELDRFIAETPRLGG

SEQ ID NO: 43308 - protein, 91 aa, Glycine max
  misc_feature (24)..(24): Xaa can be any naturally occurring amino acid
  misc_feature (40)..(40): Xaa can be any naturally occurring amino acid
  misc_feature (72)..(72): Xaa can be any naturally occurring amino acid
  unsure (1)..(91): unsure at all Xaa locations
MMRGVGGPLLTIGDLLSDLAVDDXSSATKDASVPSSPSAXQQAKRANLSDLSRLFEEHYDDLMKALQEKDPXSWPSLMLKLCAAAQHCHIG

SEQ ID NO: 43309 - protein, 374 aa, Vibrio vulnificus YJ016
MSTEKINLLDFDRKGLRELFAQELGEKAFRADQVMKWIYHFGVDDFDNMTNINKQLREKLKQKCEIVAPVVSEAQHSSDGTIKWAMRVGDQDVETVYIPEEDRATLCVSSQVGCALECKFCSTAQQGFNRNLKVSEIIGQVWRAAREVGLEKETGRRPITNVVMMGMGEPLLNMKNLIPALEIMLDDLGFGLSKRRVTVSTSGVVSGLDQMTGKIDVALAISLHAPNDKLRSEIMPINDRWDIQDFLASVRRYIASSNANRGKVTVEYVLLDHVNDGTEHAHELAQLMKDTPCKINLIPFNPYPGSPYKKPSNSRIDRFQKTLMQYEHTVTIRKTRGDDIDAACGQLVGDVIDRTKRTAMLKAAKGETIEVKAL

SEQ ID NO: 43310 - protein, 671 aa, Oryza sativa
MADQLNMGGLSMNDQPPAGARSYIPPHMRSKMGAGAGPGAPPPGPAGPDPAMNGGLNNSAWAGNQGFDARPAPGGWSGAGGPGGYPPRGGGYNNRSGFDRNAYGGAGGGAGGGGGGHARGSGDGQWRDGKHIAGPANPRVERELFGTPDDPSKQHTGINFEKYDDIPVEASGHDVPEPVREFTNPPLDDHLIRNIDLARYKIPTPVQKYSIPIVMGGRDLMACAQTGSGKTGGFLFPILSQAFQTGPSANPTAGGGGFGRQRKAYPTSLILAPTRELVSQIYDESRKFAYRSWVRPCVVYGGADIGSQLRQIERGCDLLVATPGRLVDLIERGRISLQNIKYLVLDEADRMLDMGFEPQIRRIVEGEDMPNVQDRQTLMFSATSPRDIQMLARDFLKDYIFLSVGRVGSTSENITQKVEYVEDVDKRSVLLDILHTHGAGLTLIFVETKRMADSLSDFLINQNFPATSIHGDRTQRERERALEMFRNGRCPILVATAVAARGLDIPNVTHVVNYDLPTDIDDYVHRIGRTGRAGNTGHSTAFFNRGNRGVVRELLDLLKEANQEVPAFLETIARESSFGGGGRGRGGGGRGRGRGAQTDFRKYGGGGFSSGGGGGGGFNGPPSGGFSGGGYGGPPSGGYSGGGGGYGGGGGYGGGGGGYGNPSGPGQASWW

SEQ ID NO: 43311 - protein, 469 aa, Bartonella quintana str. Toulouse
MITASDILKKITDNDIRFVDLRFTDPRGKLHHVTIDNAEISEDTFNDGVLFDGSSISGWKTINESDMVLMPDPETAHIDPFFAQSTLVIFCDVLDPVSGEFYRRDPRSIAKRAEVYMKSLGIGDTINVGPEAEFFIFDDVRYKTDPYNTGFKLDSGEFPSNDDTEYETGNFGHRPRIKGGYLPVPPVDSCQDIRSEMLTALKDMGVRVEKHHHEVAAGQHELGIRFDTLVREADKIQIFKYVVHQIAKSYGKTATFMPKPVFGDNGSGMHVHMSIWKDGKPIFAGNEYAGLSETCLFFIGGIIKHAKAINAFTNPSTNSYKRLVPGYEAPVLLAYSARNRSASCRIPMGFSPNSKRVEVRFPDPTANPYFAFAALLMAGLDGIKNKIHPGHAMDKDLYDLPPKELKEIPTVSGSLREALEELDKDRRFLKAGDVFDDDQINSFIQVKMQEVLRYETTPHPIEFDMYYSV

SEQ ID NO: 43312 - protein, 548 aa, Gibberella zeae PH-1
MGLPWEIITATSAISTLTLAWTHDDWSKSQLLGRFPVFWIAGLAVWIVWAVWVYPLLVSPLRHLPGPSGNHWLMGQSKKIMAEPSGVPMRQWASEIPNDGLLCYRGFFNQERVMVSSPKALAEVLVTNSYAFPKPSHFRWSIGRILGVGVLLAEGDEHKMQRRSLTPAFAFRHIKNLYPVFWRKAREVTRTMMAEFGQQEETQVEISGWASRATLDIIGLAGMGRDFGAIQNPNNTLAQTYSKIFKPSRQAQILAFVGMIIPMEFITKLPFRRNEDIAKAASDIRAICRDLIQEKKAKMANKEQADVDILSVALESGGFTDENLVDQLMTFLAAGHETTASAMTWAIYMMARHSDIQTRLREEIREHLPSVDSDVDITSLDIDRMPYLNAVCSEVLRYYAPVPLTMRDAAYDTTILGQTIRKGTRIVIVPWATHFDHDLWGPDADQFNPDRWLSAGGENKIGADRKAASGGANSNYAFLTFLHGPRSCIGSSFAKAEFACLLAAWIGRFEFSLANPEEMDEKNVEIRGGVTARPAKGMHVKVKVIGGY

SEQ ID NO: 43313 - protein, 131 aa, Brassica napus
  misc_feature (99)..(99): Xaa can be any naturally occurring amino acid
  misc_feature (117)..(117): Xaa can be any naturally occurring amino acid
  unsure (1)..(131): unsure at all Xaa locations
MLSGNNGNTAPQVFMNENQLQYHTNTQSNQFHLLGTMGGGGSTTVNPVNYFANDNLVPMVRPNKRGREAESISNNNNIQRQHQLQMSLNHNHSVQEEAXQENLVSTGLRLSYDDEEXTASVTSASGSIVAA

SEQ ID NO: 43314 - protein, 556 aa, Zea mays
MGASRKLQGEIDRVLKKVQEGVDVFDSIWNKVYDTENANQKEKFEADLKKEIKKLQRYRDQIKTWIQSSEIKDKKALMDARKQIEREMERFKVCEKETKTKAFSKEGLGQQPKTDPKEKAKAETRDWLNNVVSDLENQIDNFEAEIEGLSIKKGKQRPPRLVHLETSITRHKAHIKKLESILRLLDNDELSPEQVNDVKDFLDDYVERNQEDFDEFSDVEDLYSTLPMEKVEALEDMVSLAPSSLVKGVAPVSTTAVLSTKSSVATSPTQPTVSTASSQSTSQDQTEETASQESNPESTPQTPPPKGGNPGPSVPAVPIVVSTGSAAVSVPAETISSPVRLTVPATAAAVLSSAIPRSAPENTLAVTSIPANLSTTLKDDESMSVPPRRPSPAITEIGIGRGITRGTTSQALGTAPITIGPVSGNVSVSALPAINDLSKINILNTDEKINSGGLSQQLVMPLGSKVQPQQVPRTNDAIGSDSANTNENPILGGRVFSPPVVSGVQWRPQAAAAFQNQSETVCISSVNLFYYIVQLPGVLVRCLPGEPKVLCLTQPL

SEQ ID NO: 43315 - protein, 277 aa, Dehalococcoides ethenogenes 195
MRFTEGHFKGCQDYNCYYQALLPNGSPKAIVLVVHGLGEHSGRYSELAHYLADRSYAVYAYDHFGHGKTDGKAGYVSSYDVYIYDLISAFSMVQAKHPTSKIFIFGHSMGGLVTAAYASKHQYDASGLIFSSIALKPYTGMPGILNQLVKPISKIAPMLGIRKIDAATISHNKEIVKAYDEDPLVLHQRMSAQMAAEFLRICQDLPDFLKNISLPSLIIHGEEDHLVSISGSRELVQKISSKDKTLITYPGMYHEVFNEPDCPQVWNDLFFWLENHL

SEQ ID NO: 43316 - protein, 340 aa, Pasteurella multocida subsp. multocida str. Pm70
MIKDLDWKNLGFGYIKTDYRYIAYWKDGKWSKGELTQDNVLHISEGSTALHYGQQCFEGLKAYRCKDGSINLFRPDQNAERMQRSCRRLLMPEVPTDMFIDACKQVVKANQAWLAPYGTGATLYLRPFLIGVGDNVGVNPAPEYIFSIFCCPVGAYFKGGLKPTNFLVSNYDRAAPQGTGAAKVGGNYAASLYPGKEAKQNGFGDCIYLDPTTHTKIEEVGSANFFGITKDNKFITPLSPSILPSITKYSLLYLAKARLGLETEEGDVYIDQLDQFKEAGACGTAAVITPIGGIQYGDNFHVFYSETEVGEITTKLYNELVGIQFGDVEAPEGWIVKVDN

SEQ ID NO: 43317 - protein, 292 aa, Porphyromonas gingivalis W83
MTKAIKILNGSTGKHVRPLLTGLVAAVCAGKTNSTTLEAAVLLEMIHTATLIHDDVIDMASTRRGVPTLNAFFDNRVAVLMGDFVLSSALMRAIALNDIRIITIISRLGRELSEGEIRQFETADKVIIDEDIYMGVIRQKTAMLFSACAEVGAITVQAPVEIVERVKRVGELLGYAFQIRDDIFDYYRNDVGKPTGNDIREGKITLPLLFALKNEQSALRDHCLTILDQKAFSEEDLQLLTSFAIEHGGIVYAERKMAEFIDKAKAELAVFPDSDALQSLLALADFIVQRAK

SEQ ID NO: 43318 - protein, 500 aa, Triticum aestivum
  misc_feature (256)..(256): Xaa can be any naturally occurring amino acid
  unsure (1)..(500): unsure at all Xaa locations
ARGLYSACLRLPSHVNDDTQRAFVEEVMELVELNPLSGALVGLPGVNGLSTEQRKRLTIAVELVANPSIVFMDEPTSGLDARSAAIVMRTVRNIVNTGRTIVCTIHQPSIDIFESFDELLFMKRGGQLIYAGPLGPKSRNLVEFFQAVPGVPKIRDGYNPAAWMLDVTSTQMEQILGVDFAEYYRQSKLFLQTKEIVEALSKPNSEVKELTFSTKYAQPFCAQFIACLWKQNLSYWRNPQYTAVRFFYTVIISLMXLGTICWKFGSRRETQHDIFNAMGAMYAAVLFIGITNATSVQPVISIERFVSYRERAAGMYSALPFAFSLVTVEFPYILVQSLVYGTIFYSLGSFEWTAVKFLWFLFFMYFTLLYFTFYGMMTTAITPNHMVAPIIAAPFYTLWNLFCGFMIPRKLIPVWWRWYYWANPVSWTLYGLLTSQFGDLDQPLLLADGIRTTTVVAFLEEHFGFRHDFLGVVATMVVGFCVLFAVVFALAIRNLNFQRR

SEQ ID NO: 43319 - protein, 527 aa, Prochlorococcus marinus str. AS9601
MNGDLNSWDKFCNYLWFDKKLNIWLDISKINFTSKEIKNLEDKFKDVFSSIKELENGAISNIDENRQVGHYWLRNPSISPSSKIGEEIRADINSISEFGKQILNGDIKNKNNQQYTDVLWIGIGGSGLGPLLITESLQKCSKGLNFSYIDNVDPFLISEKLEELSEKLSTTLFVVVSKSGGTPEPRIAMEIIKSHCENNSLEWNSNAIAITMKGSKLFKKATSENWLKIFNLQDWVGGRTSITSSVGLLPLALINENISEFIRGASLMDETTRIRDFKNNPAALLSSAWYLTGDGIGKRDMVVLPYRDRLQVFSKYLQQLVMESLGKKFNRNGQVVNQGISVFGNKGSTDQHAYVQQLRDGIDNFFCIFIELLDSPSTNIFDEKENPKEYLSGFLQGTRSALSSENRQSITITLEKLNCFSLGALIALFERAVSFYAELVNINAYDQPGVEAGKKAAANIIEYQQKVSHLLDEGGEYSINDITSLFDNSVSEPIFFILREMCFGNDNYLVKGDWSNPNSLVIQKINS

SEQ ID NO: 43320 - protein, 192 aa, Arabidopsis thaliana
MTEQEICVRVTRAAAKRKASTAMGIDGDRVNKKRVVLGELLNVSNVNLLANLNQKKETQKPKRNLKPPPAKQIKSAPVAIIDLESKSDIDSRSDDPQMCGPYVADIYEYLRQLEVKPKQRPLPDYIEKVQKDVTPSMRGVLVDWLVEVAEEYKLGSETLYLTVSHIDRFLSLKTVNKQKLQLVGVSAMLIAS

SEQ ID NO: 43321 - protein, 541 aa, Ostreococcus tauri
MSSASRYRARLSGFSPKFKGSNPYLSSPARRAPVRARPARRPARARPVDRPPNPPHARAAVATLHTTPIARSSPRVARTRPQKRARSRPIEDIKDTHHGRSPRRCAGASAPGNHIGRADARAVTRARALTDVFGATVCVNDRVAANMTTTTRVRMPVAVEARARSTLADTPEVDELNSRVGDVPELETPELERVNAAPEEKATTKVSSEVSSSEVVGPSKKERSVEDELMTVRGAPHPVMKAPTSLNGKPALDPNRIRTISLNAPRAFLYENFLSEKECEHLLALSKGKLHKSGVVDAQTGGSSLSEVRTSTGTFISRKYDDIIAGVEERIELWSQIPQSHHEAFQILRYEPGQEYKAHFDYFFHKSGMRNNRIATVLLYLSDVEEGGETVFPNTDVPTSRNRSMYSECGNGGKALKARKGDALLFWSMKPGGELDAGSSHAGCPVIKGEKWTATKWMHVNPLAGPNDDAHNVFYDGGPRSTASCSDAQAECRGWAESGECDKNPGFMRESCKMSCRVCVGDWRDGSYVKPEEVKSETAST

SEQ ID NO: 43322 - protein, 795 aa, Vibrio vulnificus YJ016
MKFSESWLREWVNPAVTTDELTHQITMAGLEVDDVLPVAGTFNGVKVGHVVECGQHPDADKLRVTKVDVGEEELLDIVCGAANCRQGLKVAVATVGAVLPGDFKIKKAKLRGQPSHGMLCSFTELGIDVESDGIMELAIDAPIGMDFRDFLALNDVTVDVDLTSNRADCFSIRGMAREVGVLNRADVTEPSVAPVAPSIDDTVAIEVKAPAACPRYLGRVVKNVNVQAKTPLWMQEKLRRCGIRSIDPVVDITNFVLLEQGQPMHAFDLAKIDGGIVVRLAEQGEKITLLDGSEAELNADTLVVADHNKALAIAGIFGGEESGVTSETKDVLLECAFFAPDHIRGRARSYGLHTDSSMRFERGVDYALQVSAMERATALLVEICGGEVAPVVAVESEAELPKPNKVALRRTKLDNLLGHHIADSDVVEILERLGMTVETTAEGWVAVAPTWRFDIAIEQDLVEEVGRIYGYDNIPNQNPAAALKMHDHQEANIPLKRVRDLLVDRGYHEAITYSFVEPEQQKLVVPGVDALILPNPISAEMSAMRLGLIQGLLNTVVHNQKRQQPRVRLFEYGLRFIPCDTAENGMRQEPMLAGVIAGTRSEEHWNIDTNTVDFFDLKGDVEAILELSANDKAYSFVAAKHPALHPGQSAAIVVDGKEIGVIGTVHPELERKFGLNGRTIVFEIEWSAINRKVIPEAVALSKFPANRRDIAVVVDEAVASGDIVNACLEVGGEFLKAAKLFDVYVGKGVEEGKKSLAIALTLQSNERTLEDADIAGAVDAIVAHVSEKFGASLRD

SEQ ID NO: 43323 - protein, 229 aa, Pasteurella multocida subsp. multocida str. Pm70
MKKIEQLFANNYSWALRMKEENSSYFKELADHQTPSYLWIGCSDSRVPAEKLTNLGPGELFVHRNVANQVIHTDLNCLSVVQYAVEVLNIEHIIICGHTNCGGIKAAMADQDLGLINNWLLHLRDIWYKHSHLLGNLPPEKRADMLTKINVAEQVYNLGRSSIIKSAWKNGKKLSLHGWVYDVNDGFLIDQGVIATSRESLEISYRNAIARLLKLNEDEILKKDQDEEA

SEQ ID NO: 43324 - protein, 419 aa, Burkholderia pseudomallei K96243
MNANLHAFTAADAAPSTEYWWARERLHYRGNALHFCGRDVAELAAAFAEPVFLYDPQRALDNVARLQRALGDLQRGDFRLHYAMKANRFRPLLSELRRSPLFGIDACSPEELREALACGFAPERISYTAHGMMPDEAALLAALPGVHVNCDTLSAIALLGSRSPGREIGIRVNPGVGIGYGDSERLSYAGAAVTKFGIYAEQFGAALELAARHGLAVTWLHCHAGCGYLDAQLESFERVLDALDAFAARVPGLRGINLGGGLGLPHRATDRPLDLERWRAAVHARFGGRPLAIAIEPGDFIAKDAGMLVLRVAYVELKRNRRFVGLNGGFNLAIEPAFYDLPCEPVPCVRRPGPAQSVCVAGNINEALDVWGNDVSLPPVEPGDFIALLNAGGYASSMSSNHCLRGQFRELALFDAAPH

SEQ ID NO: 43325 - protein, 321 aa, Colwellia psychrerythraea 34H
MKNFKELAKNVIEIEQQAIAELVQFIDDNFELACQLMFHCKGRVIVIGMGKSGHIGGKIAATLASTGTPSFFVHPGEASHGDLGMVTSNDVVLTISNSGETSEVLAIIPVIKRIGAKLISMTGNTESTLAKLADTHVCIKVSAEACPLGLTPTSSTTATLVMGDALAVALLNARDFTAEDFALSHPGGSLGKRLLLRLSDIMHKDDRVPMISENALIKDALVEMSLKGLGMTAIVNEQQQLVGLFTDGDLRRVLDNRIDIHSESINTVMTHNPSVAQSDMLAAQALKIMEDKKINGLIIVDSNNIPVGAMNMHDFLSSGVL

SEQ ID NO: 43326 - protein, 304 aa, Prochlorococcus marinus str. AS9601
MHEFLPYAWFEGKCIPFKEAKISIATHALHYGTAAFGGMRAIPNPKNKEEFLLFRTDKHIKRLSQSAKLLLTEISEEYIYKALEEVIKRNKPEKPIYIRPFVYTSDLGIAPRLHNIETNFFIYCIELGDYLSPDGVSCRMSSWSRQEDRSLPLRGKISGAYITSSLAKTEASLSGFDEALLLNSSGKVSEASGMNLFIVRNGDLITPGVDQDILEGITRASVIELAKSFGINVIERPVDKTELLIADEVFLTGTAAKITPVKKIESTELNVERPIMNKLKSKLIEITEGRSQDYDNWVTRISLK

SEQ ID NO: 43327 - protein, 517 aa, Vibrio vulnificus YJ016
MTKNIHDQRILILDFGSQYTQLVARRVREIGVYCELWSWDVEEADIREFNPDGIILSGGPESVTEDNSPRAPQYVFDSGVPVLGVCYGMQTMAEQLGGKVSTSDEREFGYAAVKVSGESAIFKDLEATQDVWMSHGDKVVEIPAGFTKVGETDTCPYAAMANEEKKYYGVQFHPEVTHTKNGLQMLENFVLGVCGCERLWTSESIIEDAVARIKEQVGDDEVILGLSGGVDSSVVAMLVHRAIGDKLTCVFVDNGLLRLNEGQQVMDMFGDKFGLNIIKVDAEERFLKALEGKSDPEEKRKTIGHVFVDVFDEESKKLKNAKWLAQGTIYPDVIESAASKTGKAHVIKSHHNVGGLPDDMEMGLVEPLRELFKDEVRKIGLELGLPYEMLYRHPFPGPGLGVRVLGEIKKEYCDLLRRADAIFIEELHAADLYNKVSQAFTVFLPVRSVGVMGDGRKYDWVVSLRAVETIDFMTAHWAHLPYDFLGKVSNRIINEVNGISRVVYDISGKPPATIEWE

SEQ ID NO: 43328 - protein, 543 aa, Lactobacillus sakei subsp. sakei 23K
MKAQQILNDPFLNKGTAFTAEERAQFGLTGMLPPHVQTIDEQVKQAYAQYQSKANMLEQRIFLMSIFNENRVLFFKLFSQHVAEFMPVVYDPTIADTIENYSALYVNPQHAAFLSIDDPDSMKTTLANAADGREIKLIVVTDGEGILGIGDWGTQGVDISVGKLMVYTAAAGIDPSQVLPVVLDAGTNRESLLNDELYLGNWHERVRGDRYYDFVDQFVQTAEELFPNMYLHFEDFGRSNAANILNKYKDQIVTFNDDIQGTGIITLAGIMGALNISGGKMTDQVYMSFGAGTAGAGITHRIFEEMLQEGLTEEQARSRFYMVDKQGLLFDDDPELTPEQKPFARKRSEFANADELTTLEAAMKAIHPTILVGTSTQPGTFTESIVKEMAAHTERPIIFPLSNPTKLAEATAEDLIKWTDGKALVATGIPAAPVEYNGVTYEIGQANNALVYPGLGLGTIASTAKVLNDEMISKAAHSLGGIVDPTEPGAAVLPPVTKLDVFSQTVANAVAQSAVDQGLNKEEIADVQKAVADMKWEPEYKAL

SEQ ID NO: 43329 - protein, 257 aa, Thermus thermophilus HB27
MVVTGAGSGLGQALALELLRRGARVAAVDLRSEGLQETMAKAGSLGEGLSLHPLDITDKEKVAALPEEVERVHGQVDGLINNAGIIQPFKRLLDLDEAAMERVMRVNFWGTLHMTRAFLPRLLKRPEAHLVNVSSMGAFVPVPGQALYGASKAAVMLLTEALWAELQGTPVRVTLVLPGAMRTGIAEHSGVEAPRAEGAKVPVLEPEVAAKRLLDAVERDAFRVLLGRDAQTMDLLYRLSPALAARIVQRRMAHLLT

SEQ ID NO: 43330 - protein, 122 aa, Lactobacillus sakei subsp. sakei 23K
MSEKIYTKQAPEPLGPYSQAIATNKIVFMSGQLGLKDGKLAPDLAGQTKQAIMNLQSVLKEAGLSLENIVKTNCFLTNLDDFNEFNQVYAEFFGDIAPARSAVQVGKLPAGGIVEIEAIAVR

SEQ ID NO: 43331 - protein, 375 aa, Medicago truncatula
MEGKLSRAAKKLTSSPIQELSHLAQRCNAINLAEGFPDFPAPLHIKNAAVSAINSDLNQYRHVQGICEHLAKIVKEMHGLDIDSETDVAICCGQTEAFAAAIFATIDPGDEVILFDPSYETYQGCVTMAGGVPSLNSPHNPTGKVFTKDELETIAGACCSRNCLAITDEVYEHITYDNQKHISLASFPGMQERTIITSSLSKTFSVTGWRIGWAIAPASIASAIRNIHIIVTDSAPAPFQEAALTALRSPPEYFESLRRDYQSKRDYIIKLLAGVGFKIQFIPQGSFFLFAELPEDCPLSDVEFVKKLILEAGVVAVPGQGFFHTNLSTNETSSASCNYQKRYIRFAFCKSETTLAAVSEKLGKLLDVEGKLALY

SEQ ID NO: 43332 - protein, 186 aa, Mycoplasma penetrans HF-2
MPSFIKSCFSSNDWITDDKKEICFIGRSNVGKSSLINALANAKIAKTSNTPGRTQLANFYDFDKFRLIDLPGYGYAKVSKSKHFELSKIISEYIYLRKNLVAVFQIIDISVITDLDLQMSELLSNRFNQHYIVLNKADKEAKSYFDNNFAKIAAKLKKDKENIVCVSAKNKTNIPNLKKLIGSVIL

SEQ ID NO: 43333 - protein, 883 aa, Clostridium thermocellum ATCC 27405
MAKYVYLFSEGNASMRDLLGGKGANLAEMTSLGLPVPRGFTITTEACTRYYQDGKVIAKEIEDEIYRTMEKLEEIVGKKFGDPSNPFLVSVRSGARVSMPGMMDTILNLGLNDEVVVGLAKLTNNERFAYDSYRRFIQMFSDVVMEVEKSKFEAILDAVKEENNCENDCDLSAENLKEVVRRYKELFKKEKGFDFPQDPKTQLMEAVKAVFRSWENPRAIVYRRLNDIPGDWGTAVNVQEMVYGNMGNDSGTGVAFTRNPATGEKKLYGEFLMNAQGEDVVAGIRTPQSIDQLKEVMPDVYNQFVEIAEKLERHYRDMQDMEFTIERGKLFMLQTRNGKRTAAAALKIAVDLVNEGMVTKEEAILKVDPKQLDTLLHPNFEPSALKNAKPIAKGLPASPGAATGKIYFRAEDAVEATKNGEKDIILVRLETSPEDIEGMHVSKGILTGRGGMTSHAAVVARGMGTCCVAGCSEIRINEEEKYFVDKNGKKYVEGDWISLDGSTGNVYGEKLPTVEPEMTGDFATLMQWADEIRTLKIRTNADTPADAIQARKFGAEGIGLCRTEHMFFDSDRIPAMREMIVARTEEQRRKALDKLLPMQRKDFEELFTAMEGYPVTIRFLDPPLHEFLPQEDEDIEALAKEMGITFDELKAIVTGLHEFNPMMGHRGCRLAVTYPEIAEMQTRAVIEAAINVSRKNIKVVPEIMIPLVGDVKELKYVKDVVVRTANELIEKSGVKIEYKVGTMIEIPRAAITADEIAKEAEFFSFGTNDLTQMTFGFSRDDAGKFLEEYYNKKIYEFDPFAKLDQDGVGKLVEMAAKLGRQTRPDIKLGICGEHGGDPSSIEFCHQIGLNYVSCSPFRVPIARLAAAQARVNEIKGTKDLGQK

SEQ ID NO: 43334 - protein, 415 aa, Spinacia oleracea
MASIGPATTTAVKLRSSIFNPQSSTLSPSQQCITFTKSLHSFPTATRHNVASGVRCMAAVGEAATETKARTRSKYEIETLTGWLLKQEMAGVIDAELTIVLSSISLACKQIASLVQRAGISNLTGIQGAVNIQGEDQKKLDVVSNEVFSSCLRSSGRTGIIASEEEDVPVAVEESYSGNYIVVFDPLDGSSNIDAAVSTGSIFGIYSPNDECIVDSDHDDESQLSAEEQRCVVNVCQPGDNLLAAGYCMYSSSVIFVLTIGKGVYAFTLDPMYGEFVLTSEKIQIPKAGKIYSFNEGNYKMWDDKLKKYMDDLKEPGESQKPYSSRYIGSLVGDFHRTLLYGGIYGYPRDAKSKNGKLRLLYECAPMSFIVEQAGGKGSDGHQRILDIQPTEIHQRVPLYIGSVEEVEKLEKYLA

SEQ ID NO: 43335 - protein, 197 aa, Rhodopseudomonas palustris CGA009
MRTATIKRKTKETDIEVTVDLDGTGVANAATGIGFFDHMLDLLAKHSRIDITVKAVGDLHVDFHHTTEDVGIALGQAVKQALGNMAGITRYATVLMPMDETLTRVVIDVSGRPFLVFKADFPRDKIGEFDTELVREWFQAFAMNAGVTLHVETLYGENSHHIAESCFKGLARALRAAVAIDPKTAGEVPSTKGQLGG

SEQ ID NO: 43336 - protein, 1041 aa, Yarrowia lipolytica CLIB122
MDSDHGGYHDPHDSHADSSDVTDSDNRPQNLRINKIKKPLFRRFQSEQTVTTSSASGWDANDTNDTNDSENDSATSPAKHKRRPSTRAQLKAPQTQSQPQSPVLKSKHHGPQHNSLRAVSNGTKRLASRFHLGNFSLRSPKIQRKHSSYFTDNEDSDDERLVWGDRDDTQPLMSQSDYGGQFSYGSVEFPNPPTLKLPPADHTNHGIVHKASQFMQSRVGIQSMMSDTGPERRFYDDFTTVDWVRDTINDSSRVKYIQSIPGFRGRLIRSFDSLQDWILISVVAASFALIAYSIDRVEETLFDFKFGYCSSSWLSPRGECEGEWMLWSDLTSFEIPYLSAHHFNFLVYLLIMLLLAFLAVRLTLRTKTSSPISLKDNKPRVFYTAYGSGVAEVKTILSGFVIRRFLGTHTLVYKSVGLVLAVSSGLCLGKEGPYVHLATCVGNIACRLFTKFSHNDLRRRQILAAAASAGVALAFGSPLGGVLFSLEEVSYMFMPAQLFRVFFCAMTSALFLKLLDPYKTGKIVLFEVKYTQDWHSPEIFVFVILGICGGIFGALFCKFSAWWPQKVRAPGKIFHGHHTIEVLVVTLITGLTSFSSPFTRQSVAELLYQLASPCDPDNPALSKLCPTSISEIPGVAKALSWVLVLKIFLTCITFGIKVPAGIYVPSMIIGALFGRVLGLGTQLLYHQMLNEKESGVLSIFATPFLGTLATCPGGALQCITPGTYAMIGAGAFMAGVTRMNVTLAVILFELTGSLDYVLPFSIAILVANWVANLIEPKSVYELQIKKNDYPFLDNRKTLAFDSSLADLVSHFPRKLCIEMDEGDEDGSAKVTVGQLKEMLAQVQVRNGIDGSIPLVRNDNVVGLLPALELEVALDRISQWYEEVAGVVVAESEASGLRSPTSTETTGLKLSLPIPPTFPPTTIVPPSSLDSIVCTVSVKDVDITKFHHYYVGVKARETCETDPEETSNSSSCEDGLLPFEATDLTQFVDRAPLALDVHSPLTLVQMMFSKLGVRQICVVEDGQFVGVLHKKKFIDFCNNQEK

SEQ ID NO: 43337 - protein, 470 aa, Burkholderia pseudomallei K96243
MLINGLCIEGGGEPLPIVDPATGEPLAAPAAASAADLERAVAAAEAAFPAWRATTPATRASLLLALADEIDRQAGALARIESRNTGKPLHLVVQDELPAVADCFRFYAGAARTASGPSAGEYVEGHTSMVRRDPVGVVAQIAPWNYPLMMAAWKLAPALAAGNTIVFKPSEWTPLSIVALEAALARIFPAGVVNIVLGDGASVGRALATHPRVRMISLTGSVEAGKSVLAAAACNLKRTHLELGGKAPVLVFDDADLDAAVAGIRYAGFYNAGQDCTAATRIYVQRGIYDTLAQRLADAASTLRVGPPDRADAEMGPLVSAAHRARVERFVREAAALRHARVLTGGAPLPGPGCYYAPTVIAGVRHDDAPMRREAFGPVVTLTPFDTESQALRWANDSEYGLASSVWTRDAARGMRLAACIDAGVTWVNAHFTYTADMPHGGTKQSGYGSDLSTLGLADYTQPRHVMWRH

SEQ ID NO: 43338 - protein, 473 aa, Burkholderia pseudomallei K96243
MAYRNDSLLTSAQQDTRHLLHPWADLSALGRETPTVIVEAQGTRVTDAEGRTYLDAIGGMWCVTLGYGRREIADAIRDQALRMPFYTPFGAMTNEPAAALGARLAALAPGDLKRVHLTTCGSTAVESALRFAHYYFGATGRPHKRHIVTRGDAYHGSTYLAASISGKAWDRTCFHYDSTIVHHLSSPNPYRRPAGMSVDAFCASLVDEFDALIAKLGAEQIACFIAEPILASGGVIVPPPGYLAAMRERCRRHDILYISDEVVTGFGRVGHFFASHAHFGIEPDMIVVAKGLTSGYQPLGAVLISERLVDAVSGEHAYGNGVFTNGFTYSGHPVACAAALANIELMERERICEHVRDVGPYFIRRLDALRRLPIVGDVRGDHLMACIECTSGAGATGALPTPADIAIAQRVDRHCEEMGLLVRPYESMCILSPPLTVTRADIDEICAILAAALERAQRELAQHAPVREENETC

SEQ ID NO: 43339 - protein, 459 aa, Zea mays
MGIGDGSSNGNQQPVHKEIRDETTPLLPVKVEEDEGFHEFNGASFSGAVFNLSTTIVGAGIMALPASIKMLGIIPGILLIILVALLTEASIDMLVRCSHQGKITSYGWLMGEVFGQWGRIALQASVIINNVGVLIVYMIIIGDVLSGTTSGDVHHRGILEGWFGAHLWNSRAIVLLATALLVFAPLVSFKRLDSLRYTSALSVALAVVFVVITAGIAIIKLFNGTVAMPKLFPELDGLNSIWNLFTAVPVLVTAYICHYNVHSIDNELEDRTQIKPIVRTSLFLCSSVYIATSFFAYLLFGEGTLDDVLANFDANLGIPFSSVFDDIVRVSYAAHVMLVFPIVFFALRLNLDGLLFPTSRHISRDNKRFAIITVSLLAVIYLAAILIPSIWDAFQFTGATAAVLIGFIFPAMVILRDSYGIASKRDKILAVTMIVLAVLSNSVALYSDAMNIFRKKEVA

SEQ ID NO: 43340 - protein, 418 aa, Oceanospirillum sp. MED92
MDNFEYRNGQLCCEDVALAGVAEEFGTPTYVYSRDALERAYLAYADALEGHKSLVCYAVKANSNLAVLNVLARLGAGFDIVSVGELERVLRAGGDAAKIVFSGVGKQPHEIQRALEVGIRCFNIESEAELERVNEVAGSEGKVAAISFRVNPDVDAGTHPYISTGLKENKFGIDIDDAVRIYSRAADMDHVDVVGMDCHIGSQLTEVDPFLDALDRVLMLVDKIAEQGIKIKHLDLGGGLGVCYTDEVPPTPQEYIAEVLKKVEGRDLELIFEPGRSIAANAGVMLTRVEFLKCTGEKNFAIIDGAMNDLIRPSLYSAYQEIVPVMLRETGEEQQWDLVGPVCETGDFLGKDRSLNLEAGDLLAVCSAGAYGFVMASNYNSRGRPAEVMIDDNKSYLIRKRESLADLVKGEQLLPKDR

SEQ ID NO: 43341 - protein, 351 aa, Ipomoea nil
MSRPQEPHRPFFSFGNPLRMILPKGSHLSPRLISLLKSFEESLAGKLKSLIPGGGEDVISLLWMQQAIVSLSQIHIETKELITALEFPASDWDEKWIDVYLDNSVRLLDICTSISSEITRINQANLFLSCAVHYLEGEEKQIMQACSSLNGWRQHMNSQNPRLERCFEKLNTLTESLNLPKIKNSAKGKVLMQALYGVRMVTIFICSVFAVAFSGSVGNLKELEVLETCLWADAYVDLQGFINREMRNIYSSGAATALKDLEAIHASVEKLHPIIQDGVNPIGADVLPHETSGLAKMADRLSKGLDGLAKEVDGFFQIVLTGRDALLCNLRIGSNNASPSQENNAEQPTLR

SEQ ID NO: 43342 - protein, 1198 aa, Pasteurella multocida subsp. multocida str. Pm70
MTYQLLPKLTSLREPLSQHYRIDETTLVQKLLSDAEIPSDLQTKIQQLARKLVENVRNARQNASGVDALMHEFSLSSQEGVALMCLAEALLRIPDKATADKLIRDKISKGNWRSHIGQSPSMFVNAAAWGLLITGKLVSTHSEQQLSSSLTKLIAKGGEPLIRKGVEVAMRLLGKQFVTGETIEQAIKNGEKRFQQGFRYSYDMLGEAALTEEDAARYYQDYVDSIHAVGQRSSGLGVYAASGVSIKLSAIHPRYSLSQHQRVIDELYPKVKQLFLLAKQYDIGLNIDAEEADRLDISLDLVDRLLADPDLAHFNGIGLVVQAYQKRCTFVIDYLIEQARKHQHKIMVRLVKGAYWDSEIKRAQTDGAEGYPVFTRKVHTDVSYIACAKKLLAAQDVIYPQFATHNAQSLATVYHLAQGKQFEFQCLHGMGETLYDQVVGKHNLNVQCRIYAPVGSYKTLLAYLVRRLLENGANSSFVNHIVDDSIPVEALILDPVQKAKETEGTMHPKTPLPRDLFAGKRVNSKGYDLTDALQLQQLQNALTELSQNEYEAYPLLENTTAPTGKPRLVFNPAKRAMLVGKVIDAREEDVEQAFENALRHKDNWANTPVEQRAVILEKMADLMEQHMPQLFDLAVREAGKTLNNAIAEVREAVDFCRYYAQEARKLGNENPPRGIVVAISPWNFPLAIFIGEVCSALVTGNVVIAKPAEQTSLMAHFAVKLFQQAGLPIGVLQCLCGAGKVIGEKLVSDARVDGVIFTGSTDTAKRINQNLAKHNKLIPLIAETGGQNAMIVDSSALAEQVVLDVLNSAFDSAGQRCSALRVLYVQHDVAPHILTMLKGAMAELKVGNPQHLTTDVGPVIDEMAQKRLLQHIETMRTVAKDCYQVPVDPEMQQQGIFVPPTLFELENLHHLKHEVFGPVLHVVRFHASEFNQVIAQINSTGFGLTSGIHSRIDESINHWLEQVHAGNLYVNRNTVGAVVGVQAFGGRGLSGTGPKAGGPFYLQRLVHAKHWALTPLHYNTPRDLSDLAAKVRSIFTKSEQAPLLSLIDQVAQCSPLNTTFRMQGITGEENYLTFTPRSLIAIGNGPLAQQMQALIAVAAVGATAVISKYSQLAAYEKRLADYLFVAEVEECEEISQLIVLDPITAKQKAQYADRPGAILTYVEQLDLALSLFPLLHEQAISINTTAAGGNASLMAEMD

SEQ ID NO: 43343 - protein, 252 aa, Picea abies
MPFRGVAIGRPEEVTHPTAFKAALAELISTLIFVFAGEGSGMAFAKLTSDASTTPAGLVAVALAHGLGLFVAVAVGANISGGHVNPAVTFGALVGGHITLLRGILYWIAQLLGAIVACLLLKFTTGGLSTPIHSVASGMNTGEGVVMEIVITFALIYTVYATAADPKKGDLGTIAPIAIGFIVGANILAAGPFSGGSMNPARSFDPAVVSGDFTDNWVYWVGPLIGGGLAGIVYRGIFIGDDLHVPLPVSDF

SEQ ID NO: 43344 - protein, 1077 aa, delta proteobacterium MLMS-1
MPKRTDLKKILIIGSGPIIISQACEFDYSGTQAVKALKEEGYQVVLINSNPATIMTDPEIADATYIEPITPEFVAKVIEKERPDALLPTLGGQTGLNTAIQVAEMGILEEYGVELLAARIDVIRKAEGRDSFREAMRKIGIKVPQSEIIHTLSEAKAAAAEIGFPIIVRPSYTLGGTGGGIAYNQQELEKLCITGLDLSLNSEVMLEKSLLGWKEYELEVMRDNKDNVVIICSIENFDPMGVHTGDSITVAPAQTLTDREYQAMRDASLAIMREIGVETGGSNVQFAVNPADGELMVIEMNPRVSRSSALASKATGFPIAKIAAKLAVGYTLDEIRNDITRETYASFEPTIDYCVIKIPRWTFEKFPEAEDTLTTAMKSVGETMAIGRTFKEALQKGLRSLEIGISGFGADPKFEKCADLDEADLENALRQPSSQRIFQLYEALRRNLEIDQLFAITAIDPWFLHHLAGIVAREGEIRAAGFPGLEAELLHRVKRDGFSDRQLAYLTGTSEDDIRELRENLGKKPVYKLVDTCAAEFEAYTPYYYSTYEQEDEGRETSRRKVMILGGGPNRIGQGIEFDYCCVHASFALREMEIESIMVNSNPETVSTDYDTSDRLYFEPLTREDVLNIIEKEQPEGVIVQFGGQTPLNLAVPLARAGVPILGTTPDSIDRAEDRQRFQQFLQKLNLLQPANGLARSGDEALAVAKEIGYPVVVRPSYVLGGRAMRIVYNERDLNQYMTFAVEASPEHPVLIDKFLKDAVEVDVDAISDGDSAIIGGIMQHIEEAGIHSGDSACVLPPHTLEPAMIEEIKEATRAMAKELRVKGLMNVQFAVQDRTLFVLEVNPRASRTVPFVSKATGVPLAKLATRVMMGQSLAQLGLTTEREIKHFAVKEAVFPFDRFDNVDTILGPEMKSTGEVMGIDDCVGLAFAKSQLAAGQKIPLQGTIFLSVRHPEKPAIVPLARKLSELGYQLVATAGTAELINEQGIACDTVRKISEGRPHVLDMIQNHQIQWIVNISMGTRTTEDSYTIRRAALAFHLPYTTTLAGAQSMVQALATMRDKNMEVKPIQEFQQAGGFS

SEQ ID NO: 43345 - protein, 865 aa, Thermus thermophilus HB27
MAKRVYLLSEARGLSRDLLGGKGHGLAEMAAAGLPVPPAFVVTTEACRQYLRTGEVPGLWEEVRAGMAALEGLTGKRFGLGEGKAPPLLVSVRSGAPVSMPGMMDTVLNLGLTLEGVEALARATGNPRFAWDSLRRLLAMYGEVVLGERPEVFEGMLSALKAERGVGTDAALGPEDLEELAYRYLRHLEARGTPFPLDPWAQLQGAIEAVFKSWQNPRARTYRRIYGIPEDLGTAVVVQAMVFGNLGEDSGTGVGFTRNPATGEKGLYGEYLRNAQGEDVVAGVRTPEPLERLKGYAPGLYEELLQVAERLERHFRDMQDFEFTVERGRLFLLQTRAGKRTAQAAVRIAVEMAEEGLISREEAVMRVEANALPGLLRPSVDRDQAPRPLLKGLPASPGAAVGHAAFTNEAVERFHAQGLPAVLVRPETTPEDITGMYLAKGILTARGGLTSHAAVVARGLGVPAVVGAEALRVFPGEGRALAEGVEIREGDLLTLDGGTGEVYLGAVPLVEAGGEALLEKLLSWAEPHRRLGVRANADTPEDARRARAFGAEGIGLCRTEHMFFREDRLPWVRRLILAETPEEEALALERLFCFQKEDFKEILRAMDGLPVTVRLLDPPLHEFLPPLEALARRAEEGDEEAGRLLRRAEALKEANPMLGFRGARLLLLRPGVFRMQLRALLEAAKELREEGHDPRPEVMVPLVADPKEVERARALAEELFREYGPIPFGTMVETPRAALLAAEIAPLVDFFSFGTNDLTQMAFGLSRDDAGKFLPRYVEEGLFPFDPTERLDEKGVGRLLRMAAEEGRKANPRLKLGLCGEHGGEAGSVRFVADLLDYTSASPFRVLTARLAAAQAGLSRALKPA

SEQ ID NO: 43346 - protein, 262 aa, Ipomoea nil
MVSTESSREENVYMAKLAEQAERYEEMVEFMEKVAKTVDVDELTVEERNLLSVAYKNVIGARRASWRIISSIEQKEESRGNEELVKTIKEYRGRIEAELSKICDGILSLLESHLVPSASTAESKVFYLKMKGDYHRYLAEFKTGAERKEAAESTLLAYKSAQDIALGELAPTHPIRLGLALNFSVFYYEILNSPDRACNLAKQAFDEAILELDTLGEESYKDSTLIMQLLRDNLTLWTSDTADDGGDEIKEASKRESGEGPQ

SEQ ID NO: 43347 - protein, 411 aa, Synechocystis sp. PCC 6803
MPGGVSSPVRAFKSVGGQPIVFDRVEGAQIWDVDGNQYIDYVGTWGPAICGHAHPDVISALKQALDKGTSFGAPCAQENVLAEMVIDAVPSIEMVRFVNSGTEACMSVLRLMRAFTGREKIIKFEGCYHGHADMFLVKAGSGVATLGLPDSPGVPSNTTKATLTAPYNDLEAVKALFVENPDSIAGVILEPVVGNAGFILPDAGFLEGLRELTKEYGALLVFDEVMTGFRVSYGGAQARFGITPDLTTLGKVIGGGLPVGAYGGREEIMAMVAPAGPMYQAGTLSGNPLAMTAGIKTLEILQKPGSYEYLDKITKRLVDGLLAAAQDAGHEVCGGSISAMFGIFFAPGPVRNYEDAKLADTNKFARFHRGMLERGIYLAPSQYEAGFPSLAHTQEQIDQTIAVAKEVFATL

SEQ ID NO: 43348 - protein, 255 aa, Ipomoea nil
MIRTAAGKAKVVGTILCVGGAMLLSFYHGHNIGIGESSIHWKYADHLSSQNKDNNGSTNAQPNFILGPFLIIVSALSWAIWSIIQTRVSEKYPAPYSSTALMCFMSSIQCVLFAICFDHKPTDWSLRQGIRATSAVYAGIVGTALAYCLMSWCIEKKGPLYVSVFNPLLLVIVAVLSWGLLQDKIYVGTIVGSVLIVVGLYGVLWGKQKELQVIGVVHVDEEEARNEVETKEDHLEELELSAHSIITVDQFPKKN

SEQ ID NO: 43349 - protein, 619 aa, Coccidioides immitis RS
MLHVVHHHGTEPTEYLFDDAVKRQGAIPAVISEDCRYVAVVNDRCLELHQTAQEDSLLRLIFLHDDIKGGLRFLQWSKPSCLTKSSIQRVLCASNAHISVFDPEDETWAAEIDAGEGTCFVHVDFTPSADEIICFLEFNVQAMVFNLKTGEQRIIKAPKFSGPNGYVFRPRSGHLALLLKVEGNDILSVHEPGTYGCIATATLQMVDVQGLKCSPNGAWIACWGASLAGTAVAIYTADGQYFRTYTGAGNEIGFGVKTIEWSPDSRILALGKQGGTIELINGKTFGLAMALGDPMSVPIERNVYTENSSVVLEREYTLAPESPVFPFTYTIAAGTRTISALLFNPIGTMLATIDQGLPHIVWMWSIRNFTPHLIGALVQKSNIKHMLWSNEKPELLMTTNDDDVATVHQWICGRAPRIVPIPRADGGKYNASWVRDAGGLVWFAWHAGYTMGYPLGSGHSAEFRHHHPCWVKLNAAKRGLRAKARLVIPHSQFRNIQQTWTDDLEVRVEHSVDNCTSSSSIMAPAASSGGKKQKKKWSKGKVKDKANHAVVLDKTTSEKLYKDVQSYRLITVATLVDRLKINGSLARKALADLEEKGQIKKVVGHSKMNIYTRAVTASE

SEQ ID NO: 43350 - protein, 586 aa, Coccidioides immitis RS
MGVEHKQGSGMIADAEAMRVASWDEGLQKQPEGSFAQRIINSFKRDPNAYISQPISSNTEGFDAEGAAAATAASPLKRRLKSRHLQMIAIGGSIGTGLFVGSGRSLATGGPASVVIAFCLIGIMLYATIHALGELAVMYPVAGAFAHYSTRFLDPAWGFAMGWNYAILWLTLLPLEIVAAAITVGYWEADVSPAAWVAMFYVLIVVINLFGVLGYGEAEFVFSIIKVIAVIGFIILGIVLNCGGGPNGDYIGGRFWHNPGAFNNGFKGLCSVFVTAAFTFGGGELVGLAAAETANPRKSIPTAVKQVFWRIVLFYIVSMVIVGLLVPYTDERLLNGSSTDVKASPFVIAISDAGIKGLDSVMNAVILISVLSVGNAAIYGSSRTLTALAEQHQAPALLAYIDRKGRPLMSILVASCFGLLGFLAATPKQQEAFTWMLAISGLSSVFTWASICLAHIRFRRGWKIQGHSLDELPFRAQGGVITSWIGFIINCIVLVAQFWTGFAPIGYGELSHSERVKTWFSTYLAAPIVLTFYITYKLWYRTSIVHAKDMDLTTGRRDLNLQHLIAEEKAERESWPKWKRVYKAFC

SEQ ID NO: 43351 - protein, 380 aa, Prunus dulcis
MTFTPRKKEILIDILVRLPAKSLVRFLFTCKVWSDLISSSSFVSTHLNRNVTKHAHVYFLCFHHPNFECLVDPDDPCFEQELQWSLFSYETFEQCSELSHPLGSPEPYRIYGSTNGLICISDAILSLESPIHIWNPSVRKLRTLPMTTNNIEFSYIDLHFGFHPGVNDYKAVRMMGIDKDAFAVEIYSLSTDSWKRIEVIPPWLKCDWQHYKGIFLNGVVYHLIEKGPTFSLMSFDSGNAEFEEFITPGAICRSRGLFIAVYKEQICLLFDFYCCEEEGMEKIDFWVLEEKQWTQLAPFVYPSDSYKIIGISIDNELLLRKHDFSSVGLADLYLCNYESKQVRQAGIKLAVMEYGHHELFFATTYIESLLFLNKSLKRDV

SEQ ID NO: 43352 - protein, 514 aa, Prochlorococcus marinus str. AS9601
MTFVITTPLYYVNDKPHLGSVYTTIICDSIARYKRLAGEEVIFITGVDEHGLKIQRTANEKGIPPKSHCDEISEIFNNNWKDWNISFDKFIRTSSKNHEFVVNEFYERVKASDDIYMGVQKGWYCVGCEEFKDNPENSSTYKCPIHQKNLEWKNEENLFFRLSKYQKEIEKIINEPSFIEPIERKNEIINFVSRGLKDFSISRTNVTWGIPVPGYDNHTFYVWFDALLGYVSAISSDATEHSLEKSINGGWPADVHLIGKDILRFHAVYWPAMLISAKMKVPKKVFGHGFLTREGQKMGKSLGNVLDPDLLLKKYGNDPVRWYLIKDISLGNDGDFQDKRFVDIINNDLANTIGNLLNRTSSMSRKWFDNKVPNNEKISSENKLENYAKIAVENYIYNFDNYKLDLAANEVLSLAINTNLYLNDNQPWVLIKEKDNLPLVKEIIYNVLESTRIIGLLLLPLLPELSIKINEQLGSIYREEISWKKQLIWGLLVSNSSLPKPTPIINKLEYEQKL

SEQ ID NO: 43353 - protein, 417 aa, Anaplasma centrale
MVEKAILECGDCKVSLPVMRGNDGTLAIDVTGLYKDAKILTYDPGFLSTAACRSEITFIDGDKGILRTRGYDIADLVTTGGGFCSVAHLLLHGALPQGRELDDFASAVGNECHVPAQVVNVIKSLPSSAHPMAILIASFVTLAACYHAENSIDPLKSAIVAISKVPGIVAAIYRHTSGMPAVEADPNLGYVQNFVKMMFGDLGSTRQSVICRALESIFIMHADHEQNASTATVRVTGSAGANLFACLSAGAATLWGPAHGGANEAVVRMLEEIGSPERVGMFIQRVKDKKDGVRLMGFGHRVYKNYDPRALIIRDICKETLHELGTSDPLLDVAFELERVALQDEYFVKRFLYPNVDFYSGIVLKAIGVPVNMFTAFFALARTTGWSAQWYEMVTEHGDSNRICRPRQLYVGNMNAK

SEQ ID NO: 43354 - protein, 360 aa, Amycolatopsis methanolica
PQTVRGVIARSKGAPVELTDIVIPDPGPSEVTALIATCAVCHTDLTYREGGINDEFPFLLGHEAAGTVESVGEGVDSVQPGDYVVLNWRAVCGQCRACKRGRPQYCFSTFNATQKMTLTDGTELTPALGIGAFADKTLVHAGQCTKVDPAADPAVAGLLGCGVMAGLGAAVNTGAVSRGDSVAVIGCGAVGDAVIAGARLAGANKIIAVDRDAKKLEWATELGATHTVNATETDVVEAVQALTGGFGADVVIDAVGRPETWKQAFYARDLAGTVVLVGVPTPDMRLEMPLLDFFSRGGALKSSWYGDCLPERDFPVLIDLHLQGRLPLDKFVTERISLDDVEKAFHTMHAGEVLRSVVVW

SEQ ID NO: 43355 - protein, 377 aa, Prunus dulcis
MTFTLRKKETLIDILVRLPAKSLVRFLCTCKSWMDLIGSSSFVSTHLHRNVTKHAHVSLLCLHHQSFECQVDPDDPYVGQELQWSLFCDETFVLCSKLSHPLGSTEQYYGIYGSSNGLVCISDEILNFDSPIYIWNPSVRKLRTPPLSTNINIKFSHVALQFGFHPGVNDYKTVRMMRTNKSALAVEVYSLRTDCWKMIEAIPPWLKCTWRHHKGTFLNGVAYHIIEKGPIFSIMSFNAGTEEFQEFIAPDAVCSLWELRIDVYKENICLLLDLYPSEEDGMEKIDLWVLQEKRWKQLCPFIYPSDHYYRTIGMSMDNKLLMPRRDYTSGIADLHLCDYESKQVLETGIKLAVMKYGEIEFLFSISYIESLVLLNNY

SEQ ID NO: 43356 - protein, 264 aa, Medicago truncatula
MGFDSNLGGSPSSSSPSSKRTRDPEEEVYVDNLRSHKRYLSEIMASSLNGLTVGDSLPDNLMESPARSESAFSLRDDMSLQYSPMSEDSDDSRFCETGLHSCSSHPDSRPGSPVSPCRYQRSQNTFSSAPSTSLNGSHGFSVSAVTCSQPRQRSSDSDGRFPSSPSDICHSADLRRAALLRSVQMRTHPPGSASLELPFGSGQEPPPNIDPEERPCSYLKSMVDERDYQIEECSPIGIPEPEFNHDNKPCRVLNMNPKEADSGG

SEQ ID NO: 43357 - protein, 409 aa, Prunus dulcis
MWEEMALRHILPRLPSKSLMRFKCVRKSWYTLINNPTFVENHLSNSMQSKLSTCVLFSRFVQSDANSDEKELAFSFIYLRNDYDDDEHNLNFVVEDIKFPLSSGQFIGLEDVESPSILGHCNGIVCLSPCSDNLVLCNPAIKEIKLLPKSGLPDWWGCAVGFGYDPKSKDYKVSRIASYQVEIDGLIPPPRVEIYSLSTDSWREIKNNSLETDTTCFFPDYFQMYFQGICYWVGYEQPKQSVEYEDEEQKPMVIFFDTGDEIFNHILFPDSFYMYEEGSSYAYEMSYLMYCDLRIILWNGSIALFGFNRFSVFPDSYGVWVLDDFDGAKGSWTKHLTFEPLMGIKRVLEFWRSDEILMVTEDGDIVSYNLATQKLENLPMNSLSDFETIVYVNSLVSITRGNKLESVDI

SEQ ID NO: 43358 - protein, 409 aa, Prunus dulcis
MWEEMALRHILPRLPSKSLMRFKCVRKSWYTLINNPTFVENHLSNSMQSKLSTCVLFSRFVQSDANSDEKELAFSLLYLRNDYDDDEHNVNFVVEDIKFPLSSGRFIGLEDVESPSILGHCNGIVCLSPCSDNLVLCNPAIKEIKLLPKSGLPDWWGCAVGFGYDPKSKDYKVSRIASYQAEIDGLIPPPRVEIYTLSTDSWREINNNSLETDSTCFFPDYFQMYFQGICYWVGYEQPKQSVEYEDEEQKPMVIFFDTGDEIFHNLLFPDSFYMYEEGSSYAYEMSYLMYCDLRIILWNGSIALFGFNRFSVFPDSYGVWVLDDFDGAKGSWTKHLTFEPLMGIKRVLEFWKSDEILMVTIDGDIVSYNLDTEKLKNLPMNIPSDFETIVHVNSLVSITGGNKLESVDI

SEQ ID NO: 43359 - protein, 416 aa, Ehrlichia muris
MIKEAVLELDDQRIKLPVLYDTNGNKAVDITSLYKDTGVLTYDPGFMSTAACESKITFIDGNKGILCYRGHNIVDLVNGNKSFVEIIYLLFYGVFPSSEDLQNFTLQISQEYTPPQVVYDVIKAFSQDSHPMAILMACFSALAAYYHDREADKDELKCAKLAVAKIASIVALIYRYITNQDFITADTKLSYSENFVHMMFDISSYKFTQVVAKALDIIFVLHADHEQNASTATVRLAGSAGADLFACLVAGTATLWGPAHGGANEAVINMLMTIEKPSNVKQFIQKVKDGSKTTRLMGFGHRVYKNYDPRAKMMCEICREVLNDLGIDDPLLEVAVELENIALQDSYFIERNLYPNVDFYSGIVLKAIGIPVKMFTTLFALARTSGWSAQWYEMVANKNYKICRPRQLYTGHITKI

SEQ ID NO: 43360 - protein, 490 aa, Crocosphaera watsonii WH 8501
MVTATRPENKVKIGPTQLLINNKWVESASGKRFETINPSTGEVICDVAEADAADVDKAVIAARNAFNQGDWPKLSATQRGQLLYKLADLIEANIEELARLETLDNGKPYQDSLNADLQLVIACYRYYAGWADKIQGKTIPINGPYFCYTRHEPVGVVGQIIPWNFPLLMQAWKLAPALAAGNTVVMKTAEQTPLSALRLGELILEAGFPPGVVNLLSGYGPTAGQAIARHHDIDKVAFTGSTEVGHLIMEAAAQTNLKRVTLELGGKSPNIVFADANLEQAIEGAHFGLFFNQGQCCCAGSRLFVEEKCYDEFVAKSVERAKQRIVGDPFDDNTAQGSQVDRTQFDKVMEYIESGQREGAKLLCGGGRVGDRGYFIEPTVFAEVKDNMKIAQEEIFGPVMSIIKFKDMDEVIQRTNDTVYGLAAAVWTQDISKGHAIANALRAGTVWVNCYDVFDAAAPFGGFKQSGMGRELGEYGLQQYTEIKTVTVKL

SEQ ID NO: 43361 - protein, 562 aa, Oryza sativa (indica cultivar-group)
MELSSSLAAVLHSPLFLLAALLLLPVFTLLSFSSAKKPGDGGGRRLPLPPSPRGVPFLGHLPLLGSLPHRKLRSMAEAHGPVMLLWFGRVPTVVASSAAAAQEAMRARDAAFASRARVSMAERLIYGRDMVFAPYGEFWRQARRVSVLHLLSPRRIASFRGVREQEVAALLDRVRRRCGVRGGGETVNLSDMLMSYANGVISRAAFGDGAYGLDGDEGGGKLRELFANFEALLGTATVGEFVPWLAWVDKLMGLDAKAARISAELDGLLERVIADHRERRRLSQPDGGDGDGDGDENVDHRDFVDVLLDVSEVEEGAGAGEVLLFDAVAIKAIILDMIAAATDTTFTTLEWAMAELINHPPVMRKLQCEIRAAVGVPGASGGAEVTEDHLGELRLLRAVVKETLRLHAPVPLLVPRETVEDTELLGYRVPARTRVIINVWAIGRDAAAWGDRAEEFVPERWLDGGGGGGGEAVEYAAQLGQDFRFVPFGAGRRGCPGAGFAAPSIELALTNLLYHFDWELPPHADGAAAATAARLDMGELFGLSMRMKTTLNLVAKPWSSDV

SEQ ID NO: 43362 - protein, 386 aa, Clostridium thermocellum ATCC 27405
MAGKRDYYEILGVDRGASDAEIKKAYRKLAKQYHPDMNPGDKAAEAKFKEINEAYEVLSDPQKRARYDQFGHSAFDPNGFGGGGFGGGFTGGFGDFDFGGFGDIFEAFFGSGFGTRTSSARRGPQKGADLKYSMEVSFEEAAFGTEKEVTVSRLEICPTCSGSGTKPGHQPVTCRQCNGTGQVQYKQRTPFGQIVNVRTCDVCHGEGKIITNPCETCGGKGRVRKHTKLKVRIPAGIDNGETISLRGEGEHGIKGGPSGDLFITIKVKPHPIFKRHGNDVNCEIPITFTQAALGAEIEVPTLDGKEKIVIPEGTQTGTVFKLKGKGIPFLRSSGRGDQYVKVNIEVPRKLNEKQKEVLRQFAELVGDEVHEQRKGFFNKMKDALGM

SEQ ID NO: 43363 - protein, 566 aa, Rickettsiella grylli
MPKFKPVTDQNENVRFLETNALGSTLLTTAKLNKGTAFTESERQELGLLGKLPYRVESLQQQTQRVYQQFLKKEDNLEKHLYLRCLHNTNEILFYKLVSQHLTEMLPVLYTPTVGKAVEQFSQEFQEARGLYIAYPDNDRIDQILDNRLNPEVDIIVMTDGEGVLGLGDQGIGGMGICIAKLIVYVLCAGINPNRLLPIQIDVGTNNEQLLNDPLYLGWRHPRVSGQQYDDMIARVVSAIQRKLPRAYLHWEDFGRENARRNLECYRDTMCTFNDDMQGTGAVTLVALLSAIRRTKVPLTEQRIVIVGAGTAGTGIADQLCAGMLRQGLSRDEALSRFYLVGRHGLIQDSTPNLTAFQKPYAQRLMNKTEATWQLYDVVQKFKPTVLIGSSGQGGIFTEAIVKTMASQVEYPIIFPLSNPTEKSEATPDDLFNWTEGRALIATGSPFGQVYYKGEKIPIAQCNNALIYPGIGLGVVTAQATRLSDGMIWEACNALSHFTQTSSSKKALLPHFEDIQAMSRCIALAVAAQARREGLAQVPDSIDLTQEMDRQFWKPEYLPYRYSKSL

SEQ ID NO: 43364 - protein, 409 aa, Ehrlichia sp. Yamaguchi
MIKEATLELDGQKIKLPVLYDTNGDKAVDITSLYKNTGILTYDPGFMSTAACESKITFIDGNKGILCYRGHNIVDLVNKNKSFVEIIYLLFYGVFPSAEDLQNFTLQISQEYMPPQVVYDVIKSFSQDSHPMSILMACFSALASYYHDQEADKDELKYAKLAVAKIASMVALIYRYITNQDFITADTKLSYSKNFVHMMFDISSYKFTQVVAKALDIIFILHADHEQNASTATVRLAGSSGADLFACLVAGTATLWGPAHGGANEAVINMLMTIEKPSNVKQFIQKVKDGSKTTRLMGFGHRVYKNYDPRAKIMCKICREVLNDLGIDDPLLEVAQELENIALQDSYFIERNLYPNVDFYSGIILKAIGIPVRMFTTLFALARTTGWSAQWYEMVANKNYKICRPRQLY

SEQ ID NO: 43365 - protein, 168 aa, Zea mays
MEYGQQGQRGHGRTGHVDQYGNPVGGVEHGTGGMRHGTGTTGGMGQLGEHGGAGMGGGQFQPAREEHKTGGILHRSGSSSSSSSEDDGMGGRRKKGIKEKIKEKLPGATRDDLHATATTGGAYGQQGHTGSAYGQQGHTGGAYATGTEGAGEKKGIMDKIKEKLPGQH

SEQ ID NO: 43366 - protein, 138 aa, Brassica napus
MAELENPGVMPTLYMSFLSSLLERVSESNDLTRRVATQSQSVSVFDGLSRPSITVHCYLERIFKYANCSPSCFVVAYVYLDRFTHRQPSLPINSFNVHRLLITSVMVSAKFLDDRYYNNAYYAKVGGISTKEMNLLEL

SEQ ID NO: 43367 - protein, 1469 aa, Yarrowia lipolytica CLIB122
MEQTPPDYTGLDKNIDAEVRSIAESMYQTRREGVNDSDTDEELQRTNTIQPNLNVNPFLDTSDPQLDPLSKEFNSRKWIKTILGLKARFGNSRSISAGVSFKNLSAFGYGGGNDYQKTFTNSVMAIGPMIKKVLGGNKGSEVQILRHFDGLVRAGETCVVLGRPGSGCTTFLKSVACETYGFHLGEKSEWNYQGVPRDVMQKNARGEIVYNAEVDVHFPHLTVGDTLLFAALARTPQNRLEGVSREQHATHVRDVSMAMLGLTHTMDTKVGNDFVRGVSGGERKRVSIAESVVCGAPLQCWDNSTRGLDAANATEFIRSLRLSAEMTDASMFVSLYQASQEAYDMFDKVCVLYEGRQIYFGKTTEAKQFFLDLGFDCADRQTTGDFLTSLTNPIERIIRPGWESRVPRTPDDFEKCWLESEARQLLLQDIDEFNNEFVLGGPALDNFMGLRKDAQAKHTRVQSPYTISWPMQTRLCLWRGFLRIKGDMSTDIATVFGNFVMALVLSSMFYNMPQTTESFFSRGALLFFAILINAFASILEILSLYEQRPIVDKQNRYAMYHPAADALAAIITTFPTKTLTLVSVNLTIYFMTNLRREVGPFFIFFLFSLLCTMAMSMIFRTIGSVTKTLEQALAPASIIILALVIYTGFSLPISYMHGWARWINWLNPVAYGFEAVMVNEFRNREYECSMFVPSGGAYENVSLDYRSCAAVGAEPGLRFVNGDAFINQSYEYYNAHLWRNMGILFGFIIFFGAFYLFAVEYIQGAKSKGEVLVFRKEHIKKQRKEKNGDIESGVTMAGEKGTQESESSNTSINLQAQRGIYQWKDVCYDIKVKDGERRLLDHVDGFVKPGTLTALMGASGAGKTTLLDVLADRKSTGVVTGEMLVNGEHRDGSFQRKTGYVQQQDLHTATATVRESLEFSALLRQPSSIPESEKLAYVDEVIRILEMETYADAVVGVPGEGLNVEQRKRLTIGVELAAKPELLLFLDEPTSGLDSQTAWSIVKLLKKLAANGQAILCTIHQPSAILFQEFDRLLFLASGGRTVYYGDIGPQSSILTEYFERNGADPCPKQGNPAEWMLEVIGAAPGSTAKRDWPVVWAESPERAAKREELDEMARTVERVQTNTTERDSTGYSDSDQFAVGWWTQFKIVSKRQFQALWRTPSYLWSKVFLCAASAIFIGFSFFKAPNDMQGLQNKMFSFFMLFLIFNTVVEQIIPQFDKMRELYEARERSSKTYSWQVFMGSNMVVELIWQFFMGVIVFFCFYYPVGFQWTAEYNDSVHERGGLFFLYVLLLFLYNSTFAHMLIAGIDNKDTAAQIGTLLFTLMLLFCGVLATKEQMPGFWVFMYRVSPLTYFVGGMMATGMGRAPVTCSPHELVRFPAVPGKSCGEYMDGFISALGDSAGYLVSSSADMCEYCPMKSSDQFLDSVDISYTQRWRNWGILWAYPLFNIFAAFALYYFFRVPKKSKAQKA

SEQ ID NO: 43368 - protein, 585 aa, Thermus thermophilus HB27
MAGLADRVSGARLDPAAEAEIRYLEAMIARLEAGEEDPEDFRVFRLKNGIYGIRGRPEHHMIRIKLPVGRITPEGLRVLADVAERYAENRLAHVTTRQAVQLHHVHRRDVPKVLRAVNAVGLTTREACGHSIRAITCCPYAGVSPEEPFDVTPYAEAAYRYFLRHPVGQNLPRKFKIAFEGCATDHARTPIHDIGVVAALEGGKRGFRVYVGGGLGAAPMSAELLEAFTPEEDLLPTMLAIVRLFDRYGNRKVLTQARLKFLVKKWGIAAFREAVREERRLVKLTASGEDLEAWAPPPEPEPPRLPSPPKKPFSFAPGFDAWRRTNLFKQKQEGFYTVTVRLPLGDITPEGLRALAAIAETYAAEVRSAISQNLLLRFVPEEALGGLYEALLEAGLALPEAHTLLDITRCPGADTCNLAITRSRGLAQALEAHLSALPLAQDPGAKAIGVKISGCPNSCGQHHIADIGFYGSSRKVGEREVPHYVLLLGGRTREGEARFGQVVGRIPARRVPEAVERILKRYLEERQNGESFQAYLDRVGAASFKPLLQDLQEVPPYEEAPEFYQDLGAEGEAFSVQLGRGECAV

SEQ ID NO: 43369 - protein, 274 aa, Pasteurella multocida subsp. multocida str. Pm70
MIQYKKIKQISPELTLSYYNQIPVLELNHPHLGEAKVALQGAQLLSWKPKSEQQDILWLSPIEPFLLGQAIRGGIPICYPWFGATKKPIHGTARLALWKLSHFDIDIEHARIELVLLDQQHIVEAKVVMLFSEKCELIFTHYGKQAAQAAFHTYFHVGNIEQVEIMHLPTVCFNAVTQQQEQVPSSRRITQHTDCIYTLEAPTNYILDHQFNRQIEVTHQNATETVLWNPWHSVMSAMQEQDYQNMLCLETARIYQLLHFGESIRVTLARKKSN

SEQ ID NO: 43370 - protein, 314 aa, Medicago truncatula
MPLPPINDLTCIVTGSTSGIGLEIARQLAESGAHVVMAVRNTKRANDLIQKWQIESDGLGLGMALNVEVMEVDLLSLDSVARFAEAWNARATPLHALINNAGIFSIGEPQKFSKDGYEDHLQVNHLAPALLSILLLPSLIRGSPSRIVNVNSIMHHVGFVDTEDMNLTSGKRKFSSLVGYSSSKLAQVMFSSVLFKRLPAEAGISVLCVSPGIVQTNVARDLPKSVQTGYHLIPYFIFNAQEGSRSTLFAATDPQVSEYCELLKSDEWPVCPYISHDCRPANASEEAHNLQTSHEVWEKTLEMIGLLRMPWRSF

SEQ ID NO: 43371 - protein, 435 aa, Thermus thermophilus HB27
MTQLEAARKGKITEEMAYVAEKEGVSPEFVREGVAAGRIVIPRNPNHKTLTDFKGIGEGLSVKVNANLGTSYDYVNVEEEVEKARVAIQYGADTVMDLSTGGDLKAIRKRILEVATVPLGTVPIYEAEFRAARRKNFFDMSADELFQVIEEHGKEGVDYITVHVGVTLKNLEVYRNSPRTTGIVSRGGGLMAAWMLHRGEENPLYARFDDLLDIARTYDMTLSLGDGLRPGSLADSTDRAQIAELLTIGELVERARRAGVQAMVEGPGHIPLNEVAANVQIQKKLTGHAPFYILGMLPVDTAAGFDHIAGAIGGALAGWWGADMLCYLTPAEHLGLPTPEHVKQGVIAFKIAAHAADVARGNKRALERNRRMSEARYRLDWEGQFALALFPEEARRLKEERGSKTKACSMCGPFCPMNLVEAVLKGKGRMELPVA

SEQ ID NO: 43372 - protein, 201 aa, Zea mays
MSGNPVGVDNTSRRKFDKEEYLERARQREQREKDEARKGKERGPPVQRQPLKHRDYEVDLDSRLGKTQVVTPIAPLNQQAGYYCSVCECVVKDSANYLDHINGKKHQRALGMSMRVERASLEQVQKRFEALKKRKDPSAFTEEDLDERIMKQQQEEEERKRQRKEKKKEKKREQATQHEPEDVDPDIAAMMGFGGFGSSKK

SEQ ID NO: 43373 - protein, 310 aa, Arabidopsis thaliana
MEVERDQHISPPSLMAKTIPIIDLSNLDEELVAHAVVKGSEEWGIFHVVNHGIPMDLIQRLKDVGTQFFELPETEKKAVAKQDGSKDFEGYTTNLKYVKGEVWTENLFHRIWPPTCINFDYWPKNPPQYREVIEEYTKETKKLSERILGYLSEGLGLPSEALIQGLGGESTEYVMRINNYPPDPKPDLTLGVPEHTDIIGITIIITNEVPGLQIFKDDHWLDVHYIPSSITVNIGDQIMRLSNGKYKNVLHRAIVDKENQRMSWPVFVDANPDVVIGPLPELITGDNPSKFKPITCKDFKYRRLLKLPIE

SEQ ID NO: 43374 - protein, 513 aa, Lactococcus lactis subsp. cremoris
MSDTTLEKIIVLDYGSQYNQLIARRIREIGVFSELMSHKVTAKEIREINPIGIILSGGPNSVYDEGSFDIDPEIFELGLPVLGICYGMQLMSYKLGGMVEAAGEREYGVAPLQLTEKSALFAGTPEVQDVLMSHGDRVTAIPEGFHVVGTSPNSPFAAVENTERNLYGIQFHPEVRHSVHGTEMLRNFALNICGAKGNWSMENFIDMQIKDIREKVGDKKVLLGLSGGVDSSVVGVLLQRAIGDQLTSIFVDHGFLRKGEADQVMETLGGKFGLNIIKVDAQKRFMDKLVGLSDPETQRKIIGNEFVYVFDDEANKLEGVDFLAQGTLYTDVIESGTDTAQTIKSHHNVGGLPEDMQFQLIEPLNTLFKDEVRALGTQLGMPDEIVWRQPFPGPGLAIRVLGDLTEEKLETVRESDAILREEIAASGLERDVWQYFTVNTDVKSVGVMGDQRTYDYTLAIRAITSIDGMTADFAQLPWDLLQKISKRIVNEVDHVNRIVYDITSKPPATVEWQ

SEQ ID NO: 43375 - protein, 285 aa, Arabidopsis thaliana
MAEEVLSRVPMTSLRRLRFTCKKWNTLSRCRSFAKKHLVCQAKVAAKKREYKVVMMMDFRVYLMRINLQNNVELCIKRERELLFPDASDQIYVRHVFHCDGLLLCIMKDNPRLVVCNPYSGQTRWIETTNNPQRLDAYSYALGYNSSTKSHKILSFGMMFDYVSSTSAEFKIYDFNSDSWRGDIWAAVCLRRPLSGIFKSSLLLSNVRDEQLAVLFQRMDTLQMEIWVTTKIEPNTVSWSSKFFLSVDMRELTGRYSMFSFSDASFFIDEEKKVAVLTSLERMDP

SEQ ID NO: 43376 - protein, 344 aa, Chlamydophila pneumoniae CWL029
MLTLGLESSCDETACAIVNEDKQILANIIASQDIHASYGGVVPELASRAHLHIFPQVINKALQQANLLIEDMDLIAVTQTPGLIGSLSVGVHFGKGIAIGAKKSLIGVNHVEAHLYAAYMAAQNVQFPALGLVVSGAHTAAFFIENPTSYKLIGKTRDDAIGETFDKVGRFLGLPYPAGPLIEKLALEGSEDSYPFSPAKVPNYDFSFSGLKTAVLYAIKGNNSSPRSPAPEISLEKQRDIAASFQKAACTTIAQKLPTIIKEFSCRSILIGGGVAINEYFRSAIQTACNLPVYFPPAKLCSDNAAMIAGLGGENFQKNSSIPEIRICARYQWESVSPFSLASP

SEQ ID NO: 43377 - protein, 301 aa, Oryza sativa
  misc_feature (173)..(173): Xaa can be any naturally occurring amino acid
  unsure (1)..(301): unsure at all Xaa locations
MALVVICGQPCSGKSAAAACLAAALCSSTSDLTVRIIDESSLHLGRNDSYKDMVVEKNLRGVLRSEVDRSVSRDSIIVVDSLNNIKGYRYELWCLARASGIRYCVLFCDTEVDHCREWNTKRQEKGEPTYDNNIFDDLVSRFEKPDRRNRWDSPLFELFPSRDGVMGRALFRXHYRTNLTKKVDSKTRDVKVLQPTIATQTARTTEANSLYEMDKATQEVINAIVEAQSCGLGLPVNKISLGPDLPTICLQRSVGLPELRSLRRTFIKLAGQYSLSGPPPPADADSATRMFVVHLNREISS

SEQ ID NO: 43378 - protein, 130 aa, Methanosarcina acetivorans C2A
MTCDPAGGRAINAAGVQFPPVHYNGDIFLPGQANNFYTYPAVGLAVYVTRAKRATDEMFIKAARATANQRTDEQLKKGLLFPPQSSILETEVRTAVQIATLIFNRDLARVDQPEDINVWLRATLYKPQYS

SEQ ID NO: 43379 - protein, 260 aa, Polaromonas sp. JS666
MQLLTPSPQMGSPRLPLIGPQTALFLDFDGTLADLAPQPGAVQVTAGLIPTLAQLATRLGGALAIVSGRTLTDLDRFLDPLQLAAAAEHGAQRRQADGQVVSVAAPDLQEVVRRAEALAARHPGLYLEIKSAAVALHYRHAPDLETLALQVMREAANSTPGAELLQGKYVFEIKPAGVSKGTAIEAFMGEMPFVGRLPLFAGDDVTDEAGFSVVQFLGGQGIKVGEGATLARHRCAAPAALRQWLQAASQNSGHWRGISP

SEQ ID NO: 43380 - protein, 360 aa, Oryza sativa
MEAVAVAGGGAGLTRWQAAALSAVAGWVWAASSFDLTRRSRALVQPWVTRRVLAETPSIVRFQKVHHKLLDSFFSVLSCVVSVPFYTGFLPLLFWSGHSKLARQMTLLMAFCDYLGNSVKLLTLWKSVDTGRGVSPSAKLSSGRIYLGMHSLIDVIAGICFGVVILAFWLAVHNHVDAFVVSGQNVTTFWASLSLLLCFAYPKPEFPTPSFEYHTAFNGVAFGIVYGIQQTYFHFHNPDVPLIFSPQLPLIVIVGRVLVGIPTILVVKFCSKALSKWLLPVMCNTLGIPIVSTCYVPALKASEKCKVKSDAKQGGYLQKVFSLLPQKAYDVDTGIRFVQYATLAWSVVDLVPAIFTHLSL

SEQ ID NO: 43381 - protein, 341 aa, Gibberella zeae PH-1
MSAATRDVISKVQRMIPPMLEKFHKGQLGRVAVIGGSENYTGAPYFSAMASARLGADLSHVICTPAAATVIKSYSPNLMVHPLMRQSENAKKEHEPAAWNASKEHESSAEHIASQIKDLLPRLHVLVIGPGLGRDPLMHETVSLVIRAARDHGLPLVLDADALAIIHKQPELISGYIGAVLTPNVVEFGKLCDALKVKVDDDAPETARVEALAKTLKGVTVVQKGAKDYISNGETTLTVDLEGGKKRSGGQGDTLTGSIATFLGWRNAYMERLWDVGKDPIDEHELVGLAAFGGSAITRECSRLAFSKKGRSLQASDLTDEVHISFLNIFGEDKEVDESKL

SEQ ID NO: 43382 - protein, 103 aa, Anabaena variabilis
MSVYVGNLSYDVTEDSLNPVFAEYGSVKRVQLPTDRETGRMRGFGFVEMGSDAEETAAIEALDGAEWMGRDLKVNKAKPKEDRGSFGGGNRGGYGGGGGRNRY

SEQ ID NO: 43383 - protein, 141 aa, Azoarcus sp. BH72
MAIERTLSIIKPDAVAKNVIGKIYQRFEDAGLKIIAAKMVHLSEQEAGQFYAVHKERPFYKDLVSFMTSGPVMIQCLEGENAIAKNRELMGATDPKKADAGTIRADFADSIDANAVHGSDAPETAAVEVAFFFPGMNVYSR

SEQ ID NO: 43384 - protein, 329 aa, Medicago truncatula
MPLPPINDLTCIVTGSTSGIGLEIARQLAESGAHVVMAVRNTKRANDLIQKWQIESDGLGLGMALNVEVMEVDLLSLDSVARFAEAWNARATPLHALINNAGIFSIGEPQKFSKDGYEDHLQVNHLAPALLSILLLPSLIRGSPSRIVNVNSIMHHVGFVDTEDMNLTSGKRKFSSLVGYSSSKLAQVMFSSVLFKRLPAEAGISVLCVSPGIVQTNVARDLPKSVQTGYHLIPYFIFNAQEGSRSTLFAATDPQVSEYCELLKSDEWPVCPYISHDCRPANASEEAHNLQTSHEVWEKTLEMIGLPSDAVEKFLEGEEVKCRYGQEQQ

SEQ ID NO: 43385 - protein, 108 aa, Pseudomonas syringae pv. syringae B728a
MDIIETIKEQIANNTILLYMKGAPNAPQCGFSAKASQALMACGEKFAYVDILQNPEIRANLPKYANWPTFPQLWVAGELVGGSDIITEMMDDGSLQTLVKEASAAKAE

SEQ ID NO: 43386 - protein, 383 aa, Arabidopsis thaliana
MGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 43387 - protein, 162 aa, Zea mays
  misc_feature (153)..(153): Xaa can be any naturally occurring amino acid
  unsure (1)..(162): unsure at all Xaa locations
LLIPFLARGPGPVADLLLWRRRNASAAAVVGATTVWFVFERAGYSFPSVLSNALLLLVAILFFWAKSASLLNRPLPPLPNLEVSDAIVEKAANHALVWINRLLAVGHDIAIKRDRKVFIKVILILWVVSFIGMLFNFLTLIYIGVMLSSVVPXLYEKYQDQV

SEQ ID NO: 43388 - protein, 664 aa, Oceanospirillum sp. MED92
MSSRRELANAIRALSMDAVQKAKSGHPGAPMGMADIAEVLWNDFMQHNPTNPQWFDRDRFVLSNGHGSMLIYSLLHLTGYDVSIEDLKNFRQLHSKTAGHPEYGYCPGVETTTGPLGQGITNAVGFAVAEKTLAAQFNREGHEIVDHNTYVFMGDGCLMEGISHEACSLAGTLGLGKLIAFWDDNGISIDGEVEGWYTDDNVKRFESYGWQVIPGVDGHDADQIRAAIEQAKENTEQPTLICCKTIIGFGSPNKEGKEDCHGAPLGDDEIALTRERLGWTHPAFEVPSEIAEDWNAQEAGIHAENEWNERFAAYRAEFPELADELLRRISGELPADFSEKADAYIAEIAEKGETIASRKASQNALNAYGPMLPELLGGSADLAGSNLTLWSGCKGVEKNDASGNYLFYGVREFGMSAIMNGIALHGGFIPYGATFLVFMEYARNAVRMAALMKQRAIHVYTHDSIGLGEDGPTHQPVEQVANLRHTPNMSTWRPCDAVESAVAWKSALERADGPTAMIFSRQGLPHQARSEEQVANIAKGGYILRDTDGQPDAILIATGSEVGLAMDAAEALAADGVKARVVSMPETGLFDQQSAEYRESVLPAAVTARVAVEALQADFWYKYVGLNGAIVGMRTFGESAPAGELFKHFGFTTENVVETVKSVL

SEQ ID NO: 43389 - protein, 507 aa, delta proteobacterium MLMS-1
MTLYLTTPIFYVNAQPHLGHAYTGVVADTVARFARLDGEEVFFQTGTDEHGDKIVGAAKEAEVDLREYVDRISALFRQAWPLLEVEPDNFIRTTDPAHIEVVQHILQQVYQRGDIYFSDYAGLYCRGCERFLTEKELVDGKCPDHQVAPAEIREQNYFFKMSRYQQWLIDHIKEHPEFITPERYRNEVLSFLSEPLDDLCISRPVSRLEWGIPLPFDRNFVTYVWFDALINYISGIGYPDAPDFAPRWAAAEHLIAKDILKPHAIFWPTMLRAMGLPPYRRLHVHGYWNVNEAKMSKSIGNVVRPQDMVEQFGADTVRYFLLREMSFGLDASYSDEAVLARRNADLANDLGNLFSRSLTMVKNFADSRVPTPGTLTEEDQELADACLAMLDSYGRQMREFAFRQALEAVWEVIGRANRYIVTNAPWELAKDPGQQERLATVLNTLLETLRCIATTLGPVMPGAATKMAAALPLAAELTLAGQRHWPGLPPGAPVTVGENLFPRLKKG

SEQ ID NO: 43390 - protein, 611 aa, Cytophaga hutchinsonii ATCC 33406
MSEDAKIYEEELAKQSIQERKELGITWYPLFIKSEYYGFAERLHIEVERKYEADTPNIFYSGDKVRIFSNQQHNTKEDFIDGVITASAGNLVTVQLMKDEAPDWLSDGKIGMDKLFDKHSYETMLSTLDYWASDDGLTKDSIRLRDVILGEKTASFNTKENYAAPDKLDITQKKAWEKAIQAQDVAIIHGPPGTGKTTTIVEIVKTLIEKGERVLVCASSNAAVDVLTERLAARGLPVVRLGNPSKITEQNLQYCLDRQVVNHEQFGLVKELKKRAEEFFRMANKYKRNFDREEREQRKAILKEARNLRGQADDHLHFLQQNVLVKNQVVTCTPVVSMHREIGKEKFDTLIFDESGQTMEPMCWIPIQKVKKVILAGDHLQLPPTVKSDEAAKKGLAISLLEKLMPLPGISEMLAIQYRMNEKIMQFPSQWFYDNKLEAHGSVKDHAFDDDVIQFIDTAGTGYEEELVGAPFGIRNKQEADLVLAILNNVAELNKQASIGIISPYKLQIQYIREQLIEQKITSKNIQVQTVDGFQGQEKDIIIISLVRSNGKQEIGFLKDLRRMNVAITRARKKLIVIGDSSTLSSSKFYAGFQEYIESHNGYHSAWEYIS

SEQ ID NO: 43391 - protein, 180 aa, Tolypocladium inflatum
MGNKVFFDIEWEGPVMQGGKPTSTVKEQSGRINFKLYDDVVPKTAENFRALCTGEKGFGYEGSSFHRIIPEFMLQGGDFTRGNGTGGKSIYGEKFADENGQLKHDRPGLLSMANAGPNTNGSQFFVTTVVTSWLNGRHVVFGEVADQESLDVVKALEATGSGSGAVKYNKRATIVKSGEL

SEQ ID NO: 43392 - protein, 284 aa, Burkholderia pseudomallei K96243
MSGRSFLIGLIGAGIGGSLSPAMHEAEGCGQGLNYVYRRIDLDALGLTADALPELLAAAERMGFDGLNITHPCKQRVIEHLDELSADAAALGAVNTVCFAHGRRIGHNTDWSGFAKAFARGLPGASLERVVQLGAGGAGAAVAHAALTMGAAQLALFDVDPVRARSLADQLQARFPHARLSAGGTLADALANATGLIHATPTGMLGHPGLPLPAHLLRSGLWVADIVYFPLETELIRAARALGCRTLPGGGMAVYQAVDAFELFTGRAPDAERMFEHFRALVAR

SEQ ID NO: 43393 - protein, 685 aa, Magnetococcus sp. MC-1
MQELDPQLMLAGINDGALGSIFLDDQEQIVFWNRWMERASGLKRAEVLGRPLREVFPELVGGRLLRAVATALETGLPALLSHKLNLWPLPLYPSYAVRPHGPRLCQQIMINALRPHGEKRFVLIQIQDISHTVQREQLLQEQTRVLMQREEELTASRLKADQANQAKSEFLANMSHEIRTPMNAIIGMADLLLETELNKDQRRYVQIFARAGASLLELINDVLDLSKVEADRLELEHRPFDLWALVEGAVEIFTLRTQEKGVKLDFELSARAPRYVISDQKRLRQILVNLLGNAVKFTQSGQIQLWVDVRDCEDAGGWLYFRVQDSGIGMSKAQQKSIFEPFVQADASVTRQHGGTGLGLAICKKLVELLSGDIWLESELGQGSRFHFTARFTHTALVAESERAFTSAKLHGRHVLLLGSQPQNRVLLESVLRRAGCQITTVTHQAQLAGHLLEPPAGLRPFHAVLVDCYNSMARVHQQIASVRANGSVMPMVLLVGEARQEDIQIAADLGVLLLERPVSHGRLLEALGATMEQGEAALLSSSLSPTAAIEMLKQVPLKILLTEDSVDNAVLFKAYLKQYPLEITHAANGAEALTLFEQHHYDLVFMDLQMPVMDGYSATRAMRFFEKQQRRPPTPILALTAYALSGDADKSRDVGCDAHLVKPIKKLELLSSIAQYGLKISLES

SEQ ID NO: 43394 - protein, 387 aa, Oceanospirillum sp. MED92
MSVLKMSELDLSGKRVLIREDLNVPVKNGEVTSDARIRASLPTIELALKAGAKVMVMSHLGRPTEGEYNEEFSLQPVANHIGKLLGREVPLIKEWLDGGFDVAEGELVLLENVRFNVGEKKDNEALSQKMAALCDVYVMDAFGTAHRAQASTHGVAKFAEVACAGPLLAGELDALGKALDKPARPLAAIVGGSKVSTKLEVLTALSDQVDQLIVGGGIANTFLAAAGKPVGKSLCEHDLIPVAQDLMKKVNIPMPVDVVVAKEFAETAEATVKSVDDVAEDDMILDIGPQSSQNLAELLKDAGTIIWNGPVGVFEFDQFGEGTKTLSLAIAENQGFSIAGGGDTLAAVDKYDIADKVSYISTGGGAFLEFVEGKKLPAVAALEAKNS

SEQ ID NO: 43395 - protein, 402 aa, Pseudomonas syringae pv. phaseolicola 1448A
MHKLPETVLGAIKEAQALETDPLAAFVYDLDALQQHVTDVMAALPAGVELYYAIKANSEALMLETLAPLVSGFEISSGGEIERVMACPTRKPYVFSGPGKLDSDLRSALLNKVEAIHLESLNEIARLQHLAEETGRVQPVFLRINPQLPAAQSSKLAMAGTATPFGIDETDLAEAIRRVDSASHLTLKGFHVHAMSHQMSVERHEQLLDFYLQRWQEWKALASYPEQLTHFNVGGGIGVDYLNSQQFDWQRLCRYLEKRLGEQRDAPILRFEPGRFISAYCGYYAIEVLDSKTSHGEHFLVCRGGTHQFRLPVAQGHDHPVIHVPCAPATGASEEQAYTVVGQLCTPKDVLSRRQPLKGVNIGDLLVLPLAGAYGYNISHVDFLCHPRPVQHFVRNGERVRT

SEQ ID NO: 43396 - protein, 113 aa, Glycine max
  misc_feature (28)..(28): Xaa can be any naturally occurring amino acid
  unsure (1)..(113): unsure at all Xaa locations
MASSMIWSAAVTTVNRAGAGMVAPFTGXLKSLLGFPTGRPTIAFTSMVGTVGGVHCLQVWPPIARKKFGTLSYLPDLDDAQLAKEVEYLLRKGWIPRLEFELEHGFVYREHNR

SEQ ID NO: 43397 - protein, 993 aa, Dehalococcoides ethenogenes 195
MRSQFSRRDFLKISGGTAGLFATAGLFRGPIKGVEPTMVDTRPRWVKETTTICPFDASGCGFICYTDSAGNLTNMEGDPDNPVNRGSACSKGASLIQLHNNKHRLEKVLYRAAGASDWEEKSWDWALGEIANKVKASRDSGFVATNAAGKTVNRTEAIASLGGATLDNEECYLLSKMLRALGIVYLDSQARLSTASSLEALAASFGHHAMNNSWTDISNANVILDMGGNPAENYPACFSHLGEAMGKGTELISVDCRLTRTAAKAGTFVAARSGSEIAFTGGLIKYVIADIEAHPANYNLTYITEYTTAGMVVNSNFKGPADLDGMFTGYNSASHSYDQSNWSFAKASNGDPIIDKTLTNPNCVFQLLKKQYARYTPEMVAATCGCSQADFAKVCASFASTGKADKAGAIIYAMSSTQHTSGAQTVRAYAILQMLLGNIGVSGGGLFALGGESNVQGAADNGVAWNKLPGYLSAPTEDDTNFAAFAAKSSEQNAASLLKAWYGSNASSSNGFGFSFLPKTDTNTDYSYVNAIKQMAAGTIKGAFAWGANPVVESAAAAQATQALAKLDWLVVTDMFESETAAFWKKEGISSQTEVFLLPAACSYEKEGSVTNADRWVQWRNQAVNAPGEAKSELEVISSLFSRIQSLYQGESALNAEAITKLSWTYSTNPSAADVAKEMNGYKVSSLQQLESPEELRTDGTVACGNNLYVGSFTDAGNQMARREQTGVFHAGWAWSWPVNIRILNNRASVDLSGQPFNAAKPVVSWNGMGWSGDIVDGNNPPVNQSGGLPFKGTSGSQGQLFAAMADGPMPEHYEPWESPVDNALSGTQNNPAAMVFEGDTKGSAGEYPVICTTVRTVEHSLGGELTRNMPFLVELAPAAYVEISEQLASEKGIKAGDIVKLTSARGSVSVAAAVTKRLKPFSIGGKTVHQVAIPYHWGFMGIAQGDSANTLAPNTADSNSSTPEFKAFLVKVEKEADGTVPTITGRYKVLED

SEQ ID NO: 43398 - protein, 550 aa, Chlamydophila pneumoniae CWL029
MHPLYVDLDTIISSYSPPLPKEFQEAASLIAVPDTSHSKPVVPGVKTLFPQTYHLPYLKFVQGENVVHTPLKVGVMFSGGPAPGGHNVIQGLFNSLKDFHPDSSLVGFVNNGDGLTNNKSIDITEEFLSKFRNSGGFNCIGTGRKKIVTPEAKEACLKTAEALDLDGLVIIGGDGSNTATAILAEYFAKRRPKTSIVGVPKTIDGDLQHTFLDLTFGFDTATKFYSSIISNISRDALSCKAHYHFIKLMGRSASHIALECALQTHPNIALIGEEIAEKNLPLKTIIHKICSVIADRAAMEKYYGVILIPEGIIEFIPEIINLITEIESLSEYEDKISRLSPESQRLLKSFPAPIIEQILNDRDAHGNVYVSKISVDKLLIHLVSNHLQQYFPNVPFNAISHFLGYEGRSGLPTKFDNTYGYSLGYGAGILVRNHCNGYLSTIESLACPFMKWKLRAIPVVKMFTVKQQADGTLQPKIKKYLVDIGSTAFRKFKLYRKIWALEDSYRFLGPLQIETPPEMHSDNFPPLTLLLNHNFWQRHQGCIEIPDTTY

SEQ ID NO: 43399 - protein, 172 aa, Brassica napus
  misc_feature (125)..(125): Xaa can be any naturally occurring amino acid
  misc_feature (159)..(159): Xaa can be any naturally occurring amino acid
  unsure (1)..(172): unsure at all Xaa locations
MARFVDPLVVGRVIGEVVDLFVPSISMTVAYDGPKDISNGCLLKPSATAAPPLVRISGRRNDLYTLIMTDPDAPSPSNPTMREYLHWIVINIPGGTDATKGEEVVEYMGPRPPVGIHRYVLVLFXQKTRVHAEAPGDRANFKTRAFAAAHELGLPTAVXYFNAQKEPASRRR

SEQ ID NO: 43400 - protein, 179 aa, Zea mays
  misc_feature (35)..(35): Xaa can be any naturally occurring amino acid
  misc_feature (127)..(127): Xaa can be any naturally occurring amino acid
  misc_feature (135)..(135): Xaa can be any naturally occurring amino acid
  unsure (1)..(179): unsure at all Xaa locations
KFLVNAVHTMEELKLTGNHLKGSRPLLTFSTNFDXQPHWKLVKEMITQIFATPKDHRKAKPFHDHVFVFSIVDGHVWFRNYQISVPHNEIDKVDKGGLDKMTLIEVGPRFCLNPIKIFGGSFGGSYXYENPYYIXIRALEKRQKAGKYAKKVKAKVRRKMHEMENTLEPDEFAELWKGE

SEQ ID NO: 43401 - protein, 171 aa, Clostridium thermocellum ATCC 27405
MDLKAKLREVPDFPKEGINFIDITTVLQDPEALKECIDSMKKKVESFGEFDIIVGAESRGFIFGAPLAYALGKGFVPIRKKGKLPYKTISVEYELEYGTDILEMHIDAIKKGQRVVIVDDLLATGGTTKSNIKLVEQLGGEILGIVYFVELTFLNGREKLKGYNVESIVQY

SEQ ID NO: 43402 - protein, 435 aa, Cytophaga hutchinsonii ATCC 33406
MIAIIGAGISGLTLAYQLQQAGKPYILFESNSRPGGYINSQRFGKYLLEVGPNSILVDKKLEEFIHELNLDKLFEPAAIINKNRFIYKDANIQQVPSGPLSFLTGRFFSAKTKYAIFKELFNKSISKENETVYDFFARRFSAPFTQYTIDPFATGVYAGDIKQLLIEETFPQLVELEKQYGSIIKGIFKKGFGEKRKTGTFVHGLQTLTDTLAAQLHSLQLNTRVLNLRKQMDKIVLTTDTKHGIEELTFDKVVVCGTTFQAATLIKDSYPDLSAILSQVQYASMKAVFAAFKRTDVTHPMNGFGCLYPSAEQSFLAGTIWNSSIFNDRCPADEVLTTSFIGGMHHPEYTALSESELEQRAIQQLSKDLGITGKPTFTHVAGWNKAIPQYDIYLKKARLASKLLSDDHIYFRSNWTNGISLGNCIQSARDLALIL

SEQ ID NO: 43403 - protein, 481 aa, Burkholderia pseudomallei K96243
MPLRDHAAYRRETLRWCGQRAARARTLDVFDPYSGLRVGTVPLATVDDVRRAFDYAVAYRPALSRYERSQILERAAARLTARAEEASTLISLESGLSKQDSRYEIGRVADVFKFASIEALRDDAQSYSCDLTPHGKSRRVFSQRQPLDGVIVAITPFNHPMNQVAHKIAPAIATNNRVIVKPSEKVPLSALYLADVLYEAGLPEPMLQVLTGDPREIADELLTHPSATLITFTGGVAIGKSIAAKAGYRRIVLELGGNDPLIVLDDADLERAAALAAQGSYKNSGQRCTAVKRILVHKRVAPRFTELLVEHTRAWTYGDPFDPANRMGTVIDEAAAALFEARVDEAVAQGARLLTGNARRGALYAPTVLDRVDASMTLVREETFGPVSPIIAFDTIDDAIRISNGTAFGLSSGVCTDRADAIVRFVNELNVGTVNVWEVPGYRLELTPFGGIKDSGLGYKEGVQEAMKSFTNLKTFSLPWA

SEQ ID NO: 43404 - protein, 206 aa, Saccharomyces cerevisiae
MNSEYDYLFKLLLIGNSGVGKSCLLLRFSDDTYTNDYISTIGVDFKIKTVELDGKTVKLQIWDTAGQERFRTITSSYYRGSHGIIIVYDVTDQESFNGVKMWLQEIDRYATSTVLKLLVGNKCDLKDKRVVEYDVAKEFADANKMPFLETSALDSTNVEDAFLTMARQIKQSMSQQNLNETTQKKEDKGNVNLKGQSLTNTGGGCC

SEQ ID NO: 43405 - protein, 180 aa, Dehalococcoides ethenogenes 195
MSRFAVLLAEGFEEIEFCTITDILRRADLEVKIVGLKNGLTGGSRGIRIMPDLGIDELKSSDYEVLVLPGGNPGFINMGKDQRVLELIRSAHAEGKYLAAICAGPAVLSRAGVINGKEVAIYPGVKHLLKGCTACDLRVKVEGKLITGRSPQAAMDFALTLMDMFAKPQAAKVVRDEMLV

SEQ ID NO: 43406 - protein, 426 aa, Escherichia coli
MRKSENLYQAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKYTLTCTYNDLASVRAAFEQYPQEIACIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGVHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 43407 - protein, 795 aa, Pasteurella multocida subsp. multocida str. Pm70
MKFSESWVREWVNPAISTAQLCDQITMLGLEVDGVEKVAGDFSGVVVGEVVECAQHPDADKLRVTKVNVGGDRLLDIVCGAPNCRQGLKVACATEGAVLPGDFKIKKTKLRGQPSEGMLCSFSELGIDVESSGIIELPQNAPVGTNLRDYLTLDDNTVEISLTPNRADCLSIAGIAREIGVVNKLAVNTPHFESVKATITDKVDIQLHAPEACPRYLLRVVKNVNVQAPSPMWLQEKLRRCGIRSIDPVVDVTNYILLELGQPMHAFDAAKVAQPVQVRMAKSGEALVLLDGSTAKLKDNTLLIADQNGPLAMAGIFGGQASGVNAETKDIILEAAFFAPLAIAGRARQYGLHTDSSHRFERGVDFELQRQAMERATALLVEICGGEVGDICEVASDAFLPKLNQVSLRREKLDALLGHHIETETVTDILTRLGLQVSYANDVWQVTSASWRFDIEIEEDLVEEIARIYGYNSIPNKAPLAHLRMREHKEADLDLARIKTALVDADYQEAITYSFVDPKIQSVLHPQQDALVLPNPISVEMSAMRLSLLSGLLGAVQYNQNRQQTRVRLFETGLRFIPDTQAEFGVRQEFVLAAVMTGNKKAEHWAGKAESVDFFDLKGDLESILSLTGTRNLVKFVAKSYPALHPGQSAAIMLNGEEIGFIGTLHPNAAKQLGLNGKTVVFEILWQAIATRQVVQAKEISRFPANRRDLAIVVAESVAASDVLDACREVAGETLTQVNLFDVYQGNGVAEGHKSLAISLIIQDNEKTLEEDDINAVVSVVLSELKQRFNAYLRD

SEQ ID NO: 43408 - protein, 387 aa, Pseudomonas syringae pv. phaseolicola 1448A
MTVLKMTDLDLQGKRVLIREDLNVPVKDGVVSSDARILASLPTIRLALEKGAAVMVCSHLGRPTEGEFSAENSLKPVADYLSKALGRDVPLVADYLDGVDVKAGDVVLFENVRFNKGEKKNADELAQKYAALCDVFVMDAFGTAHRAEGSTHGVAKFAKVAAAGPLLAAELEALGKALGAPAQPMTAIVAGSKVSTKLDVLNSLSGICNQLIVGGGIANTFLAAAGHKVGKSLYEPDLLDTARAIAAKVSVPLPTDVVVAKEFAESATATVKLIADVADDDMILDIGPQTAAHFAELLKSSGTILWNGPVGVFEFDQFGEGTKTLAKAIGESQAFSIAGGGDTLAAIDKYGVAEQISYISTGGGAFLEFVEGKVLPAVEVLEQRAKA

SEQ ID NO: 43409 - protein, 415 aa, Azoarcus sp. BH72
MRKQKLVMVGNGMAGVKTLEELLKHAPDAFEITVFGAEPHGNYNRILLSPVLAGEMSLPEIMLNDIGWYRAHGITLHAGRRVVEIDRARRIVRADDGTEAAYDRLLLATGSAPFILPVPGRELPGVIAYRDIADTEAMIDAARQHRHAVVIGAGLLGLEAANGLVLRGMDVTVVHLGGWIMDRQLDQPAAELLQASLEAKGMRFRLQAQTAALLPGTGGRVAAVQLQDGSTLPADLVVMAAGIRPNTALAEAAKLRCERGIVVHDTLQTVTDPRIYAVGECVNHRGTAYGLVAPLFEQARVCANHLAGHGIGRYTGSVTSTKLKVTGVDVFSAGDFMGGEGCDEIVLHDRAGGIYKKLVLKENRLAGAVMVGDTADGAWYFQLVREGGDVSALRDHMMFGQRFTQSQLAGAACPG

SEQ ID NO: 43410 - protein, 924 aa, Azoarcus sp. BH72
MEPHMNLADLGLKANETRSVCCYCGTGCGVIVERDGGRITGVRGDPAHPANFGRLCTKGSTLHLAAAPGGRALYPELRSTRADSRRRVGWDEALDTAADRFAVIIREHGPDAVAFYISGQLLTEDYYVFNKLARALVGTNNIDSNSRLCMSSAVAGYKGTLGTDSVPASYEDLALADHLLITGANPAWAHPIVFRRIEEAKRANPDLFITVIDPRRTETAEFADLHLQIAPGTDVLLYNAMLHVLLWEDLIDRDFIRDHTSGFDALREQLADCSPAKIAGLCGVPADKIVEAARRFGKARGAVSLWCQGLNQSHHGVANNSALIHLHLATGQIGRPGAGPFSLTGQPNAMGGREVGAMATILPAHRDPANADDRADLARLWGVPALPEAPGLAAVQMFDAIGEGRIKAVWIACTNPAQSLPDQDKVRAALDKAEFVVVQEAFADTETVPYADLLLPAASWGEKSGSVTNSERRVSRVRGVVPAPGEARPDWAIAADFARRLQARLAPAAAAGFDWADEAAVFAEHVSLSAGRDCDMSGLSYGVLEALGPQQWPYPQGAGGGTPRLFTDGRFNTADGRARFNPVGFPVRHAPLPEPTDAAHPFVLTTGRLRDQWHGMSRTGKVAALWGHTPRAEVAVNPADLDRRGLAAGQLVKVASRRGALVLPVAADSGVAPGQAWIPMHWGGATLAQSGTNLVTSAATDPVSKQPALKQAAVSIAPVDFGWRAAWAAQARDGAEAVAWMAALQPRLAAFGYAALSLAGRERSVVVLQVADTAPAPAERLADIDQLFGCVAEDHAVLAFRDSRRGIDKRARIADGTLVAIRLVGEVAAADWLIAAIVAGEPAEPLRPWLFAPLSRPPAGLARAERTVCNCFGIGEQQIREAIGGGADLDALQGALKCGTACGSCLPALRRMVAEGAVAEVAGA

SEQ ID NO: 43411 - protein, 175 aa, Triticum aestivum
MAPTVMASSATSVAPFQGLKSTAGLPVSRRSNGASLGSVSNGGRIRCMQVWPIEGIKKCETLSYLPPLNTEALLKQVDYLIRSKWVPCLEYSKVGFIFREHNTSPGYYDGRYWTMWKLPMFGCTDATQVINEVEEVNKEYPDAYVRIIGFDNMRQVQCVSFIAFKPPGCEESGKA

SEQ ID NO: 43412 - protein, 762 aa, Desulfitobacterium hafniense DCB-2
MRKTPGRNELIFVSERTYHGLVLDRFQEEALDAIDEGQSVIVAAPTGTGKTLVADYLVEKVMAEGRRIIYTAPIKALSNQKFKDYKQLFGVDQVGILTGDVVLNSEAPLLIMTTEIFRNQVITNDPSLESVSYIIFDEIHWLNDEERGTVWEESIILAPPHMKLLGLSATIANAQQLVDWIGTIRQEDVALIQENRRIVPLEYYYFSRDTGLVNYEKLWKYYRQQIQSAPPTEGSLFAPTNHLDLIKVIQKQYLPALYFVFSRKQCADKASELAYLTNYLNPQEKRQVEDAFLEHFGPESDWSPSTRLLRRLAVKGIAFHHAGLMPSQKVLVEELFLKRLVHVLYCTETFSVGINYPVRSVCFDTLNKFDGRNFRPLANHEFFQMSGRAGRRGLDERGYSFALVDLNYMEKSPPPRFNINRLEPLTSQFKLSYNTVLNLQATLSYEQIQIYFQKSFAAHSNLHTHGQLIAELAQLEEQFNGKGEHVCRHTDSYACPVKYLPKKKELDRLKRAYQALGPRRQNRVYGREMARKIKNWEKLLATTPQKCPNAKLALCEEESKQRRKLQQRMIEIRKDLKTLPDQNFFFNEFQFKKNQLIQMGYIREDELLPRGECACHIYVQELLVTELIFSGIMETLDDDQLNALLSAIDFEARKNDYFQRLPVLDWTPLQDLVRYIQSVCGPESVRYDPRVAVIVYSWSQGVSFAEVQRLSNLDEGDIISVIRRTIDLLRQMRDAVKEPALLQRLKLCMDKLDRDEAAVLAL

SEQ ID NO: 43413 - protein, 512 aa, Thermoanaerobacter tengcongensis MB4
MGIKRETILILDFGGQYTQLIARRIREANVYCEIVPYDISPEEIKKIDPKGIVLSGGPASVYVKNAPKCDKEIFELGYPVLGICYGVQLMTELLGGKVAPAPVREYGKTEVVINNTIPLFKGIERDTIVWMSHTDQIELPPPDFKVVASTENCPIAAIANVEKKLYGVQFHPEVSHTHRGTEIIRNFLFEVCDCSADWTMDSLIEQTVKEVRAKVGNHKAVCALSGGVDSAVAAVLVDRAIHDQLVCIFVDTGLLRTNEGDMVIETFRKNYDMNIIRVDAKDRFLSRLKGVTDPEEKRKIIGNVFIEVFKEEAMKIGDVKFLVQGTLYPDVIESGHGISSTIKSHHNVGGLPEDIGFELIEPLRMLFKDEVRQVGKELGIPDEILYRQPFPGPGLAVRIVGEVTEEKLEILRLADSIVQREMKRFGWYNKVWQSFAILPGIKSVGVMGDERTYGYAIILRVVDSMDGMTADWTKLPYEILESISTSITNEVPGVNRVLYDITSKPPATIEWE

SEQ ID NO: 43414 - protein, 526 aa, Candida albicans SC5314
MSANIQALMKSYVNFDEHTSGSAARGILIGMFAAFGGFLFGYDTGTISGVLSMDYVKARFPNNKTDFTSGESSLIVSILSVGTFVGSLIAPLFSDRIGRRWTLILSTLIVFNLGVLLQTVATEKKLLIAGRAIAGTGVGLISSVIPNYISETTPKWARGAVTASYQWMITWGLLIAACANKGSQGRKDSGSYRIPIGIQFLWALILGIGFLFLPETPRYWVSKSEETKAKDSLRRIRNLPVDHPDLVSEYDDIKANFDFESKYATSSWTQVFKNVNKQHHRLFTGVAIQALQQLTGINFIFYYGTQFFKRSGIEDPFLIQLATNIVNVGMTVPGIILVETWGRRPLLMAGSVVMAVSQLIVAIVGVAASSHAANQCLVAFSCIFIAGFAATWGPLCWAICGESFALNVRSKSISLCTASNWLWNFGIGYATPYMVDSGKGNADLGSKVFFIWGGCNVIGGLFAYFMVYETKSLTLEQVDELYLKVDHAWQSKGFVPSVHAFRDDGDIEHISSDGKAEMVEVDENSV

SEQ ID NO: 43415 - protein, 882 aa, Yarrowia lipolytica CLIB122
MSFEKEKPVVTDEKDTAVGEVHDVCEVQPHIMDWIARQLGIPPNDIDGTYPPEVAFMAEKFSEMTESEAVEICTKALHSHRVDPNFKDAYKDQLADLLDALNGTNYSDEKDDLESPYNDPVERAMLLKYWATLFNWWSPYPEVRAVTDPIDEDNTTVMTWRVILLGTIWVAVSAFVNQFFEPRLPGISLSASVVQLLLYPSGRLLQYCLPDWGLTFRGNRYTLNPGRWSQKEQLLCTIMVNCAAGTPYVTSNIFVQYMPMFYNQSWAGGFGYSFLLMLVTQFMGFGLAGLLRRVAVYPIMSMWPTILPTLAVNKALLAPNRRESINGWTLSRYTFFFIVFIGSFLYFWVPNYLWQAFSTWNWMTWIAPNNADLAIVTGSFGGMGYNPIPTFDWNMITGGISPILMPLYTSINFVGGVFVSGLVIMAIYYTNNNYTRWIPINTNELYDNTGNPFDVKKILTNFVFDDEKYRKYSPPYYSAANLVTYGAFFAMYPMSFVYSILCHYETMGVALKDTWKSLRYIHRSNFEGLEDPFSRIQRKHKEVPDWWFYCILLIMFGLSIALVEHWPTDTPVWVIVLCLGLVVIFLFPFTIFASLTGVSLTLNVLAELIVGYALPGKFQALNTAKALTVQIAGQAQNYASDQKLTHYAHLPPRSIFSCQLWATLVNGLVCLGVLQFQMHDVKDICDPHNKLKFTCPGETTFFSASVIWGVIGPKRIFDHQYPALKWMFLLGAGLAMCFWAAQILIPNLLMKKYPIKTRKIQKIQRMLLSVNPILVVNAFIAGWAPTNLSYFTGGLYVALLFNGYIKNRFLAWWRKYAYVFSAAMDTGIALSGIIIFFAVQYNDYSISWWGNNVIAEGLDYNGVPPPPLPDVGYFGPGPDHYP

SEQ ID NO: 43416 - protein, 223 aa, Escherichia coli
MLELQEASRLPERLGDDFVRAANIILHCEGKVVVSGIGKSGHIGKKIAATLASTGTPAFFVHPAEALHGDLGMIESRDVMLFISYSGGAKELDLIIPRLEDKSIALLAMTGKPTSPLGLAAKAVLDISVEREACPMHLAPTSSTVNTLMMGDALAMAVMQARGFNEEDFARSHPAGALGARLLNKVHHLMRRDDAIPQVAVNRQRDGCDAGTQPHRSGAGGGM

SEQ ID NO: 43417 - protein, 293 aa, Thermus thermophilus HB27
MEKGTFHIKTGFAEMFKGGVIMDVTTPEQAVIAEEAGAVAVMALERVPADIRAQGGVARMSDPKIIKEIMAAVSIPVMAKVRIGHFVEAMILEAIGVDFIDESEVLTPADEEHHIDKWKFKVPFVCGARNLGEALRRIAEGAAMIRTKGEAGTGNVVEAVRHARTMWKEIRYVQSLREDELMAYAKEIGAPFELVKWVHDHGRLPVVNFAAGGIATPADAALMMHLGMDGVFVGSGIFKSGDPRKRARAIVRAVAHYNDPEVLAEVSEDLGEPMVGINLDQLKEEERLAKRGW

SEQ ID NO: 43418 - protein, 901 aa, Bordetella parapertussis 12822
MSSFAQAGALAAANDEDTLETQEWLEALAAVLDREGPQRAHYLLERLIDEARRSGAHIPFSPNTAYVNTIPPGLEPAHPGNLELEARIRSYVRWNAMAMVVRANKHNPPDGGDLGGHIASFASLATMIGCGQNHFWHGETEEHGGDLVYFQGHTSPGMYGRAYLEGRLTEDQLNHFRREVDGKGLSSYPHPKLMPDFWQFPTVSMGLGPLMAIYQARFLKYLHARGIADTSNRKVWVFCGDGEMDEPESLGAIALAAREKLDNLIFVINCNLQRLDGPVRGNGKIIQELEGDFRGSGWNVIKLIWGGYWDPLLAHDKEGILRRIMEEAVDGEYQAYKANDGKYVREHFFGKHPKLLEMVARMSDEDIWRLNRGGHDPHKVYAAFDAASKHAGQPTVILAKTIKGYGMGHVGQAKNPTHQQKKLELDSIREFRDRFGIPIPDDKLEELPYYKPAEDSPEMQYLHERRKALGGYLPKRRAKADEQLKAPALDAFKAVLEPTAEGREISTTQAFVRVLNQILRDKDLGPRVVPILADESRTFGMEGLFRQIGIYAPEGQKYTPVDKDQVMYYKESADGQLLQEGINEAGAMSSWMAAATSYSTNNRIMVPFYIYYSMFGFQRVGDLAWAAGDMQARGFLLGGTAGRTTLNGEGLQHEDGHSHLLASTIPNCVSYDPTFAHELAVIIQHGLKRMVEDQENVYYYLTVMNENYPQPGLTAGDEEGIIRGMYKLKSHGKGKQRVQLMGSGTILREVMAAQELLEADWGVASDIWSVTSLTELRRDGLDAERHNLLHPEGKQQVPYVTTQLAKSEGPIIASTDYMKLFADQIRPFVPKDRTYKVLGTDGFGRSDFRYKLREHFEVDRHFVVLASLRALADEGKIPAAKVAEAIKKYGINPNKANPHHA

SEQ ID NO: 43419 - protein, 377 aa, Oceanospirillum sp. MED92
MSKRDYYEVLGVSRDSSDRDIKKAFRRMAMKYHPDRNPDDKEAEESFKEVNEAYEVLSDAQKKAAYDQYGHAGVDPNMRGGHGGGFEGNFSDIFGDVFGDIFGGGGGRGGRSSVQRGADLRYNMEMTLEEAVRGVEKEIRVPTLVGCETCDGSGAKPGTSAKICGTCGGQGQVRMQQGFFSVQQTCPTCHGEGKVISDPCNDCHGHGRIEKTKTLNVKIPAGVDTGDRIRLAGEGEAGTHGGPAGDLYVQVHVKDHPIFERDGKHLYCEVPISFVDAALGGELEVPTLDGRVKLKVPSETQTGKMFRLRGKGISPVRGGSTGDLLVKVVVETPVNLSSRQKELLREFQDEMEQGTHKHSPKKHGFFDSVKKFFEDMT

SEQ ID NO: 43420 - protein, 540 aa, Bordetella parapertussis 12822
MSNIVEIKVPDIGDFKEVEVIEVLVSAGDTIKAEQSLITVESDKASMEIPASAAGVVKSVKVKVGDKIAEGTVILEVEAAGEAAAAPKAEQAPEAAEAPKADAAKAEAPAAAGPIEVKVPDIGDFKEVEVIEVLVAEGDTIKAEQSLITVESDKASMEIPASAGGVVQSLKVKVGDKVAMGTVIAVVQGQGAAAPAAKAEAPAAAEPAASASASAPAPAQRPAPAAALQDEDLKPGQLPHASPSVRKFARELGVNLSRVTGSAAKGRITADDVRAYVKQALSAGAPAGASGGGDGAALGLLPWPKIDFTKFGPIEAKPLSRIKKISGANLHRNWVMIPHVTNNDEADITDLEALRVALNKENEKSGVKVTMLAFLIKAVVAALKKFPEFNASLDGDNLVLKQYYHIGFAADTPNGLVVPVVRDADKKGILELARETSELARKAREGKVSPAEMQGGCFSISSLGGIGGTHFTPIINAPEVAILGVSRSAHKPVWDGKQFVPRLTLPLSLSYDHRVIDGASAARFNAYLGQLLADFRRIAL

SEQ ID NO: 43421 - protein, 295 aa, delta proteobacterium MLMS-1
MSSQFSGTFVAIATPFNDDGSIDEPGLVELIEFQLAGGTNGIVPCGTTGESATMSHEEHHRVVELTVKTVAGRVPVLAGAGSNSTSETIELTRHAQNAGADGVLLITPYYNKPSQEGLYQHFKTVAESVEIPMVLYNVPGRTAVNMLPATVARCAALKNIVGIKEASANLQQVSEVILLCPEDFMVLSGDDFTSMATVLVGGHGVISVSSNVDPRRMAEMIAAARQGEVSRANELHYQLLPLMQAMFFDTNPVPAKTALALMGRIKSPRVRQPLWQMNDEAQGRLQRVLKERGLL

SEQ ID NO: 43422 - protein, 591 aa, Bordetella parapertussis 12822
MSNIVEIKVPDIGDFKEVEVIEVLVAAGDTIKAEQSLITVESDKASMEIPASSAGVVKSVKVKVGDKVAEGTVILDVEAAGEAAAAPKAEAPKAEAPKADAPKAPAAKASAPAAAAYSGSADLECDMLVLGAGPGGYSAAFRAADLGMDTVMVERYATLGGVCLNVGCIPSKALLHNAAVIDEARALAAHGISFGEPKVDLDKLRGYKDGVVAKLTGGLAGMARACKVRVATGTGEFADPHHLTVTDGEGKKQTIRFKQAIIAAGSQSVKLPFLPDDERIVDSTGALQLRAIPKKMLIIGGGIIGLEMGTVYSTLGARLDVVEMLDGLMQGADRDLVKVWQKMNAPRFDNIMLKTKTVGAEARKDGIYVSFEGEGAPKEPQRYDLVLQAVGRSPNGKKIGAERAGVAVTERGFIEVDRQMRTNVPHIYAIGDVVGQPMLAHKAVHEGHVAAEAAHGEKSFFDARVIPSVAYTDPEVAWVGLTEDEAKKQGVKVEKGLFPWAASGRAIANGRDEGFTKLLFDAETHRIVGGGIVGTHAGDLISEIALAIEMGADMVDIGKTIHPHPTLGESVGMAAEVAEGVCTDLPPMRKK

SEQ ID NO: 43423 - protein, 493 aa, Ustilago maydis 521
MMNTKLKDLSLLEASDFLKAPDSLDTSDNESFDVMDPGSGRPICRLTASNLKDVDYAIQAASQAFPSYSAIPARERAMLLLNFDKLIRDNLDDLAWILVYETGKPLEEARAEVQYALTFSWWYVGETERVQGQVVKSATNPSLRYLTVWQPVGPVAILTPWNFPVALFVRKAVSALAAGCTIVAKPSPETPLSTLAVANLLHRAGFPSGSVNIVLASYRNTPAIGQALCTDLRIKKLSFTGSTRVGRLLMQQCAPTLKKLTLELGGLGAYLIFDDADIEAAATALVANKLRHAGQTCISAQRTFVHESIVDRVLKCIIELLDRVTLGHGAQPSTTLGPLQTERSQQKVREHIEDARAKGATVYTSKAAVPSSGYFVAPTLIVGCTAEMLVFQEESFGPLISLTSFATEQEAVALANKTDMGLTSYVFTKDSARLWRMFEQLKAGNVGLNVGGSTTAAEIPFGGVDQSGFGKEAGIGAGLKEYMVEKSATMSIA

SEQ ID NO: 43424 - protein, 241 aa, Prochlorococcus marinus str. AS9601
MRKSVIAGNWKMHMTCAEAKSYLKEFIPLIKDINEDRKVVIAPPFTAISTFSNHSDFDYLDISSQNIHWEDQGAFTAEISPKMLLEHGVSYAIVGHSEPRKYFSESDEQINKRAVFAQSSGLTPIVCVGETLEQRERGEAVRVITRQVEQGLENTDPSNLIVAYEPIWAIGTGKTCQAEDANKICSLIRKLIGFDDVIIQYGGSVKPNNIDEIMSMSDIDGVLVGGASLDPNSFARIANYQ

SEQ ID NO: 43425 - protein, 537 aa, Ustilago maydis 521
MGSKYHYTPRRISNDHFGIDIGLRGNALLSVITATCAVAFCTVGIENGLLGGVINTTQFKETFNDPDANTIGNIVSLYEIGCVIGALSTFVVGDVLGRRRTILLSSILMLIGAAIQAASSTVGVMIAGRIISGLGMGAINSTVPILQAETSPAVSRGQLVALDLTVLNIGIVFAYWMDYGFAYSGLTGSKVWRIPVALQSVFIIVLVLTTLIIPDSPRWLAKKGRHEEAIAVLERLHNASIDSPEVQNSYAGIQQALEHERAAANTGWASLVAKDSIQTRKRLFLACFIQAAQQLSGINALIYYSGTLFSKSIGLDDKKSALMAGGLNMCLILGSIISIFFIDRVGRKKLLIPCIAGMSAVMCVQTGLVKVIQDGTQNANYGRAASAMLFVFEFFFSLGFQATVWLIPSEVLPLLIRTKGSALSTASNWIFNFAIVKFTPSALQNIGWRTYIIFAVLNACWVPVIYFFLPETKGRSLEEIDELFATDDWHIDNSHAATDTKAAAHRSGDVEYADIDAGSNKSSFKGDNIVTSTGDSK

SEQ ID NO: 43426 - protein, 1098 aa, Prochlorococcus marinus str. AS9601
MPQRGDLKKILILGSGPIVIGQACEFDYSGTQACKALRNAGYEVVLINSNPASIMTDPEIASKTYIEPLTPEIVSQIILREKPDAILPTMGGQTALNLAVKLSESDFLKENNVELIGADLRAINKAEDRKLFKESMEKINVNVCPSGIASNLDEAVEVSKKISSYPLIIRPAFTLGGVGGGIAFNLEEFVVLCKSGLEESPSNQILIEKSLIGWKEFELEVMRDTADNVVIICSIENLDPMGVHTGDSITVAPAQTLTDKEYQRLRDLSLKIIREVGVETGGSNIQFALNPSNGEVIVIEMNPRVSRSSALASKATGFPIAKIAALLSVGYTLDEIINDITKKTPACFEPSIDYVVTKIPRFAFEKFKGSTNTLSTAMKSVGESMAIGRSFEESFQKALRSLEVGVFGWECDSLDEFKNESHIKNSLRNPTSERILMVKKAMQLGKTNSYIQEVTNIDLWFIEKLRNIFNFENEFLKEKELYTLDRDLMLHAKQLGFSDQQIAKLTNSDFFEVRRYRKKLNIIPIYKNVDTCSAEFSSSTPYHYSTYEEAFINFNSQTFDSEISENSKSKKIMILGGGPNRIGQGIEFDYCCCHASYQASTNGYKTIMVNSNPETVSTDYDTSDILYFEPVTLEDVLNIIEAENPYGLIVQFGGQTPLKLSLPLSEWLKSNEGLRTGSKILGTSPISIDLAEDREEFTKILKELAIRQPLNGIAHNQKEAAVVAKNIGFPLVVRPSYVLGGRAMEIVKDENELSRYISEAVKVSPDHPILLDQYLNNAIEIDVDALCDSEGSVVIAGLMEHVEPAGIHSGDSACCLPSISLSKSTIENVKKWTKLIAQRLNVVGLINLQFAVTNTNNKEKKLFILEANPRASRTVPFVSKAIGKPVAKLATQLMQGFTLEDVNFTQEFYPKYQAVKEAVLPFKRFPGSDTLLGPEMKSTGEVMGLAKDFGIAYAKSELAAGNGVPSEGVAFLSTNDLDKKLLEEVARELMILGFKLIATKGTAAYLINLGIQVEEVLKVHEGRPNIEDLIRSGLVQLIINTPIGSQALHDDAYLRRAALEYNIPTFTTIPGAKAAIKAIKALQCNNIDSYSLQEIHNF

SEQ ID NO: 43427 - protein, 280 aa, Bradyrhizobium sp. BTAi1
MTLAAKPRAACLIGWPAAHSRSPLIHHHWLHKLGIAGGYTIEAVPPEELADFVTHLHGRGFVGANVTIPHKERVLELTKPDSRARAVGAANTLWYEHGILRATNTDVEGFVGNLDAAAPGWDRTDVALVLGSGGSARAVVFGLLERGIGRVHVINRTAARAQALADQFGPRVVAGGWEQVSALLPQAGLLVNTTSLGMHGQPPLAIEIGRLPEQAVVVDIVYVPLETQLLVAARARGLRTADGLGMLLHQAVRGFELWFGERPQVTPELRALVEADLRNR

SEQ ID NO: 43428 - protein, 114 aa, Clostridium thermocellum ATCC 27405
MENCVFCKIIKRELPSTIYYEDERVIAIKDINPAAPVHVLIIPKEHIANVKEINESNAQILIDIHKAANKVAEDLGIAEKGYRLITNCGVAAGQTVFHLHYHLLGGVDMGPKIL

SEQ ID NO: 43429 - protein, 456 aa, Streptococcus thermophilus LMG 18311
MVFIKETPIMAITAADIRREVKEKNVTFLRLMFSDILGIMKNVEIPATDEQLDKVLSNKVMFDGSSIEGFVRINESDMYLYPDLDTWTVFPWGDENGSVAGLICDIYTSAGEPFAGDPRGNLKKALRHMEEVGYKSFNLGPEPEFFLLKLDEQGNPTLEVNDKGGYFDLAPTDLADNTRREIVNVLTEMGFEVEASHHEVGVGQHEIDFKYTEVLKACDNIQIFKLVVKTIARKHGLYATFMAKPKYGIAGSGMHCNMSLFTEEGNAFFDPEDPHGMQLSQDAYYFLGGLMKHAYNYTAIINPTVNSYKRLVPGYEAPVYIAWAGSNRSPLIRVPASRGMGTRLELRSVDPMANPYLAMAVLLEAGLDGIINKIEAPAPIETNIYSMSPEERKEAGIIDLPSTLRNALKALETDEVVRQALGNHIYTNFLDAKRLEWASYATFVSQWEIDNYLDLY

SEQ ID NO: 43430 - protein, 489 aa, Bacillus cereus ATCC 10987
MNKELLADKLKVKDAKLFIDGKYVDSVCGETFDTFNPATNRKLASIAKANEEDTKRAIDVAERTFKSGIWSKMPVEERSNILCKMSDLIMERVDELAYIETLDVGKPIKESKGFDIPRSAHNFRFFAEMAKYIVHEHYDKHNFMSYAKYAPAGVTSLIIPWNLPFMQMTWKASAALASGNTVVVKPASYTPLSAVMLGEIANDAGLPPGVLNIITGPGSTVGTKMTTHPAVRRISFVGESNTGKTIMRNASENLIPVSLELGGKSANIVFEDADLDEAVQGSIEAIYRNQGEICLAGSRLLVQESVYEQFLEKFVAAVKRIKVGDPLSEDTDMGALVSKSHLETVDRYVELGISEGAKLAYGGKRVESLVEGNFYEPTILYDVDNSMRVAQEEIFGPVLVVIPFKTEEDAIRIANDSIYGLAGVVWTNDLRRAQRVVSQIDSGLLWINCWYVRDLRTPFGGSKASGIGREGGRHSFEFYTEAKTVTMKL

SEQ ID NO: 43431 - protein, 507 aa, Polaromonas sp. JS666
MSHANDISSLLQSLGIHADLNSQASATLEVHTPIDGSRLARLATTSPAEVDAALNRAHQRFLSWRDVPAPKRGELVRAFGETVRRHKPELGQLISLETGKILQEGLGEVQEVIDICEFAVGLSRQLYGLTIASERPDHKLLETWHPVGVVGIISAFNFPMAVFAWNAALALVCGNTLAWKPSEKTPLSAVALNGLLLRAAKELGLDTDGLSELLIGERSVGEALVNHPQVKLVSATGSTAMGKNVAMACAAQFKRSLLELGGNNAAIVCPSANLELVVRGAAFAAAGTAGQRCTSLRRLIVHRSVYAALVERLVSVFARLPVGNPLTEGTLVGPLIDGRAFDAMQTALASAKGLGAKVHFGQREEGAGAGGSAGHYVRPAIVELAEQAGPMLHETFAPILYVVPYDDFDEAIAMNNAVVHGLSSAVFTQDLREAERFTSACGSDCGIANVNIGTSGAEIGGAFGGEKETGGGRESGSDSWKAYMRRATNTVNYGSSLPLAQGIRFEI

SEQ ID NO: 43432 - protein, 212 aa, Oryza sativa
MKFRSDSSGGDEPRAPAAGDGGGGGDEPAKRQRTDPSSSSSQGEASSSSQPPPQQQQEEQPPEDAGEGEQPRVPDLGEDLVFEVLRRAEARTLAAAACVSRGWRQLAEDERLWEAACVREWANLGFSERQLRAVVLSLGGFRRLHAVYIRPLQWRGAGVPRQQGRRQPPVRLGRDQVQLSLSLFSIGFFQNMPCPKKDKGNDSDKNGGGQCG

SEQ ID NO: 43433 - protein, 323 aa, Zea mays
MAAGRELVVSFGEMLIDFVPTVAGVSLAEAPAFLKAAGGAPANVAIAVSRLGGGAAFVGKLGDDEFGRMLAAILRDNGVDGGGVVFDAGARTALAFVTLRADGEREFMFYRNPSADMLLTADELNVGLIRRAAVFHYGSISLIAEPCRTAHLRAMEIAKEAGALLSYDPNLREALWPSREEARTQILSIWDQADIVKVSEVELEFLTGINSVEDDVVMKLWRPTMKLLLVTLGDQGCKYYTRDFHGAVPSFKVQQVDTTGAGDAFVGALLRRIVKDPSSLQDEKKLVESIKFANACGAITATKKGAIPSLPTETEVLQLIEKA

SEQ ID NO: 43434 - protein, 253 aa, Cytophaga hutchinsonii ATCC 33406
MTGTAWPIIIFFVAHWYLSLFSQTFFLHRYSAHAMFKMNKFWEKFFFIFLYLTQGSSYLVPRAYGALHRMHHAYSDTEKDPHSPLYSRNAFVMMWKTKDIYNAVLRREAQVEDKFNKNLPEWAFIDNIGDMWISRIIWGTLYVLFYIYFVPADMWYLYLLLPIHFLMGPVHGAIVNWFGHKLGYQNFDNKDASRNTLALDVLLGGELFQNNHHMYGSRPNFAMKWFEFDPTYPVIKVLHYVRIIRLVNPDAKA

SEQ ID NO: 43435 - protein, 105 aa, Magnetospirillum magnetotacticum MS-1
MRLLDATPELLAAHYAEHEGKPFFQPLVDFMLSGKILAVVAEGQGVVPGFRSLAGATNPTEALPGTIRGDLGRDWGLKVQQNLVHGSDSPESAAREIALWFPELG

SEQ ID NO: 43436 - protein, 333 aa, Azoarcus sp. BH72
MRRVTLTQFLIEQQRAGRVSADLRLLIEVVARAVKAISVNVSKGALAGVLGEAGTDNVQGEAQKKLDVIANEILLQANEWGGHLAAMASEEVETVHQIPFDYPKGGYLLLFDPLDGSSNIDVNISVGTIFSVLRFPEGEAEPTEQSFMQPGREQVAAGYAVYGPSTQLVLTVGHGVHAFTLDREMGSFIYTHPFMTIPDDTHEFAINASNARFWEEPVQRYVGELQAGKTGPRGKDFNMRWVASMVADVHRILTRGGIFMYPLDEKCRAQGGKLRLMYEANPMAMLVEQAGGAATTGRERILDLMPTKLHQRVPVILGSRNEVERVTAYHRES

SEQ ID NO: 43437 - protein, 360 aa, Oryza sativa
MEQPKPPSVAASAAEAQNPNAFTCELPHSIYALAFSPSAPVLAAGSFLEDLHNRVSLLSFDPVHPTAASFRALPALSFDHPYPPTKLQFHPRAASAPHLLASSSDALRLWLAPLDDLAATATAAAPELRSVLDNRKTSASEFCAPLTSFDWNEAEPRRIGTASIDTTCTIWDIERGVVETQLIAHDKAVHDIAWGENGIFASVSADGSVRVFDLRDKEHSTIFYESPRPDTPLLRLAWNRYDFHYMATLLMDSSAVVVLDMRAPGVPVAELHRHRACANAVAWAPQATRHLCSAGDDGQALIWELPATPGAVPAEGIDPVMVYDAGAEINQLQWAAAYPEWISIAFENKVQLLRVRRDVF

SEQ ID NO: 43438 - protein, 549 aa, Mycobacterium smegmatis str. MC2 155
MSADITETPAWQALSDHHAEIGDRHLTELFADDPARGTELALTVGDLYIDYSKHRVTRRTLDLLVDLARAAGLEERRDAMFAGEHINTSEDRAVLHTALRLPRDAKLVVDGQDVVADVHDVLDRMGDFTDRLRSGEWTGATGERITTVVNIGIGGSDLGPVMVYDALRHYADAGISARFVSNVDPADLVAKLDGLEPAKTLFIVASKTFSTLETLTNATAARRWLTDALGDAAVAKHFVAVSTNKKLVDEFGINTDNMFGFWDWVGGRYSVDSAIGLSVMAVIGKERFAEFLAGFHIVDEHFRTAPLHQNAPALLGLIGLWYSNFFGAQSRAVLPYSNDLSRFAAYLQQLTMESNGKSVRADGTPVSTDTGEIFWGEPGTNGQHAFYQLLHQGTRLVPADFIGFSQPTDDLPTADGTGSMHDLLMSNFFAQTQVLAFGKTADAIASEGTPADVVPHKVMPGNRPTTSILATKLTPSVVGQLIALYEHQVFTEGVIWGIDSFDQWGVELGKTQAKALLPVLTGDKSPAAQSDTSTDALVRRYRTERGRPA

SEQ ID NO: 43439 - protein, 399 aa, Streptococcus thermophilus LMG 18311
MAKLTVKDVELKGKKVLVRVDFNVPVKDGVITNDNRITAALPTIKYILEQGGRAILFSHLGRVKEEADKEGKSLAPVAADLAAKLGQDVKFIPGVTRGAELEAAVNSLEDGQVLLVENTRFEDVDGKKESKNDPELGKYWASLGDGIFVNDAFGTAHRAHASNVGISANVEKAVAGFLLENEIAYIQEAVENPERPFVAILGGSKVSDKIGVIENLLEKADKVLIGGGMTYTFFKAQGIEIGNSLVEEDKLDVAKALLEKSNGKLILPVDSKEANAFADYTEVKYTEGEAVDPGFLGLDIGPKSIAKFDEALTGAKTVVWNGPMGVFENPDFQAGTIGVMDAIVKQPGVKSIIGGGDSAAAAINLGYADKFSWISTGGGASMELLEGKELPGLAALTEK

SEQ ID NO: 43440 - protein, 260 aa, Brassica napus
  misc_feature (248)..(248): Xaa can be any naturally occurring amino acid
  unsure (1)..(260): unsure at all Xaa locations
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDIREKLCYIALDYEQELETANTSSSVEKNYELPDGXVITIGSERFRCP

SEQ ID NO: 43441 - protein, 100 aa, Glycine max
  misc_feature (25)..(25): Xaa can be any naturally occurring amino acid
  misc_feature (61)..(61): Xaa can be any naturally occurring amino acid
  unsure (1)..(100): unsure at all Xaa locations
LLRVTLLLQDTYRKKLSSIKLYTIXNGPAISLQYHELLTFIGNFHETLAARTPRRTVIAAXTYDLIDPNTVHRVRITTSNLYSTALLHERNKHFGTSLST

SEQ ID NO: 43442 - protein, 316 aa, Oryza sativa
MGVPSAPAPDAHRRGVFLLSVGAGGGGAGTAVVEVEVEHPHSLSLSPPPMSSCGRYILHRVCRFDTLAGVAIKYGVEVADVKRVNGLTTDLQMFAHKTLRIPLPEWATRRPPKNSALDPLLKPPQSTVAPSMDLLQNYYGLARPPKGDPENEGTEMATYSIGQHTKARSLSTGFSLVNGEVDDAEKPIRRRQKSDAEFSTREGNSGGVLMKAGPGLALRPKSGSRPEINNSQQDLVATAVPSYGDGLQAVRKSSSTPEFQDSDNSIASVWLKSKWNLKPDAFTLPLPILLLDSIPKPIFDTFPKQIAAWRNKAARD

SEQ ID NO: 43443 - protein, 182 aa, Fusobacterium nucleatum subsp. vincentii ATCC 49256
MKTYVFLADGFEILETFAPVDVLKRCGAEVVTVSTEKDLFVASSQKNIVKADVMLSDIDYKTADLVVIPGGYPGYINLRENKEVVGIVKYFLDNDKYVASICGGPTIFSYNNLANGTKLTGHSAVKEELSENHIYVDVPTHIDGKIITGVGAGQAINFAFKIAEQFFDKEKIEEVKKGMEII

SEQ ID NO: 43444 - protein, 298 aa, Brassica napus
  misc_feature (181)..(181): Xaa can be any naturally occurring amino acid
  misc_feature (243)..(243): Xaa can be any naturally occurring amino acid
  misc_feature (251)..(251): Xaa can be any naturally occurring amino acid
  misc_feature (254)..(254): Xaa can be any naturally occurring amino acid
  unsure (1)..(298): unsure at all Xaa locations
MRPPLTGGRGGGGFSGGRGGGGYSGGRGGSSGGRGRGGGRGFGDRGGRGGGRGMSRGGRGDRGRGRGGPGGRGGMKGGSKVIVEPHRHAGVFIAKGKEDALVTRNLVPGEAVYNEKRISVPNEDGTKTEYRVWNPFRSKLAAAILGGVDNIYIKPGAKVLYLGAASGTTVSHVSDLVGPEXGCVYAVEFSHRSGRDLVNMAKKRTTAIPIIEDARHPAQYRTLVGMVDVVFADVAQPDQARIXALNASSFXLKXGGHIFVISIRAFKALSFGLWPQPPILSPFFVPPPLTLTFLPSLR

SEQ ID NO: 43445 - protein, 180 aa, Rhizobium leguminosarum bv. viciae 3841
MNNTISELAASIRSIPDYPKPGIIFRDITTLLGNPRAFRRAVDELVQPYAGTKIDKIAGMEARGFILGGAVAHQLSSGFVPIRKKGKLPHETVRIAYSLEYGVDEMEMHRDAVQPGEKVILVDDLIATGGTAVGATRLLRQIGAEVVGACFVIDLPDLGGRRKLEELGVVVHTLVEFSGH

SEQ ID NO: 43446 - protein, 393 aa, Desulfitobacterium hafniense DCB-2
MGGKVLKARRLSSLGASVFTEMDDLRKELEKAGKQLINLSIGSPDRSPSAEIRKVLAEGVLDGGSYGYTLTRGTESFRSGCARWYKERFGVNLDPEKEVLPLMGSQDGLAHIFLALCDPGDVALIPDPGYPIYTAGLVLAGGEKVALPLREENGFLPDLSAIEDEVAQQAKIMFLNYPNNPTAAVAPLSFFEEVVDFARRNRIVVCHDAAYSELAFDGYRPVSFLQVPGAKEVGIEFHSVSKTYNLAGVRLGFAVGNGEIIGALAELKSNIDYGVFEPALQAGAYALSASQENVEQNRRAYQERRDIWVKGCAQAGWSMPSPRGSMFIWAPVPTAQDSRSFAFALAREAGVIVVPGVAFGEYGEGYVRIGMVQDQEVLQEAVRRVQEFLAAQG

SEQ ID NO: 43447 - protein, 264 aa, Kluyveromyces lactis NRRL Y-1140
MGVIDITSQDQFTELTTTKAGDKLLVLYFYTSWAEPCVAVGKVVEALSEERCNKDVVFLSISAEEQVEISELFEVSSVPYFIFIKSGTILREMSGADPKEFVAILNQLNASGTDDNESGAANSSADNGAGSNVASSRTENVSNVGPGSPLGEDNEEQEETEEQLGERLKKLTQAAPVMLFMKGTPSEPKCGFSRQMVGILREHQIRFGFFDILKDENVRQGLKKFSDWPTFPQLYINGEFQGGLDIIKESLEEDPEFFQHTLSA

SEQ ID NO: 43448 - protein, 736 aa, Archaeoglobus fulgidus DSM 4304
MQVQVSLSRDLSFFDITMIGIAGMIGAGVFALTGIAAGIAGPAIILAFFLNGIIATLTGLAYAELGSAMPQAGGGYLWIKEAMGDYAGFMAGWIDWAAHTIACALYAVTFGAFFAEMLVGFVGLPLPHVLTAKISSLAMVSFLAYVNYRGAKESGFLGSLVTVLKVLILLVFAGFGIIKMLSYPDWQSSFTPFFPTGFAGVLAAMGLTFIAFEGFEIIVQSGEEVKDPEKNIPKAIVVSLWVAVAIYILIAFSLLGAVRADVPSWMYLGQLAELSLVKVADSIMPLGGWMILAGGLISTISAMNATIYSSSRVIFALSRSGYLHRSLSAINERTKTPHYAIFFSYIIIAAASLAPIEAVASAASLMFIILFLAVNVTLIILRLRRPDIQSAFRLPLVPVLPAIAAALLAVVSYFLITQVEHGEGVFLITIAWMFLGSFFYFAYSEKELEKREEEEVMTVFTEKPVEKMEYTILVPVANPVIAKKLVRFAELIARKKKGAVVILNTVRLPQQTPISAPAKDVKKAKELVEGLMNLSVPSGGVVKVSHSVSEAILSTAEEWKANMIVMGWRGRTFRRDVVLGSTIDPVLLKAKCDVVVIRFEPGEKIPEFRDVLISTIGGPHAKLGYEIARALVEDKSGRIKLLYVGSSEKEREKAEKVFEEAMEILNGLNVEREFAISSSPSDVVAREAESFDLVIVGASERTFLKNFLTGLFPEKVVMKTSKTVAMTRKWVGLLNR

SEQ ID NO: 43449 - protein, 345 aa, delta proteobacterium MLMS-1
MKKILCADIGATHSRFAWFTLAEPATDDFAAPPDSAPPASAASTNPAAGLELQDIRWLPTAPDGSLAAQLRTLYSEGFPLPPEQTAMAVLAVAGPVRRGRYSKLPLAGWEVDLDLIEGEFPFAAATLINDFTAQALAVLTPPGQAAREILPGEPEPAGPLAIVGAGTGLGKALLLPATGPARPAPLVIPSEGGHADFPFAGGREGDYLDFLLQKRGEERISGNTVVSGQGLAYLHWFLGGRQLEPAAVLAELAPDSATLAWAARFYGRVCRNYALETLATGGLYVAGGVAARSPELLDHPEFAREFHHSPTMNDLLTRIPVRLINDQNSGLWGAAMQAALLLTTK

SEQ ID NO: 43450 - protein, 487 aa, Brassica napus
MGETAAANHHHHHHGHQVFDAYVPPQPAFKCFDDDGRLKRTGTVWTASAHIITAVIGSGVLSLAWAIAQLGWVAGPAVMLVFSLVTLYSSTLLSDCYRTGDAVSGKRNYTYMDAVRSILGGFKFKICGLIQYLNLFGIAIGYTIAASISMMAIKRSNCFHKSGGKDPCHMSSNPYMIIFGVTEILLSQVPDFDQIWWISIVAAVMSFTYSAIGLALGIVQVAANGVFKGSLTGISIGTVTQTQKIWRTFQALGDIAFAYSYSVVLIEIQDTVRSPPSESKTMKKATKLSIAITTIFYMLCGSMGYAAFGDAAPGNLLTGFGFYNPFWLLDIANAAIVVHLIGAYQVFSQPIFAFAEKSASERFPDNDLLTKELEFKIPGFRSPYKTNVFRVVFRCSFVVLTTVISMLMPFFNDVVGILGALGFWPLTVYFPVEMYIKQRKVEKWSTRWVCLQMLSVACLVISVVAGVGSIAGVMLDLKVYKPFQSTY

SEQ ID NO: 43451 - protein, 501 aa, Lotus japonicus
MAMAGLYRRLLPSPPAVDFASSQGKQLFLEAVQNGTMESFYRLVSYFQTQSEPAFCGLASLSMVLNALAIDPGRKWKGPWRWFDESMLDCCEPLDKIKARGISFGKLVCLAHCAGAKVEAFHASHSSIDHFRKYVMKCSTSDDCHVISSYHREALKQTGTGHFSPIGGYHAGKDMALILDVARFKYPPHWIPLTHLWEGMNYVDESTGKTRGFMLISRPHREPGMLYTLSCKHESWNSIAKFLIDDIPFLLTSEDVKDICKVLSVIVTSLPSNFEEFIKWVAEIRRGEDGSPSLSVEEKARLSVKEEILKQVQRTGLFKHVASFLSHSCSGHTPTSGDRDTFPVIAASVCCQGAEILGGKISSSAEYCCRETCMKCWKAEDDKPIRMVCGTVVNGNTEQGVDVLIPSSCGKLSCTCSSTTKSIRKHPASTDVLTVLLLSLPTSTWAGIADEKLLSEIHDLVSIENLPALLQEEVLHLRRQLHILKRCQEGKVDEDLGVPLS

SEQ ID NO: 43452 - protein, 501 aa, Ustilago maydis 521
MPHMPQGIVKGGKEDVKLNNQSLWQTKAYINGVWTDADNKSTLKVFNKATGAEIGQVPDMGANETAAAISAADEAFKSWSKTTAKHRHDLLMKLYYAHQENAEDLAKIIVAENGKALPEAKGEISYSNGFLEWFAEEATRTYGHTVPSPLPGVRNVVQMQPVGVAGLITPWNFPAAMITRKAAPALAAGCTVVVKAPAETPFSALAFAHLAEKVGFPKGTINVVTCAKGDNEIAVGKQLCENPAVRKISFTGSTRVGKILMSQSASTLKKLSMELGGNAPFIVFEDADLDKAVEGAIACKFRGSGQTCICANRIYVHASIKDEFLQKLAAKVNDFKVGYGMDKGTTHGPLVSEAGLSKVEEHVNDSVKKGAKVIVGGKRGEGLFFEPTIITDLPEDVPTDREETFGPLAAVYTFTSEQEVVRKANNVDVGLAGYFFSKDTARCWRVAEELQVGMVGINTGLISQHAVPFGGVHESGFGREGGRTGIDEYLVQKLMVFGGVN

SEQ ID NO: 43453 - protein, 432 aa, Glycine max
MSFTATKFAPSPLPLNSTTPRSNDKPLSFSFDHSKPNPSSSFLGSTRKLLRFNALARPHAHPRASSSPAAAVLLERTSNLLVTKEEGLELYEDMILGRFFEDKCAEMYYRGKMFGFVHLYNGQEAVSTGFIKLLKKEDSVVSTYRDHVHALSKGVPSRQVMSELFGKATGCCRGQGGSMHMFSKEHNLLGGFAFIGEGIPVATGAAFSSKYRREVLKQADCDHVTLAFFGDGTCNNGQFYECLNMAALWKLPIVFVVENNLWAIGMSHLRATSDPQIWKKGPAFGMPGVHVDGMDVLKVREVAKEAVERARRGDGPTLVECETYRFRGHSLADPDELRDPAEKEHYAGRDPITALKQYLIENNLANEQELKAIEKKIDEILEDAVEFADSSPLPPRSQLLENVFADPKGFGIGPDGRYRCEDPKFTEGTAHV

SEQ ID NO: 43454 - protein, 345 aa, Streptococcus thermophilus LMG 18311
MIFIRRKSLMVVKVGINGFGRIGRLAFRRIQNVEGVEVTRINDLTDPVMLAHLLKYDTTQGRFDGTVELKDGGFEVNGKFVKVSAERDPEQIDWANDGVEIVLEATGFFTKKVLAEKHLHPGGAKKVVITAPGGNDVKTIVFNTNHDILDGTETVISGASCTTNCLAPMAKALNDNFGIVEGLMTTIHAYTGDQMILDGPHRGGDLRRARAGAANIVPNSTGAAKAIGLVIPELNGKLDGSAQRVPVPTGSVTELVAVCEKNVTVDEVNAAMKAATNESYGYTEDPIVSSDIVGMSYGSLFDATQTKVLDVDGKQLVKVVSWYDNEMSYTSQLVRTLEYFAKIAK

SEQ ID NO: 43455 - protein, 387 aa, Coccidioides immitis RS
MAPIDSVEVKKYDYIVIGGGSGGSGAARRAAGWYKAKTLIIENGRSGGCCVNVGCVPKKMTWNFSSIAESLRDGVHYGYDIPKNISVDYNLFKRKRDAVIERLNGIYERNWNREGIDLVHGTATFVGQKELEVTLQDGSGKVRFTAPHILIATGGYPKVPNTPGAEHGITSDGFFEIEDLPPKVAVVGSGYIGVELAGVMHTAGVETHLFCRHETFLRKFDPMIQHTMTKRYEDVGMKIHKNFTGVKEVKLLREGKGADKLLRLIMHDGSEIEVNELLWAIGRSPAVDNLGLKEIGVKQLPGGYIAVDDFQNTSVEGIYALGDVTGRAELTPVAIAAGRQLGNRLFGPPELKSSRLSYDNIPTVVFAHPEVGSIGLTEPEAVENYVL

SEQ ID NO: 43456 - protein, 1386 aa, Oryza sativa
  misc_feature (941)..(941): Xaa can be any naturally occurring amino acid
  misc_feature (973)..(973): Xaa can be any naturally occurring amino acid
  misc_feature (1088)..(1088): Xaa can be any naturally occurring amino acid
  unsure (1)..(1386): unsure at all Xaa locations
MELSNQGQTPMSTNMGSQPLPSSNIQPNQAEYPSMFYPSLPADWGAQPMFSMGASVPISSYFIVPMSQQSVQIGASRPETPRSSGAHSLSRVSLRPPQQVLSIRTSLPTMVGSQHSPAGKKLQPTIASPKVQILKSTQSQSSNKRSAQKETPSKVQTQQLESVRSKFRESLSAALRTDSDQSKNQSSDVQPDGSADQKKEMDVDADQVATTSQGMSAAKSEVLTSVGAERRAEDEKLNSDLVSNIATPLNADIQQQPENASLQDEMLGQYTVVADELLQGHGLCWVSDFDAGVPEPATQPNLKRSRASDIDPVVADTLSESESKRMKSANDEEAIDKDSIIQKADDLAVRVEEELFKLFGGVNKKYKEKGRSLLFNLKDKSNPELRERVLSGDITPDRLCSMTAEELASKELSEWRLAKAEELAQMVVLPSTEVDVRRLVRKTHKGEFQVEVEETDGISVEVELGGNLLTQVPSKAPEDQTKSDDKESTDDKTGIQDNDKAPDGTSQDEDNGAGKNDPQDDLEYVDNEKSDLMQELMVDDLKDTENLPPIPSLDEFMQGLDSEPPFENLSAGTPEEDSDDRDEADTTAESAELPEEEVKVSAAEKIVSEADLPSSQDKSESKLESPKDEVGSNLGPVEQREGKLIKSSPDSVEVKQTTTENVLNRDSTVHNMATTLPMIRESIWEGAIQLTMSSLTNVVAIFKSGEKPPVKEWRSFVEIKGRVKLSAFQEFVEQLPKSRSRAIMVTELCWKEGSHESGRQHLLQTIDSYISDERVGLAEPADGIELYLCPSQGKTVEILSRHLPKEHLESLAVSASSIIGVIVWRRPNVPRMPAHPRHDGSRRPSILKKPQVTGSTPGPRPSLPMSSHGAPPGFPVQRHRHEEDVTDDVPPGFGPGVARDEDDLPEFNFVNSSNPAANVTTTQAYKGRQHVPLTSARPVEXQMRELVQKYGNRSSGQARPWDDDDDDDIPEWXNPNQLVTQQQPTRQLPVPPTPQQPLPPPPPPPSLQQLHHPYQHQQQQQQQLYHHQNALQPQIPSNSIPQAYLRTQQPLQQLPLMQQQLQPAQAWQQTNAWWPAQGGAAAAAAPAXMVQQSQYGVIPNSNNSAQSYGSGSESGSEDDDLDVGIGDVPSELEVKNSGLIPAQSKETERQLSKKEWKKKELAELDTVLAELGISGHAERKPDKQNGGDKNGAPQGPWRGGGYKSEEEITAVYMKEKMKKIASAKKKSGRGGWGCKACCKMEDAARSAKLAGAKKKEKTNSLSIDRLLPSPSSEFRMSTGLICSTCYYEVEVPGVGFAPRIDLKLCFASWLFLKSALRIGSTVTLKLMNKEYAAKESLKKFLRFFVGVPKRHFCLSLESKPAALSSHPLWQYPFTRNRRFAYSYYKL

SEQ ID NO: 43457 - protein, 462 aa, Erwinia carotovora subsp. atroseptica SCRI1043
MAEDVKQEKLHRGLEARHIELIALGGTIGVGLFMGAASALKWAGPSVLLAYIVAGIFVFFIMRSMGEMLYLEPVAGSFAVYAHKYMHPFFGYLTAWGYWFMWMAVGISEITAIGVYVQYWFPELPQWIPAIVAVALVAGANLAAVRLYGEIEFWFAMIKITTIVVMILVGVGIIFFGFGNHGQATGFSNLTEHGGFLAGGWKGLLFALCLVVASYQGVELVGITAGEAKNPQVTLKRAINNILWRILIFYVGAIFVIVTIFPWNEIGTSGSPFVLTFAKIGIVAAAGIINFVVLTAALSGCNSGMYSCGRMLYSLANNRQLPAWLGKVTASGVPAAGVMISILCLVAGSLLNYVIPNPEKVFVYVYSASVLPGMVPWFVVLISQLRFREQHRVALASHPFKSILFPWVNYLTMAFLLCVLVGMYINIDTRMSLLVGVAFLAVVSLCYFALGLGKKTSLAGGK

SEQ ID NO: 43458 - protein, 487 aa, Arabidopsis thaliana
MAMMRTSPRDSISNLPDEILGKILSLLPTKVAASTSVLSKRWRNLLGLVDNLCFDESMVVYPNEEEETSGSLRFCDFVDKTFALLSNSHIEKFSLSRVYKYNDDVDGMVRRWIRTVMERGLLEIHLHATPMSFVAIETKLLTSNTLVKLTLSARCFVEVERVFFPALKSLSLFSILGDYTNYIRLIDGCPVLEELYMRDGDYPFLRLTCGTNVESASLKRLVIFTHNPNEMIWHELIYFEAPSLVYLDYSSYVSAKYDVVDFDLLVEARLSLRLWVSTNDYDYSDDDDDDDDDDDDDDDGDYYIVEPKAPIFGDVTELLAAIRNITTLHLSPDSLEVFHFCCKSMPVFNNLLNLSIESNKDKGWQVMPLLLKSCPNLHTLVIKGLVHRVTSRCGDACACIPKKQRKIVQKEEALCCLRTCQVKVLQISEYGGYFQELKQMRHFLGKLECLETVKVGVHAENNNNSEFLRANVLTLPRVSAKCNVHFI

SEQ ID NO: 43459 - protein, 1320 aa, Emericella nidulans
MGKTSAKDVAELKDYQLGDCLGRGAFGSVYRALNWNTGETVAVKQIKLADLPKSELRVIMLEIDLLKNLDHPNIVKYQGFVKSAETLNIILEYCENGSLHSIAKNFGRFPETLVGVYMSQVLHGLLYLHDQGVIHRDIKGANILTTKEGLVKLADFGVASRTTGLSESSVVGTPYWMAPEVIELSGATTASDIWSLGCTVIELLEGKPPYYNLQPMPALFRIVNDDHPPLPQGASPAVKDFLMQCFQKDPNLRVSARKLLKHPWIVNARRSDSVVPKKSTEYEEAVKSVQEWNEALRSPESNALRRGTRNENQNPPSLRLDTRHTPTKVTLPSPVSRIVADKFSSPSSGEEDNWDDDFATAISPSALQLPHLRPHDNFGGMLSSEKLKAFASLDGTVLKSDESFEESDDPFKGSLLAGEHDPLKTIRPPPSQQANSGTSQSQNGPYGAHMRRGPPLNTAITPVYGGQMLQNSSSPIRQQRPPLFYKENSVEDYSDLISANEDVLDRKISAFQVGPTLRTPEGSDHAADVHQESDEHKDLADTGRSREVIRYQSSYEQEDTPRIGRQISVKRYRGTVEIQQFAENEHDEDFSDILGVDGVTLDKAESDDGSNKSTLMLNTKLSNNSWLGDLDDEDDPFALLEEGLDETDLEANIARDKHARLRSQVEGLVGSLKTSQDEEVLGDISEQLLAVFCDFPETKNIIISAHGMLPILEILDLCRRRDITLCLLKIVNAIIYDDYEIQENLCFVGGIPIINEFAAKKYPREIRLEAAAFVQQMYQTSTLTLQMFVSAGGLNVLVEFLEDDYEDERDLVLVGVNGIWSVFELQGSTPKNDFCRILSRSSVLDPLSLVLSRVLDEEGELAEVVEGRIANIFFIFSQAENHVKEMVSERTVLHRVLKELKRMTPAHQITMLKFIKNLSMLSTTLDSLQNSNAIDVLTDLLRSTIKRPHFREVSNQILNTIYNMCRLNKSRQEDAALNGIVPLLQKIVKTERPLKEFALPILCDMAHSGKVGRRELWRNKGLAFYISLLSDPYWQVTALDAIFIWLQEETAKVEEHLLENRYDQPSFTDAIVRCLTLSKANAFENILEPLQKLLRLSPPIASTLARPDLFSRLGQKLHHSKAAVRLNLLRIISSICDSSEQQGGLLASYGLLDSIRELEHDPAILVRDMAGKLIQSSERNDSYGLCKLKPNVRRGSTSATSPGLLANQSAPVTPQLSRQNQSKGYYDSRETQRRPRSAISGSALALRPGSRDGPTPGIVGGANGSAGASRNRIARGVSNRLSHIELLPNDDDRIPSSITRRSSVLPRRRRLTQFEAERGS

SEQ ID NO: 43460 - protein, 107 aa, Azoarcus sp. BH72
MDIKDVIREQVTTHPVALYMKGVPQAPACGFSATAVQILKASGVKDFFSVNVLADDAVRQGIKEFSNWPTIPQLYVKGEFVGGADIMREMYQSGEIQQLLKDAGVTA

SEQ ID NO: 43461 - protein, 118 aa, Oceanospirillum sp. MED92
MSGKNLIIQQLEAEQMNKEVPEFAPGDTVVVQVKVVEGNRTRLQAFEGVVLGKRNRGVNSAFTVRKISHGVGVERTFQTYSTTVDSIEVKRRGDVRQAKLYYLRERSGKSARIKEKLN

SEQ ID NO: 43462 - protein, 736 aa, Zea mays
MATHSVAAAHATIAARAGAAGAPAPAERLGFRLLGSPAGGLRSARRAPPAAASRRHRVVRAAAVETLQGKAATGELLEKSVNTIRFLAIDAVEKANSGHPGLPMGCAPMGHVLYDEVMRYNPKNPYWFNRDRFVLSAGHGCMLQYALLHLAGYDSVKEEDLKQFRQWGSRTPGHPENFETPGVEVTTGPLGQGIANAVGLALAEKHLAARFNKPDSEIVDHYTYVILGDGCQMEGIANEACSLAGHWGLGKLIAFYDDNHISIDGDTEIAFTEDVSTRFEALGWHTIWVKNGNTGYDDIRAAIKEAKAVTDKPTLIKVTTTIGFGSPNKANSYSVHGSALGAKEVEATRQNLGWPYDTFFVPEDVKSHWSRHTPEGAALEADWNAKFAEYEKKYADDAATLKSIITGELPTGWVDALPKYTPESPGDATRNLSQQCLNALANVVPGLIGGSADLASSNMTLLKMFGDFQKDTAEERNVRFGVREHGMGAICNGIALHSPGFVPYCATFFVFTDYMRGAMRISALSEAGVIYVMTHDSIGLGEDGPTHQPIEHLVSFRAMPNILMLRPADGNETAGAYKVAVVNRKRPSILALSRQKLPHLPGTSIEGVEKGGYTISDNSTGNKPDLIVMGTGSELEIAAKAADELRKEGKTVRVVSFVSWELFDEQSDEYKESVLPAAVTARISIEAGSTLGWQKYVGAQGKAIGIDKFGASAPAGTIYKEYGITVESIIAAAKSF

SEQ ID NO: 43463 - protein, 283 aa, Thermus thermophilus HB27
MILPPIPTPFDREGRLDEEAFRELAQALEPLVDGLLVYGSNGEGVHLTPEERARGLRALRPRKPFLVGLMEETLPQAEGALLEAKAAGAMALLATPPRYHHGSLGAGLLRYYEALAEKMPLFLYHVPQNTKVDLPLEAVEALAPHPNVLGIKDSSGDLSRIAFYQARLREFRVYTGHAPTFLGALALGAEGGILAAANLAPRAYRALLDHFREGRLAEAQELQKKLFPLGDLLAKGGVPLLKQALRHLGLPAGYPRPPYPAESPLWERFLPVLEGLKEEGWVL

SEQ ID NO: 43464 - protein, 375 aa, Xanthomonas campestris pv. vesicatoria str. 85-10
MSKRDYYEVLGVARGASDEELKKAYRRCAMKHHPDRNPGDAAAEAAFKECKEAYEVLSDGNKRRAYDAHGHAAFEHGMGGGGGPGGPDMGDIFGDIFGNIFGGGAAGPRAARRGADVGYVLELDLEEAVAGIERRIEIPTLVECAPCHGSGSEDGKVETCGTCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLQQFEATFTGEDARKHSPKSATFIDGVKGFWDRMTS

SEQ ID NO: 43465 - protein, 546 aa, Oryza sativa
MTKPQQQSPPSTTATTTTSPPPPPPSTPPPASSSSSSLAKLPLRLHSLASSSRSLLSALRRSPVTTLVAAFFLLALFMYGEDVRTLAELSIDDYLYPDADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSSKIGIGGRWFNTDAVITFCQFNIDEPCISATGSLELWNILKYRHRVRWFPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGKLPISVNRRNHLQRDDKSLSWNQLTPNLSVAISDLSKWSTLKCWYLQIAL

SEQ ID NO: 43466 - protein, 610 aa, Thermus thermophilus HB27
MVRMDLSRIRNFSIIAHVDHGKSTLADRILELTHAVSDREMREQFLDSLELERERGITIKASAVRVRYRAKDGEEYVFHLIDTPGHVDFTYEVSRALAAVEGVLLVVDASQGVEAETLAKFYMALEHGHVIIPVINKIDLPNARPLEVALEVEEVLGLPADEAIFASGKTGEGVEEILEAIVQRIPPPKGDPEAPLKALIFDSVYDAYQGVIPYLRLFEGRVRPGDRIRIYSTGKEFTVDKVGVFTPQGLVATEALEAGEVGWLVAAIRDIHDVQVGDTLTLADRPTPSPYPGFRPAKPVVFAGLYPVDSGEYGKLRDALEKLKLNDAALTFEPESSTALGFGFRCGFLGLLHAEIVQERLEREFGLSLIATAPSVVYKVRLKSGEEVEVHNPADLPDPTRIEEILEPYVKLTIFTPEEYVGSLMQLLQEKRGRLVNMNYLPGAQKRVELVYEAPFAEILYDFHDRLKSVSRGYASMDYEQIGYRPGDLVKVNVLVHGEVVDALTFIAHREKAYTMARAIVDKLAEVIPRQLFEVPIQAAIGGKIIARATVKALRKDVLAKCYGGDVTRKKKLLEKQKEGKKRLKAIGKVEVPQEAFLAVLSAGRDEPKG

SEQ ID NO: 43467 - protein, 328 aa, Ustilago maydis 521
MPQSHSFKYDPEFLQAAGPVLATFAQRPKPSLHDVETHRVNLDTALRAAGEAGPKYPVETTTHAITTRDGATINVIQVAPKQRRDNGPAVLHAHGGGMMSGTADAWVASGILPGLAAASGVDIFSVEYRPAPEHQLDGLVNDCYDALEWLSSNAASLGIDSNRIGVFGESAGGGIVAGVALQARDKALSPPLRKQILIYPMLDDRNLTPDERLSPTAIWSYENNLTGWSALLGKDIAGTDKVNELVKYAVPARVQDLSGLPDTYIDIGQLDIFIEETLEYVGRLHKAGVQVELNVYKGFPHAWELVGAQNTSVGKRIISERILALQSF

SEQ ID NO: 43468 - protein, 375 aa, Paracoccidioides brasiliensis
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAISRIDMAGRDLTNYLMKILAERGYSFSTTAEREIVRDIKEKLCYVALDFQQEIQTASQSSTLEKSYELPDGQVITIGNERFRAPEALFQPSVLGLESGGIHATTYNAIMKCDVDVRKDLYGNIVMSGGTTMYPGISDRMQKEITALAPSSMKVKIIAPPERKYSVWIGGSILASLSTFQQMWISKQEYDESGPSIVHRKCF

SEQ ID NO: 43469 - protein, 562 aa, Bacillus cereus ATCC 10987
MTTTTTVKSDIEIAQEASMKKIQEIAADLNILEDELEPYGHYKGKLSLDIFKRLQNEKDGKVVLVTAINPTPAGEGKSTVTVGLGQAFNKIGKKTVIALREPSLGPTMGLKGGAAGGGFSQVVPMEDINLHFTGDIHAITTANNALAAFIDNHIQQGNTLGIDTRKIVWKRCVDLNDRALRNVVIGLGGPVQGVPREDGFDITVASEIMAVFCLATDIQDLKARLSRIVVAYNFANQPVTVKDLGVEGALTLLLKDALKPNLVQTLENTPAIIHGGPFANIAHGCNSVIATTMAAKLGDYVITEAGFGADLGAEKFLDIKARAAGIKPEAVVIVATIRALKMHGGVAKDQLKEENVDALAKGMENLQKHVETIQSFGVPFVIAINKFITDTDAEVAYLQEWCNERGYAVSLTEVWEKGGQGGVDLAEKVLKEIEKGENNYAPLYELELPLEEKIRTIAQKVYGAKDIEFAPKARKQLAQYEGEGWSNLPVCMAKTQYSLSDDATKLGRPSDFIVTIRELKPSIGAGFIVALTGTMLTMPGLPKQPAALQMDVNEDGKAVGLF

SEQ ID NO: 43470 - protein, 326 aa, Bartonella vinsonii subsp. arupensis
DGDKGILLYRGYPIEQLAEKGDFLESCYLLLYGELPTKQEKSDFDRCIMQHTMVHEQFARFFHGFRRDSHPMAVMVACLGAMSAFYHDSIDITDPQQRMIASVRLISKVPTLAAMAYKYSIGQAFVYPRNDLSYAANFLRMCFSVPCEEYKTNPVLTRAMDRIFILHADHEQNASTSTVRLAGSSGANPFACIAAGVACLWGPAHGGANEACLKMLQEIGSVKRIPEFIARAKDKNDPFRLMGFGHRVYKNYDPRAKIMQKTCHEVLKELNIQDDPLLDIAIELEKIALNDEYFVEKKLYPNVDFYSGITLKALGFPTEMFTVLFE

SEQ ID NO: 43471 - protein, 321 aa, Ureaplasma parvum
MNQVNFLNLDKNILIITSGGDAPGMNASLISLIHRLMNNNFNVFIGIEGLLGLYNNLIEPIKDKRVFDVYFNEQGTVIKTSRFIKLDINDKKTQIIKDNLLSHNIQKIIILGGQGSMQAGLVLTKMGFEVFGILHTIDNDFSETQMCIGALSAASFNQKLLKCLNYTAKAHCAFNLVELMGRECSWLVNNSVGKLKPILMLTNQDNKYTVDEVIDLIKNKINSIKEYDPLIIVQELIYDQKWYELLVKTFEQKLHKSLRITILNYLQRGAPVSDFDLQLAKDSANVLVDFIVNQNDIKNTNNMYVVINKFDNKLEVIKFNK

SEQ ID NO: 43472 - protein, 429 aa, Blastopirellula marina DSM 3645
MTEVAHLRVRDTEIELPIVEGTEQETAVDISKLRAETGFITLDDGYVNTGSTTSKITYLDGEAGILRYRGYPIEQLAENCDFVEVMYLLIYGELPTEAQIMDFRKSIRRHTMLHEDMRSFYDGFPRDAHPMAILSSVVSGLSTFYQDSLDPHDPRQVEVSIHRLLAKLPTIAAYSFKKSVGQPFIYPQNDLSYCENFLQMMFAVPSEPFHVDPDFVSALNLLLIVHADHEQNCSTSTVRMVGSADANLFASISAGISALWGPLHGGANEAVVSMLEKIIADDMNVEKYVKLAKDKTSKFRLMGFGHRVYKNFDPRATIIKKACDTLLAKLAIKDPIFEVAQRLETAALNDEYFIERKLYPNVDFYSGVIYRAIGIPVQMFTVLFAIGRLPGWIAHWKEMQGSPSKRICRPRQVYTGPTEREFVSLEKRG

SEQ ID NO: 43473 - protein, 759 aa, Mesorhizobium loti MAFF303099
MARKTENNGPSVSAQEALEFHAMGRPGKLEIVATKPMTTQRDLSLAYSPGVAVPVRAIAEDPSRAFDYTTRGNMVAVISNGTAILGLGNLGALASKPVMEGKAVLFKRFADVDSIDLEVDTEDADEFINCVRFLGPSFGGINLEDIKAPECFIIEQRLRELMDIPVFHDDQHGTAIISAAGLINALEITGRDMKTTRLVCNGAGAAGIACIELMKAMGFAPENIILCDTKGVVFQGRTEGMNQWKSAHAVKTEARSLADALDGADVFLGLSAKGALTTAMVQSMAKNPIIFAMANPDPEITPEEVAEIRTDAIMATGRSDYPNQVNNVLGFPYIFRGALDVRATTINEDMKIAAARALAELARQDVPDDVAAAYQGNRPKFGPNYIIPVPFDPRLISAIPLAVAKAAMESGVARKPILDLDRYAQELSARRDPIASTLQRIYDRVRRQPKRIVFAEGEEEQVMRAAVSYVNQRLGTAILLGRDDVIKENAKHAGIDLNKQGIEIINARLSRRNGIYTDYLYERMQRKGFLFRDCQRLINNDRNHFAACMVALGDADGIVTGVTRNYSTALDDIRRVIDAKPGHRVIGVSIVLARGKTVLVADTAVHDMPNAEQIADIAEEAAGFARRMGYEPRLAMLAYSTFGHPQGERSERVQEAVRILDKRRVDFEYDGEMAADVALNARAMAQYPFIRLTGPANVLIMPAFHSASISTKMLQELGGSTVIGPLLVGLNKPVQIVSLNAKDSDIVNMAAIAAYTAGT

SEQ ID NO: 43474 - protein, 190 aa, Spinacia oleracea
MALHLSLSHQSWTSPAHPITSSDPTRSSVPGTGLSRRVDFLGSCKINGVFVVKRKDRRRMRGGEVRASMEQALGTQEMEAIVGKVTEVNKDTFWPIVKAAGDKPVVLDMFTQWCGPCKAMAPKYEKLAEEYLDVIFLKLDCNQENKTLAKELGIRVVPTFKILKENSVVGEVTGAKYDKLLEAIQAARSS

SEQ ID NO: 43475 - protein, 286 aa, Oryza sativa (japonica cultivar-group)
MVEPVNDLPTFGVGHSLGSVIHLLIGSRYAVQRSGNILMAFNNKEASLAVPLFSPVIVPMAQSFGPIFSQLTSYPTLRFGAEAAIKQLENLSPPVVKQLLPLVQQLPPLYMDLVKGREEFVPKPEETRRLVKSYYGISRNLLIKFKDDQIDETSILAQVLSSESAISSLLDMSIRSLPGDHGLPLQQVLPDVPPAMADAVNRGGELLTNLATGTPWEAVAKEVGTGGAQYCTVLSANLQFSFTRNVHLVATEDGYFIRLLQQQQQQQLILSHMGSTYPDIKYCMCV

SEQ ID NO: 43476 - protein, 480 aa, Xanthomonas campestris pv. vesicatoria str. 85-10
MSEQEQFDVVVIGAGPAGYHAAIRAAQLGMKVACIDAALGKDGKPALGGTCLRVGCIPSKALLDSSRQFWNMGHLFGDHGISFNDAKMDVPTMIGRKDKIVKQFTGGIAMLFKANKITPYYGFGQLLPGNIVKVTQHEGGEIELKGTNVILAAGSESIELPFAKFDGDTIVDNVGGLDFTAVPKRLAVIGAGVIGLELGSVWKRLGAEVTILEALPDFLALADAEVAKTALKEFKKQGLDIKLGAKVSKTEITGSGDAKQVVLSYTDAAGEQTLTVDKLLVAVGRKAATKNLLAEGTGVKVTDRGQIEVDGHCHTGVDGVWAIGDCVRGPMLAHKGFEEGIAVAELIAGLPGHVNFDTIPWVIYTEPEIAWVGKTEQQLKAEGVAYKAGSFPFAAIGRAVAMGEPAGFVKVIADAETDRVLGMHLVGVGVSELVHEGVLTMEFNGSADDLARICHAHPTLSEAIHDAAMAVSKRAIHKAN

SEQ ID NO: 43477 - protein, 666 aa, Streptococcus pyogenes MGAS10394
MMKKPFYITTPIYYPSGKLHIGSAYTTIACDVLARYKRLMGHEVFYLTGLDEHGQKIQTKAKEAGITPQTYVDNMAKDVKALWQLLDISYDTFIRTTDDYHEEVVAAVFEKLLAQDDIYLGEYSGWYSVSDEEFFTESQLKEVFRDEDGQVIGGIAPSGHEVEWVSEESYFLRLSKYADRLVAFFKERPDFIQPDGRMNEMVKNFIEPGLEDLAVSRTTFTWGVPVPSDPKHVVYVWIDALLNYATALGYGQANHANFDKFWNGTVFHMVGKDILRFHSIYWPILLMMLDLPMPDRLIAHGWFVMKDGKMSKSKGNVVYPEMLVERFGLDPLRYYLMRSLPVGSDGTFTPEDYVGRINYELANDLGNLLNRTVAMINKYFDGTVPAYVDNGTAFDADLSQLIDAQLADYHKHMEAVDYPRALEAVWTIIARTNKYIDETAPWVLAKEDGDKAQLASVMAHLAASLRVVAHVIQPFMMETSAAIMAQLGLAPVSDLSTLALADFPANTKVVAKGTPIFPRLDMEAEIDYIKAQMGDSSAISQEKEWVPEEVALKSEKDVITFETFDAVEIRVAEVKEVSKVEGSEKLLRFRVDAGDGQDRQILSGIAKCYPNEQELVGKKLQIVANLKPRKMMKQYISQGMILSAEHGDQLTVLTVDPSVPNGSIIG

SEQ ID NO: 43478 - protein, 404 aa, Xanthomonas campestris pv. vesicatoria str. 85-10
MATEVKVPVLPESVSDATIASWHKKAGEAVKRDENLVDLETDKVVLEVPSPVDGVLKEIKFDTGSTVTSNQILAIIEEGAVAAAAPAEEKKADAPAPAAAAPAAAPAPAAAAAPAAASKSAADALPPGARFSAITQGVDPSQVEGTGRRGAVTKEDIVNFAKAGGVGKASGARPEERVPMTRVRKTIAKRLMESKNSTAMLTTFNEVNLAKVSAARKELQDEFQKAHGIKLGFMSFFVKAAANALQRFPLVNASIDGDDIIYHGYSDISIAVSTDKGLVTPVLRNVERQSFADVEQGIADYAAKARAGKLGLDDLQGGTFTITNGGTFGSLLSTPIINPPQSAILGMHAIKERPIAENGQVVIAPMMYLALSYDHRIIDGKDSVQFLVDIKNQLENPGRMLFGL

SEQ ID NO: 43479 - protein, 321 aa, Ureaplasma parvum
MNQVNFLNSDKNILIITSGGDAPGMNASLISLIHRLMNNNFNVFIGIEGLLGLYNNLIEPIKDKRVFDVYFNEQGTVIKTSRFIKLDINDKKTQIIKDNLLSHNIQKIIILGGQGSMQAGLVLTKMGFEVFGILHTIDNDFSETQMCIGALSAASFNQKLLKCLNYTAKAHCAFNLVELMGRECSWLVNNSVGKLKPILMLTNQDNKYTVDEVIDLIKDKINSIKEYDPLIIVQELIYDQKWYELLVKTFEQKLHKSLRITILNYLQRGAPVSDFDLQLAKDSANVLVDFIVNQNDIKNTNNMYVVINKFDNKLEVIKFNK

SEQ ID NO: 43480 - protein, 1322 aa, Erwinia carotovora subsp. atroseptica SCRI1043
MGSTTMGVKLDEETRERIKVAAQRIDRTPHWLIKQAIFHYLERLESGLDTPETPQSANISRIEAEEIMPQSREEETHQPFLDFAEQVLPQSVTRAAMTSAYRRPESELVPILLEQARLTDEMSQLTQKLAYRLAEKLRSQKLGNGRAGIVQGLLQEFSLSSQEGVALMCLAEALLRIPDKSTRDALIRDKISRGNWQAHLGHSPSLFVNAATWGLLFTGKLVATHNEANLSNSLNRIIGKRGEPLVRKGVDMAMRLMGEQFVTGETIGEALANARERENKGFRYSYDMLGEAALTAHDAAAYLTAYQQAIHAIGKASNGRGIYEGPGISIKLSALHTRYSRAQYDRVIDELYPRLLSLTLLARQYDIGINIDAEEADRLEISLDLLEKLCMEPQLVGWNGIGFVIQAYQKRCPYVIDELIELAQRSHRRLMIRLVKGAYWDSEIKRAQVDGLEGYPVYTRKVYTDVSYLACARKLLAVPNLIYPQFATHNAQTLSAIYHMAGNNYYPGQYEFQCLHGMGEPLYDQVVGAVADGKLNRPCRIYAPVGTHETLLAYLVRRLLENGANTSFVNRIADTSMALETLIADPISGVEALAKVEWSMGAPHPRIPLPRQLYGQERKNSSGLDLSNEHRLASLSSALLSHAVQSWYAEPMIEGESEASEQKPVVNPADVHDVVGYVRDASTADVELALAAAVRAGTIWFATPATERAAILNRAASLMEGQLQSLLGLLVREAGKSFSNAIAEVREAVDFLRYYAGQVRDTFANDTYRPLGPVVCISPWNFPLAIFTGQISAALAAGNSVLAKPAEQTPLIATQAVRILHEAGVPTGVLQLLPGQGETIGAALVNDERVRGVVFTGSTAVAKILQRSIAGRLDPQGRLTPLIAETGGLNAMIVDSSALTEQVVNDVIASAFDSAGQRCSALRLLCLQEDIADRTLTMLRGAMAECRMGNPERLSTDIGPLIDAEAKENVERHIQTMRAKGHTVYQAVYPQDDAAWLRGTFVKPTLIELNDISELEKEVFGPVLHIVRYQSQQLDTLIEQINAAGYGLTLGVHTRIDETIQRVTNRAKVGNQYVNRNMVGAVVGVQPFGGEGLSGTGPKAGGPLYLYRLLAHRPDDALAAEFAKQNREQAPDTSARALLLAGLQALEDWAISGEHQDLATLCQRYKEYSVSGTTRRLLGPTGESNTYTLLPRERILCLADNDEDRLIQAAAVLATGGKLLWPEGEQEKTLYARLPEELQSRIQFTHGWQRHEVSFQGVIFHGNADRLRQISEALAERDGPIILLLGYSNGDTHVQLERLLIERSLSINTAAAGGNASLMTIG

SEQ ID NO: 43481 - protein, 562 aa, Xanthomonas campestris
MSLNGGAGASRAGGRSDHRGGVRQHERRRSQDLQAQSGICERAQRDLPHQPQHPHPGRMTQTNGFDALHAHAQRLRGAAIPALLAAEPERPTQYARQVGPLYFNFARQKYDRAALDALFAIARERDLSGAFQRLFRGEQVNVTEQRAALHTALRGDLTDAPVASEAYATAEEVRQRMGSLIQQLEATDVTDIVSVGIGGSDLGPRLVADALRAPSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLEGAAQFDAHVLNTPLEENVAVLHGLTAVWNRNLLGSATHAVMTYDQRLALLPAYLQQLVMESLGKRVKLDGSAVDSDTVSVWWGGAGTDVQHSFFQALHQGTSVVPADFIGTVHNDDPYAENHTALMANVLAQTEALANGQDSSDPHRSYPGGRPSTVILLDALTPQALGALISMYEHSVYVQSVMWGINAFDQFGVELGKQLASQLLPALKGESVDVADPVTRELLNKLRG

SEQ ID NO: 43482 - protein, 135 aa, Brassica napus
  misc_feature (35)..(35): Xaa can be any naturally occurring amino acid
  misc_feature (38)..(38): Xaa can be any naturally occurring amino acid
  misc_feature (40)..(40): Xaa can be any naturally occurring amino acid
  misc_feature (46)..(46): Xaa can be any naturally occurring amino acid
  misc_feature (49)..(50): Xaa can be any naturally occurring amino acid
  misc_feature (55)..(57): Xaa can be any naturally occurring amino acid
  misc_feature (60)..(60): Xaa can be any naturally occurring amino acid
  misc_feature (63)..(64): Xaa can be any naturally occurring amino acid
  misc_feature (66)..(67): Xaa can be any naturally occurring amino acid
  misc_feature (69)..(69): Xaa can be any naturally occurring amino acid
  misc_feature (76)..(78): Xaa can be any naturally occurring amino acid
  misc_feature (81)..(81): Xaa can be any naturally occurring amino acid
  misc_feature (88)..(88): Xaa can be any naturally occurring amino acid
  misc_feature (96)..(97): Xaa can be any naturally occurring amino acid
  misc_feature (101)..(101): Xaa can be any naturally occurring amino acid
  misc_feature (104)..(104): Xaa can be any naturally occurring amino acid
  misc_feature (107)..(107): Xaa can be any naturally occurring amino acid
  unsure (1)..(135): unsure at all Xaa locations
MGKLLCDSTATLQSPSPTVQWREPPTASAPLDDVXLVXQXTEAAAXVEXXEKTMXXXAAXIAXXEXXTXLEELQRXXXQRXHAMGVLXKSSPAKGXXRTSXSHXFSXHRFLPHFFPPHFPGFCPPDRPAATLHRS

SEQ ID NO: 43483 - protein, 275 aa, Glycine max
  misc_feature (205)..(205): Xaa can be any naturally occurring amino acid
  unsure (1)..(275): unsure at all Xaa locations
MAFFGRIGNLLRQTASRQVSSKLRSPPSFFQAIRCMSSAPSTKLFIGGVSYSTDEQSLREAFSKYGEVVDARIIMDRETGRSRGFGFITYTSVEEASSAIQALDGQDLHGRPIRVNYANERPRGYGGGGGGFGSYGAVGGGGYEGGGGSGYRGNVSDGYGGGNYSRNDGGGYGYGAGSYGSGGNYGDSGPGNNYSGGYSGSNSGXFGDAGSVGNHESSTGFAGNGYDGSVVDGGVGAGSEFGSSGQLDSKTSSNGDEGFGDYRDDNDADNFAKRA

SEQ ID NO: 43484 - protein, 494 aa, Azoarcus sp. BH72
MSFADLGLIPELQRAVADAGYTEPTPIQRQAIPIVIAGNDVMGGAQTGTGKTAGFTLPLLHRLARHANTSTSPARHQTRALILAPTRELAMQVYESVKTYSKHLPLRATCIYGGVDMNPQIQELRRGIEIVIATPGRLLDHVQQKTINLTQVEMLVLDEADRMLDMGFIPDIKRILALLPASRQSLLFSATFSDEIKKLADQMLKNPQLIEVARRNMVSETITHRVHPVSSGMKRNLLAHLLRHQPDTQALVFVDTKLVCGRLAHFLERHSISADSIHGDKSQQQRTETLEAFKAGKLRVLVATDVAARGIDIDELPYVINYELPHTAEDYVHRIGRTGRAGHQGNAVSLVCTEEKHLLADIQKLIKLEIPQEVVPGFEPDPDFFEAGSRAHRGRRPVEDFDERPRREPRGGREERPPREERAPREDRGARNVVAKRPPRSTIAPDGFDFSKPYVAKPVVLAEGAAPDASPAEAGTPRRGQRPIAFLLGGLGRK

SEQ ID NO: 43485 - protein, 177 aa, Leptospira interrogans serovar Lai str. 56601
MSIVKSKIRTIPDYPKPGILFRDITSLLLDPEGLALTIGTFVNRYQGKGITKVAGIEARGFLTGAPLAFQLGVGFIPIRKKGKLPSETVSEEYDLEYGKDVIEVHKDSIQPGDKILLMDDLIATGGTMIAAVKLLKKLGAEIYEAGVIIDLPDLGGRKKLQEELKVPVFSICEFEGH

SEQ ID NO: 43486 - protein, 358 aa, Fragaria x ananassa
MTAYRGKYADELIKNAAYIGTPGKGILAADESTGTIGKRFDSIKVENVEENRRALRELLFTAPGVLQYLSGVILFEETLYQKTAEGKPFVDVLNEGGVLPGIKVDKGVVELKGTDGETTTQGLDGLGARCAKYYEAGARFAKWRAVLKIGPNEPSQLSINENANGLARYAIICQENGLVPIVEPEILVDGPHSIDKCADVTERVLAACYKALNDHHVLLEGTLLKPNMVTPGSEAKKASPEVIAEYTVRALQRTTPAAVPAVVFLSGGQSEEEATLNLNAMNQLKGKKPWTLSFSFGRALQASTLKAWSGKKENVKAAQEALLTRAKANSEATLGTYKGDAKLGEGAAESLHVKDYKY

SEQ ID NO: 43487 - protein, 455 aa, Bacteroides fragilis YCH46
MARFEIKMPKLGESITEGTILSWSVQVGDVVNEDDVLFEVNTAKVSAEIPSPVAGKVVEILFKEGDTVPVGTVVAIVDMDGEGSGEASETAGSVETASAPKAAEVSGTASVPKVQAEVTAPKVERWYSPAVLQLAREAKISQEELDSIPGTGYEGRLSKKDIRTYIEMKKGAPAADVSTTVVSTVSANNSGSSPVPSAEVQKKAAAAAPQAQHGQSASAVSSDASVEVKEMDRVRRIIADHMVMSKKVSPHVTNVVEVDVTRLVRWREKTKDDFFRREGVKLTYMPAIAEATAQALAAYPQVNVSVDGYNILYKKHINVGIAVSQDDGNLIVPVVHDADRLNLNGLAVAIDSLAKKARVNKLMPDDIDGGTFTITNFGTFKMLFGTPIINQPQVAILGVGVIEKKPAVVETPEGDVIAIRHKMYLSLSYDHRVVDGSLGGNFLHFIADYLENWKE

SEQ ID NO: 43488 - protein, 678 aa, Bacteroides fragilis YCH46
MKKYDIKTTDEQTLRKWYHLMTLGRALDEKAPAYLLQSLGWSYHAPYAGHDGIQLAIGQVFTLGEDYLFPYYRDMLTVLSAGMTPEELILNGISKATDPGSAGRHMSNHFAKPEWHIENISSATGTHDLHAAGVGRAMVYYGHKGVAITSHGESATSEGFVYEAINGASNERLPVIFVFQDNGYGISVPKKDQTANRKVADNFSGFKNLRIIHCNGKDVFDSMNAMTEAREFAIANRTPVIVHANCVRIGSHSNSDKHTLYRDENELAYVKEADPLMKFRRMLLRYKRLTEEDLQQIEAAAKKELAAANRKALAAPDPIPESIYDFVLPEPYIPQKYKDGLPGPVEGEKSFMVNAINETLKEEFRRNPDTFIWGQDVANKDKGGVFNVTKGMQQEFGDARVFSAPIAEDYIVGTANGMCRFDPKIHVVIEGAEFADYFWPAVEQYVECTHEYWRSNGKFTPNITLRLASGGYIGGGLYHSQNLEGALTTLPGARIVCPSFADDAAGLLRTSMRSKGFTLYLEPKALYNSVEAAAVVPEEFEVPFGKARIRREGTDLTIITYGNTTHFCLDVAERLAREEVGSVEVIDLRSLIPLDKEAIFASVRKTGKVMVVHEDKVFSGFGAEIAAQIAGEMFRYLDAPVQRVGSTFTPVGFNPILERAILPNDEKIYKAAKELLEF

SEQ ID NO: 43489 - protein, 308 aa, Erwinia carotovora subsp. atroseptica SCRI1043
MTKKADYIWFNGEMVPWAEAKVHVMSHALHYGTSVFEGVRCYNSHKGPVVFRHREHMQRLRDSAKIYRMPVAQSVDELMEACRETLRKNNLTSAYIRPLVFIGDVGMGVNPPDGYQTDVIIAAFPWGAYLGEEALEAGIDAMVSSWNRVAANTIPTAAKAGGNYLSSLLVGSEARRHGYQEGIALDVHGYVSEGAGENLFEVKDGIIFTPPFTSSALPGITRDAIIKLAKDAGYEVREQVLSRESLYLADEVFMSGTAAEITPVRSVDGIQVGIGKRGPVTQALQQAFFGLFTGETEDKWGWLDPVNQ

SEQ ID NO: 43490 - protein, 267 aa, Streptococcus pneumoniae R6
MQFPEGFVEKYKEILGDEARDFLASFEEEAVSAFRVNPLKEEQLSFSDAITQTPWGHYGKVSGKSPEHATGLVYSQEPAAQMVAQVAQPSPGMKVLDLAAAPGGKSTQLAAYLAGEGLLVSNEISSKRAKILVENMERFGATNVVVTNESADRLVKVFKGYFDLIVLDAPCSGEGMFRKQPDAMDYWSLDYPSQCASLQREILEDAVTMLAEGGRLVYSTCTWAPEENEEIVNWLLEEYDFDLLPVEHINGMVAGIDLPETARMYPY

SEQ ID NO: 43491 - protein, 306 aa, Arabidopsis thaliana
MPLNVVNDRDGSSRILLTDPAGSTAEVLLYGGQVVSWKNERREKLLYMSTKAQLKPPKAIRGGLPISFPQFGNFGALERHGFARNRFWSLDNDPSPLPPANQQSTVDLVLKSTEDDLKIWPHSFELRVRISISPGKLTIIPRVRNTDTKAFSFMFSLRNYLYVSDISEVRVEGLETLDYLDNLMRRERFTEQADAITFDGEVDKVYLNTPTKIAIIDHERKRTIELRKEGMPNAAVWNPWDKKAKSIADMGDEDYTTMLCVDSGAIESPIVLKPHEEWKGRQELSIVSSSYCSGQLDPRKVLYGDY

SEQ ID NO: 43492 - protein, 652 aa, Helicobacter hepaticus ATCC 51449
MQKTSPHITDEDIPLLQKMSHTLGFLCADMVQKANSGHPGAPMGLSDIASVLHFHINLAPTQPQWLNRDRIIFSGGHASALVYSLLHLWGFEVSMADLHSFRQLDSKTPGHPEYRHTQGIEITTGPLGQGIANAVGMAMASKYAQNLFGREIISHNIYCLCGDGDLQEGISYEAASLAGHHALSNLILIYDSNHITIEGDTQLAMSEDIAKRFEAQGWEVLSCDGHDYIQIHNVLTNAKTSSKPILIIAHTIIAKNALSLEGSHKAHGAPLGEEIIATAKQKLSFPAESFYIPDDVALAFGTMKERGELNFAQWYKNYENLPQIAKERLDKMREPDVSHIVYPQFALGESMATRVSNGKILNSISQALEGFIGGSADLAPSNNTQLQDEGDFPQGKNWHFGIREHAMGAICNGVANYGLFLPFCATFFVFSDYMSPSVRVASLMKAKVYYIWTHDSIGVGEDGATHQPIEQLSHFRAMPNLLVFRPADANENIACWQVGLDSKLPCAFVLSRQNLPVIMESTPQLKKQVQKGGYVLRSCDNAVITLMASGSEVSLALKACETLEDLGIKTQVVSVPCLDLLLEQPKGYIKELCGKSAVLAIEASRGLEWYAVADEVIGMQSFGASGKGEALFNRFNFNIDYIIAAAQKLIQN

SEQ ID NO: 43493 - protein, 113 aa, Helicobacter hepaticus ATCC 51449
MAEKTIFEKIVAGEIPCKKVLENERFLAFYDINPKAPVHILAIPKVCVKDFDCADSKLLGELCGFAQEVTKSVGIDKSGYRIITNIGADGGQEVPHLHLHILGGGKLKFPSLV

SEQ ID NO: 43494 - protein, 468 aa, Bacillus cereus ATCC 10987
MKQKRNSLYIFSITLVAAIGGLLFGYDTAVISGAEESLKVYFIDSLGLGSLAHGVTVSSALIGCIIGGVISGYCASKFGRKRSLIIAAILFIVSALGASYPEFLFFTKGEPTIVLLLAFNLYRIIGGIGVGLASAICPIYIGEIAPADIRGRLVSFNQFMIIFGMLVVYFVNWGIANGETLEWINDVGWRYMFASGVIPAIIFAILLLFVPETPRYLAIQHQDKKALAILTKINGPLEAKAILDDIKQTMAINVSSEKLFSYGKLVIIVGVLLSVFQQFVGINVALYYAPRIFESMGAAKDSSMMQTIIMGLVNVIFTVIAILTVDRWGRKPLLIVGSIGMAIGMFGVASMAFANIIGIGTLIFIIVYTASFMMSWGPICWVLISEIFPNKIRGQAVAIAVAAQWAANYFISSTYPMMMEYSGGLTYSFYGLMSVLSALFVWKLVPETKGKTLEQMENTWKKQTEYIS

SEQ ID NO: 43495 - protein, 400 aa, Zea mays
MLRVRNRLLPLLGAASPLPSPIHIHLRVCRLLSTSTSTATVPAPFSLENYLVAACGFAPAQARLVSKKAFNELSRESKRSSEEHSCRRLISASNPDAILALLSGAGLSRADIAAVVFADPLILRASVSKIAPRLVALRDRVGLSTPQIARFLLVGSRALRRCDVVPKVEFFLSFLGSFDRVLAVAKANLGIFNANLEKVIKPNIDLFRQRGVRNVPKICLHRPRTLSFNLERVKEFLLRAEELGVPAASPLFMQAVGVVTSFPPEKVAAKLDFFKRTLGCSESEVSNAVSKMPQILALSEATLLRKIEFLVNEGAIEPQYIMQRPILLAFSLEKRLVPRYRVIKVLQGKGLLNSNMSLSSLASLAEETFKSKFVDCHKDCVPGLADAYAAACASIVPSTV

SEQ ID NO: 43496 - protein, 559 aa, Rhizobium leguminosarum bv. viciae 3841
MPSIKSDIEIARAAAKKPIFEIGAKLGIPVEQLVPYGHDKAKVSAEFIAAQAGKKDGKLILVTAINPTPAGEGKTTTTVGLGDGLNRIGKKAVVCIREASLGPCFGVKGGAAGGGYAQVVPMEDINLHFTGDFHAITSAHNLLAAMIDNHIYWGNEENIDIRRITWRRVMDMNDRALRSMVLSLGGVANGFPRQGGFDITVASEVMAILCLATDLKDLERRLGDIIIGYRFDRTPVHARDLKADGAMAVLLKDAMQPNLVQTLENNPAFVHGGPFANIAHGCNSVTATKTALKLGDYVVTEAGFGADLGAEKFFDIKCRKAGLKPDAAVIVATVRALKMNGGVKKDDLGTEDVAALKKGCANLGRHVANVRRFGVPVVVAINHFVSDTDAEIAAVKEFVSRLGAEAILCRHWALGSAGIEDLAHKVVELAESGQAKFQPLYGDDLSLFEKIEIVASKIYHAGEVTADKAVRDQLQTWEEQGYGKLPICMAKTQYSFSTDPNLRGAPEGHIVTVREVRLSAGAGFVVAITGEIMTMPGLPKSPSAERIFLNDQGYIEGLF

SEQ ID NO: 43497 - protein, 583 aa, Nicotiana tabacum
SIKFLAPSLPNPARFSKNAVKLHATPPSVAAPPPGAPEVAAERLEPRVEEKDGYWILKEQFRKGINPQEKVKIEKQPMKLFMENGIEELAKIPIEEIDQSKLTKDDIDVRLKWLGLFHRRKNQYGRFMMRLKLPNGVTTSAQTRYLASVIRKYGKEGCADITTRQNWQIRGVVLPDVPEILKGLAEVGLTSLQSGMDNVRNPVGNPLAGIDPEEIVDTGPYTNLLSQFITGNSRGNPAVSNLPRKWNPCVVASHDLYEHPHINDLAYMPATKDGRFGFNLLVGGFFSAKRCDEAIPLDAWVPADDVVPVCKAILEAFRDLGFRGNRQKCRMMWLIDELGVEGFRAEVEKRMPQQELERASPEDLVQKQWERRDYLGVHPQKQEGYSFIGLHIPVGRVQADDMDELARLADEYGSGEIRLTVEQNIIIPNIENSKIEALLKEPVLSTFSPDPPILMKGLVACTGNQFCGQAIIETKARSLMITEEVQRQVSLTRPVRMHWTGCPNTCAQVQVADIGFMGCLTRDKNGKTVEGADVFLGGRIGSDSHLGEVYKKAVPCDDLVPLVVDLLVNNFGAVPREREETED

SEQ ID NO: 43498 - protein, 387 aa, Pseudomonas syringae pv. phaseolicola 1448A
MSINVEDYYSAETFKKMKAFADKQETPFVVIDTAIISKAYDDLRAGFEFAKVYYAVKANPAVEVINLLKDKGSSFDIASIYELDKVMSCGVGPERISYGNTIKKSKDIRYFYEKGVRLFATDSEADLRNIAKAAPGAKVYVRILTEGSTTADWPLSRKFGCQTDMAMDLLILARDLGLVPYGISFHVGSQQRDISVWDAAIAKVKVIFERLKEEDGIVLKLINMGGGFPANYITRTNSLETYAEEIIRFLKEDFGDDLPEIILEPGRSLISNAGILVSEVVLVARKSRTAVERWVYTDVGKFSGLIETMDEAIKFPIWTEKKGEMEEVVIAGPTCDSADIMYENYKYGLPLNLAIGDRMYWLSTGAYTTSYSAVEFNGFPPLKSFYL

SEQ ID NO: 43499 - protein, 448 aa, Nonea caspica
MATEIKKYITSDELKNHDKPGDLWISIQGKVYDVSNWVKDHPGGTFPLMSLAGQEVTDAFVAFHPPSVWKNLDRFFTGYYLKDYSVSEVSKDYRKLVFEFSKMGLYDKKGHIVFATLCFIATLFAMSVYGVLFCEGVLVHLFSGCLMGFLWIQSGWIGHDARHYMVVSDSRFNKFVGIFVSNCISGISIGWWKWNHNAHHLACNSLEYDPDLQYIPFLVVSSKFFTSLNSHFYGKRLTFDSLSRFFVSYQHWTFYPVMCSARLNMFVQSLIMLLTKRNVSYRAQELLGLLVFLIWFPLLVSCLPNVGERVMFVVASLCVTGMQQVQFSLNHFSSSVYVGKVKGNNWFEKQTDGTLDISCPPWMDWFHGGLQFQVEHHLFPKMPRCHFRKISPFVMELCKKHNLPYNVASFSKANELTLSTLRNTALAARDITKPLPKNLVWEALQTHG

SEQ ID NO: 43500 - protein, 325 aa, Wolbachia endosymbiont of Drosophila simulans
MLITNSDKLDDIVSSDLSAMNDFVFKNVNDEDAKLATDIISHLVRSGGKKIRPKLVFIICKMLNYSGENRINVAASVEFIHNATLLHDDVLDESEARHGVKTANKIWGNKSSILVGDLLLTLAFRWLIECGNLNILSILSKASHLLVKGEIKQMTARFDPHTVRENYFDIIGEKTASLFSACCEAASTVSGATNDETERLKNFGFNFGMAFQIVDDMLDYTANQGTSGKQVGKDFFEGKVTLPAIIAYEKGSPAEQKFWEKCFSSARHNFDQALHYINHHNAIQLSMEKARHYINMAQNDISTFSDSFYKTTLINFLNASIERRM

SEQ ID NO: 43501 - protein, 157 aa, Triticum aestivum
  misc_feature (110)..(110): Xaa can be any naturally occurring amino acid
  misc_feature (116)..(116): Xaa can be any naturally occurring amino acid
  misc_feature (125)..(125): Xaa can be any naturally occurring amino acid
  misc_feature (136)..(137): Xaa can be any naturally occurring amino acid
  unsure (1)..(157): unsure at all Xaa locations
MEWASAAYTAAALVCAAAACVVALAHIYRHLLHYAEPIYQRFIVRIIFMVPVYAVMSFLSLILPNNAIYFNSIREIYDAWVIYNFLSLCLAWVGGPGAVVVSLSGRTLKXSWILMXCCYQAIPLXGRLYEDQTRFXXFVIQAYLVAHLKLTKGNQDE

SEQ ID NO: 43502 - protein, 154 aa, Lactobacillus plantarum WCFS1
MANSEKTLVLVKPDGVSEGHIGEVITRLERKGYQIAALKVIKATAEQLQQHYSEKVGKPYFKEIETYMMEGPLVAIIVSGTGVVKAVHRLAGSTRPAEAQPGTIRGDFSHEYPDGILRNVIHTSDSRENAHHEIAIWFPELAVKARKADNKVKA

SEQ ID NO: 43503 - protein, 328 aa, Xanthomonas campestris pv. vesicatoria str. 85-10
MSATKHQVVCFGEALIDMLALPQDGPDQARTFAQYAGGAPANVAVAVARLGGAAHFVGMLGRDMFGDFLLQSLQQSGVATDGIVRTDQAKTALAFVALDDAGERSFSFYRPPAADLLFRPEHFAADGFTQAAVLHVCSNSMTEPEIAQCTLDGMRRARADGAIVSLDLNLRPMLWPQDVDPAALLWEALALADVVKLSREELEYLAGTLDGDASAVTQKLWQGKASCLLVTDGGGPVHWQTRTDAGQVPAFQVQVRDSTAAGDAFVGGLLYQLATRAASLEQLCGDSAAINEVIRFAAAVGALAVTRKGAFAAMPSIDDVHSLIQEQS

SEQ ID NO: 43504 - protein, 317 aa, Burkholderia xenovorans LB400
MTTALDQLKQYTTVVADTGDFQQLAQYKPQDATTNPSLILKAVQKDDYKPLLEKTVKAHASKPVGAIIDQLLIAFGTEILKIIPGRVSTEVDARLSFDTEGSIAKGRELIALYKEHGIGRERVLIKLASTWEGIRAAEVLQKEGIHCNMTLLFSLAQAAACAEAGAQLISPFVGRIYDWYKKNAGSAWDEAKDGGANDPGVKSVRRIYAYYKKFGYKTEVMGASFRTPGQILELAGCDLLTISPDLLQKLHESTEKVERKLSPDIAKESDIERVPVDESSFRFLVNDEAMATEKLAEGIRAFAADAIKLEKLIDALR

SEQ ID NO: 43505 - protein, 456 aa, Nicotiana tabacum
MMRLKLPNGVTTSAQTRYLASVIRKYGKEGCADITTRQNWQIRGVVLPDVPEILKGLAEVGLTSLQSGMDNVRNPVGNPLAAIDPEEIVDTRPYTNLLSQFITGNSRGNPALSNLPSKWNPCVVGSHDLYEHPHINDLAYMPATKDGRFGFNLLVGGFFSAKRCDEAIPLDAWVPADDVVPVCKAILEAFRDLGFRGNRQKCRMMWLIDELGVEGFRAEVEKRMPQQQLERASPEDLVQKQWERRDYLGVHPQKQEGYSFIGLHIPVGRVQADDMDELARLADEYGSGEIRLTVEQNIIIPNIETSKIEALLKEPVLSTFSPDPPILMKGLVACTGNQFCGQAIIETKARSLKITEEVQRQVSLTKPVRMHWTGCPNTCAQVQVADIGFMGCLTRDKNGKTVEGADVFLGGRIGSDSHLGEVYKKAVPCDDLVPLVVDLLVNNFGAVPREREETED

SEQ ID NO: 43506 - protein, 347 aa, Nicotiana tabacum
GDVTTRQNWQIRGVVLPDVPEILKGLDEVGLTSLQSGMDNVRNPVGNPLAGIDPHEIVDTRPYTNLLSQYVTANFRGNPAVTNLPRKWNVCVIGSHDLYEHPHINDLAYMPASKDGRFGFNLLVGGFFSPKRCAEAVPLDAWVPADDVVPVCKAILEAYRDLGTRGNRQKTRMMWLVDELGVEGFRAEVVKRMPQQKLDRESTEDLVQKQWERREYLGVHPQKQEGYSFVGLHIPVGRVQADDMDELARLADNYGSGELRLTVEQNIIIPNVENSKIESLLNEPLLKNRFSTNPPILMKNLVACTGNQFCGQAIIETKARSMKITEEVQRLVSVTKPVRMHWTGCPN

SEQ ID NO: 43507 - protein, 274 aa, Zea mays
MKRKENSAHSAPPLNRPRGKRKALAELPKSNGLNMNHDSAPRPSKPRTRSAARAEAEAEAAMKRRKAGDAARWPMDTRQPDAEAAVAPYVGDIDRYLRSLEVEPLRRPSHSYFQDIQKNICPKMRAILVDWLVEVAEEFKLHAETLHLAVSYVDRFLTMNVVARNKLQLLGVTALLVAAKYEEIESSKMKVKRYTDITDNTYTKQQNLSLEQSTGYRVFDLQKSIYVIHELQLTIRCPNQVAIREKYKDPKFGCVSTMVSPREIPTSFLEGCHK

SEQ ID NO: 43508 - protein, 215 aa, Helicobacter hepaticus ATCC 51449
MKELFEGAIKFREEDFNEHKELYESLKKRQEPHTLLITCTDSRVVPNLITNSLPGDLFVIRNMGNIVPPYLGSDKGIRGGYLATTSGIEYALSILGIKNVIICGHSDCGACSAIYEPPEELEKAPYVKKWIELLEPVKQKVDALKPGSKAKRRWLMEQVNIEHQLENLMTYPFVEERFDRGELNIYGWYYIIETGEILNYNMIQREFKPINKIKS

SEQ ID NO: 43509 - protein, 945 aa, Candida glabrata CBS 138
MDGGIEDSGAFFAPDAVFGDRVRRFQEFLEVFEQYKDDVKAILAKNSASLASELGNIDEDAEEDVDLMDDIDKSKKNVSDGPNAVPHRITISLDDLRDFDRKFWRGVLNEPAYYIPPAERALSEIATALDDSPRNTVDAVSAKRPWRLSFKGSFGSHTLSPGTLNAMYLNKLVSIEGIVTKTSLVRPKLMRSVHYAEKTGRFHYRDYTDSTTSLTTRVPTPAIYPTEDPDGNKLTTEYGFSTYIDHQRITVQEMPEMAQVGPVPRSVDIILDDDLVDKTKPGDRINVVGVFKSVGAGGLNQGESNTLNGFRTLIIGNSVYPLHARSTGVSAKETLNDLDIRNINKLSKRGDIFEILAQSLAPSIYGHENIKRAVLLMLFGGVEKNLENGSHLRGDINILMVGDPSTAKSQMLRFVLNTASLAIATTGRGSSGVGLTAAVTTDRETGERRLEAGAMVLADRGIVCIDEFDKMTDVDRVAIHEVMEQQTVTIAKAGIHTTLNSRCSVIAAANPVFGQYDVNRDPHQNIALPDSLLSRFDLLFVVTDDINEARDRSISEHVLRTHRYLSPGMVEGEPVRDRLNLSLAVGTDEDDENANDNTNQDEEDQVFEKFNPLLQAGAMLAKNRGNYNGTEIPKLVKISFLRKYVQYAKERVVPQLTTEAVDVIVKNYTDLRNDENTKKSPITARTLETLIRLATAHAKVRLSRTVDKVDATVAANLLRFSLLGEDVGEITDADLQMDFEYPSNRNSPKKSPKKKQRLGPRGYGLSPSKSNRGSPVKRLDFGDSQAEERLDASQIEEEDVLEPGMEELHISDDANLHRRLERELRGSPLRSTQQGPLTEVTTPRMPNISTAGQEEDNGNQDISVDTVDQSNISTARLSLLSGLVARLMQTDLFEEESYPVDALFDVINGELAEEEKFTKTEYLAGLKVMAQRNNLMIAEEKVWRV

SEQ ID NO: 43510 - protein, 189 aa, Boechera stricta
NMLKTLDRYQKCSYGSIEVNNKPAKELENSYREYLKLKGRYENLQRQQRNLLGEDLGPLDSKELEQLERQLDGSLKQVRSIKTQYMLDQLSDLHNKEQMLLETNRALAMKLEDMIGVRSHHMGGGGWEGGEQNITYAHHQAQSQGLYQPLECNPTLQIGYDNPVCSEQITATTQAQAQPGNGYIPGWML

SEQ ID NO: 43511 - protein, 251 aa, Boechera stricta
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLEANRALSMKLEDMTIGVRHHHIVGAWEGGDQQNVAYGHHQAQSQGLYQSLECDPTLQIGYGHPVCSEQMTVTTQVQTQPGNGYIPGWML

SEQ ID NO: 43512 - protein, 734 aa, Arabidopsis thaliana
MKGATLVALAATIGNFLQGWDNATIAGAMVYINKDLNLPTSVQGLVVAMSLIGATVITTCSGPISDWLGRRPMLILSSVMYFVCGLIMLWSPNVYVLCFARLLNGFGAGLAVTLVPVYISETAPPEIRGQLNTLPQFLGSGGMFLSYCMVFTMSLSDSPSWRAMLGVLSIPSLLYLFLTVFYLPESPRWLVSKGRMDEAKRVLQQLCGREDVTDEMALLVEGLDIGGEKTMEDLLVTLEDHEGDDTLETVDEDGQIRLYGTHENQSYLARPVPEQNSSLGLRSRHGSLANQSMILKDPLVNLFGSLHEKMPEAGGNTRSGIFPHFGSMFSTTADAPHGKPAHWEKDIESHYNKDNDDYATDDGAGDDDDSDNDLRSPLMSRQTTSMDKDMIPHPTSGSTLSMRRHSTLMQGNGESSMGIGGGWHMGYRYENDEYKRYYLKEDGAESRRGSIISIPGGPDGGGSYIHASALVSRSVLGPKSVHGSAMVPPEKIAASGPLWSALLEPGVKRALVVGVGIQILQQFSGINGVLYYTPQILERAGVDILLSSLGLSSISASFLISGLTTLLMLPAIVVAMRLMDVSGRRSLLLWTIPVLIVSLVVLVISELIHISKVVNAALSTGCVVLYFCFFVMGYGPFQTSSVLKSSQQADRGLCIAICAMVFWIGDIIVTYSLPVLLSSIELVGVFSIYAAVCVISWIFVYMKVPETKGMPLEVITDYFAFGAQAQASAPSKDI

SEQ ID NO: 43513 - protein, 454 aa, Wolbachia endosymbiont of Drosophila simulans
MPIEILMPALSPTMSKTGGKIVKWHKKEQDKVEVGDVIAEIETDKAIMEFESIDEGVLAKILVTEGTSGVPVNQPIALMLEEGEDESALNNYTSTSINSAVKKEVTKSAVDNQKSEHQDLNGKPISHSSVSFQRVTLESNPSMSSQCLTLGSRKEEWIPVSATQMTEGYAEGRTKISPLAKKIAQNEGVNVQQLKGTGPYGRIIKADVLEFLGSGIHTESPEKDTIVEVSNMRQVIAQRLTESKQNVPHFYLTVDCQVDKLISLKNEINSADENNKVTINDLIIKAAAFSMKKFPDINSSWIDNKILRYSNIDISIAVALEDGLITPIVKNADKKGILSISKEVKDLVSRARSGKLKPEEFQGGGFTISNLGMFGIKAFSAIINPPQSCIMAVGASKKQPIVMNEKIEIAEIMTVTLSVDHRAVDGALGAKFLNAFKHYIENPLVMLIETAVIY

SEQ ID NO: 43514 - protein, 444 aa, Lupinus luteus
MATIATIKARQIFDSRGNPTVEVDLTLSDGTFARAAVPSGASTGIYEALELRDGGSDYLGKGVSKAVDNVNTIIAPALIGKDPTEQTAIDNFIVQELDGTVNEWGWGKQKLGANAILAVSLAVCKAGASALKIPLYKHIANLAGNKNLVLPVPAFNVINGGSHAGNKLAMQEFMILPVGASTFKEALKIGVEVYHNLKSVIKKKYGQDAVNVGDEGGFAPNIQENKEGLELLKSAIAKAGYTDKVVIGMDVAASEFYTSDKKYVLNFKEDNNDGSQKISGEELKELYKSFVAEYPIASIEDPFDQDDWEHYGKITTEIGTEVQIVGDDLLVTNPKRVQKAIDSKSCNALLLKVNQIGSVTESIEAVKMSKKAGWGVMTSHRSGETEDTFIADLAVGLSTGQIKTGAPCRSERLAKYNQLLRIEEELGDEAVYAGVNYRNPVEPY

SEQ ID NO: 43515 - protein, 467 aa, Brucella suis 1330
MSYDVVVIGTGPGGYVAAIKAAQLGLKVAVVEKRKTFGGTCLNIGCIPSKALLHASEVFAEAGHSFDTLGVEVTPKLNLTKMLAHKDTTVKANVSGVEFLFKKNKITPYIGTGKIVGKGKVSVTSEDGKVEEIEAKNIIIATGSDVAGIPGVKVDIDEKVIVSSTGALSFDKVPGSLIVVGGGVIGLELGSVWARLGAKVTVVEYLDKVLGPMDGEVSKQFQRLLEKQGIAFKLGAKVTGVEKVGKGAKVTFEPVKGGDAETLEADAVLIATGRRPYTDGLGLQEAGVAVDERGRVAIDDHWRTNVEGIYAIGDVVQGPMLAHKAEDEGIAVAEIIAGQAGHVNFDVIPSVVYTQPEVASVGKTEEELKAAGIDYKVGKFPFTANGRARAMLHTDGFVKILADKATDRVLGAHILGYNAGEMIHELAVLMEFGGSSEDLARTCHAHPTMSETVRESALATFAKPIHM

SEQ ID NO: 43516 - protein, 612 aa, Oryza sativa
MDAVAFPPPPAPFLDDDLDFGDFAFADPQPAAAAAFDAFGAYDDDWGDFVDSRLGSWEKPRGPLPLSLFGADEDEEEEEGPAELPPTAADQRGASHASSNGSKPADLKDLIAGLYGSHPQPSSTDAAEVGTQEGSAVAAAEEEEEDGDGFEDDGWEFKAAAPSSSSDAVQDGGRQAHGDLTQDVPKSMSSDQEGWSLFTSVSENLNNVQTTDHVGTRESAGQSVKAFSYFPPNNAAILDLYKESEPIDAVHIMQCSSESVQSSSDMFSNTEMNSSFGTDENHSIKSASDRILIDFYHKLREESLTVISQYKKDLKESQKNSMLSDEKNEVMTETEREIQEICKELQDSSLAKGFCKDEHPSKDVCISELLNSAKEDHLKDFDKEYHLTEIIAMALEDMSSAVKLYKHSVSILRTLEIASKEEQCDYVSAWYSMLLSCAQELQHGAMIWQESCHANVGETVISQGAHYFIALGEIYRVAQILHISMLSFKPWVLADPGMLSKMLVCWNSCVNSWTSGLGMALTMVVDSKNLDAPVAKVLLESIININDIEVPNLQSFLPSDKMACKLTLLPTSLVPGMEVIIWDADHYFVKVANLWANQISSDPPQFSVSRVA

SEQ ID NO: 43517 - protein, 205 aa, Pisum sativum
YAKAKECSEILTVEDFAILLAKHFTSFYKQVTTAIVKIVEKPWERVSVDGQPHEHGFKLGSEKHTTEAIVKKSGALQLTSGIEGLSVLKTTKSGFEGFIRDKYTVLPDTRERMLATEITALWRYSYESVYSVPQKPLYFTDKYLAVKRVLLDTFFGPPKEGVYSPSVQSTLYQMAKATLNRVPDIASIQLKMPNIHFIPVNLSNK

SEQ ID NO: 43518 - protein, 287 aa, Clostridium difficile 630
MEISGRTGLFALIGTPVGHSKSPVMYNYSFKKLDLDYRYLAFDITVDKVKEALLAIKTFNIKGANVTMPCKSAVTEYMDELSPAARIIGACNTIVNDNGKLVGHITDGVGYVRNLKENGVEVKGKKITIMGAGGAATAIQVQCALDGAREISIFNPKDDFYKRAEQTVENIKKDVPECVVNLYDLEDTNKLYEEIESSDILTNATLIGMKPYDNETNIKDTSVLRKDLVVTDVVYNPKKTKMIEDAEANGCKAIGGLGMLLYQGAEAFNLYTGLEMPVEEVNELCFK

SEQ ID NO: 43519 - protein, 205 aa, Astragalus sinicus
YVKAKECSEILSVEDFAIILARHFTSFYNQVTTAIVKIVEKPWERLNVNGQPHEHGFKLGSEKHTVEAIVNKSGALQLTSGIEGLSVLKTTKSGFEGFVRDKYTALPETRERMLATEVTAAWRYSYESLNSIPQKPLYFTDKYLDVKRVLVDTFFGHPKEGVYSPSVQSTLYQMARATLNRFPDIASIQLKMPNIHFIPVNISNK

SEQ ID NO: 43520 - protein, 205 aa, Astragalus sinicus
YVKAKECSEILSVEDFAIILARHFTSFYNQVTTAIVKIVEKPWERLNVNGQPHEHGFKLGSEKHTVEAIVNKSGALQLTSGIEGLSVLKTTKSGFEGFVRDKYTALPETRERMLATEVTAAWRYSYESLNSIPQKPLYFTDKYLDVKRVLVDTFFGHPTEGVYSPSVQSTLYQMARATLNRFPDIASIQLKMPNIHFIPVNISNK

SEQ ID NO: 43521 - protein, 503 aa, Avicennia marina
MSTMAIRMPTRQLFIDGEWREPVQRKRILIINPANEQTIGDIPAATAEDVDIAVEAARKAFFRNSGKDWSSTTGAHRAKYLRAIAAKIKDRKAELVKLEAIDSGKPLVEASLDMDDVIGCFEYFAGIAERLDSEQRTPVSLPMETFKCHLLKEPIGVVGLISPWNYPLLMAIWKVAPALASGCTAILKPSELASVTCLELAEVCMEVGLPPGVLNILTGLGPEAGAPLVTHPHVAKISFTGSDTTGVKIMTAAAQLVKPVTLELGGKSPIVVFEDVDLDTAAEWTLFGCFWTNGQICSATSRLLVHESIAATFLEKLVKWCEKIKISDPLEEGCRLGPIVSRRQYEKVMKYISTAKEEGATILCGGARPEHLEKGYFVQPTIITDVKTSMQIWIEEVFGPVLCVKTFATEDEAIDLANDTHYGLAAAVISKDLDRCERMAKAFQVGAVWVNCSQPCFYQAPWGGKKRSGFGRELGERGLDIYLNVKQVTQYVSSEPWDWYKSP

SEQ ID NO: 43522 - protein, 457 aa, Rhizobium leguminosarum bv. viciae 3841
MGVKPRERAVGGQENSMSNRLNAPNDLRAFWMPFTANRQFKKEPRLFVGAKDMYYTTHDGRQVLDGTAGLWCVNAGHCRPKITEAIREQAGELDYAPAFQLGHPKAFELANRLVDIAPEGLNHVLYTNSGSESVETALKVALAYHRVKGNGSRFRLIGRERGYHGVNFGGISVGGIVTNRKMFGTLLTGVDHMPHTHQPGKNNFTRGEPEHGGDIATELERIVTLHDASTVAAVIVEPVAGSTGVLIPPKGYLQKLREICTKHGILLIFDEVITGFGRLGAPFAAQYYDVKPDMITAAKGLTNGVIPMGAVFVTSEIHDAFMNGPEHMIEFFHGYTYSGNPIASAAALATLDTYKEEGLLTRAAELSDYWADALHSLKDCPNVIDIRNTGLIGAIELDPIAGEPTKRAFTAFLKAYESGLLIRTTGDIIALSPPLIIEKHHIDELFGKLRTILQNNI

SEQ ID NO: 43523 - protein, 295 aa, Wolbachia endosymbiont of Drosophila simulans
MCNVGIPVPPGFTISTSACKVYYQDNRSSVIQVSDYSDPEKNVVTHWNDICSGIKNYMTMLENDIGCKFGDLNNPLLVSIRSGSVSSMPGMLDTILNVGLNDETVVGLAKKSGERFAYDSYCRFIMMYSNVVLQLDHHLFQDVIDNEQQKSGAKSLADLDVDVLKRIVNDFKKIVYEKTEKHFPQNVEEQLLNSVNAVFASWKNDRAVSYRRIHNIPENLGTAVNVQAMVFGNLNDNSATGVIFTRNPSTGEKKLFGEFLVNAQGEDVVSGVYTPMPIDGEQKNTMEKVAAQCLP

SEQ ID NO: 43524 - protein, 94 aa, Brassica napus
  misc_feature (36)..(36): Xaa can be any naturally occurring amino acid
  misc_feature (51)..(51): Xaa can be any naturally occurring amino acid
  misc_feature (61)..(61): Xaa can be any naturally occurring amino acid
  unsure (1)..(94): unsure at all Xaa locations
VVLGYEHGVLRNTNPRYVCQREFALKNLPDDPLFQXSKLYEVVPPVLTKLXRYYTVLFGVXMSLAICSQIIWDKALGLGLERQSVLQMDLLEVL

SEQ ID NO: 43525 - protein, 245 aa, Archaeoglobus fulgidus DSM 4304
MDEKLLKTIAESKYLVALTGAGVSAESGIPTFRGKDGLWNRYRPEELANPQAFAKDPEKVWKWYAWRMEKVFNAQPNKAHQAFAELERLGVLKCLITQNVDDLHERAGSRNVIHLHGSLRVVRCTSCNNSFEVESAPKIPPLPKCDKCGSLLRPGVVWFGEMLPPDVLDRAMREVERADVIIVAGTSAVVQPAASLPLIVKQRGGAIIEINPDETPLTPIADYSLRGKAGEVMDELVRHVRKALS

SEQ ID NO: 43526 - protein, 408 aa, Brucella suis 1330
MATEIRVPTLGESVTEATIGKWFKKAGEAIAVDEPLVELETDKVTVEVPAPAAGVLAEITAKEGDTVEVGALLGQISSDGAAVAAAPAQKKEEAKPAAAAPAAAPVASASSGPAMQPAPAAAKLLAESGLSADQVEGSGKRGQVLKGDVLDAITKGVSAAPAAPVAARPASSADDASREERVKMTRLRQTIARRLKDAQNTAAMLTTFNEVDMSAVMELRNKYKDVFEKKHGVKLGFMGFFTKAVTHALKEIPAVNAEIDGTDIVYKNFCHVGMAVGTDKGLVVPVIRDADQMSIAEVEKELARLARAARDGSLSMADMQGGTFTITNGGVYGSLMSTPILNAPQSGILGMHKIQERPMVVGGQIVVRPMMYLALSYDHRIVDGKEAVTFLVRVKESLEDPERLVLDL

SEQ ID NO: 43527 - protein, 132 aa, Oryza sativa
GVPSPSPLPSGELRALPGERRRFGRRGSPESPPPCPRWPPTSGRRRTDIWRLAQQVKVRQRVIATAVTYFRRVYTRKSMTEYDPRLVAPTCLYLASKVEESTVQARLLVFYIKKMCASDEKYRFEIKDILEM

SEQ ID NO: 43528 - protein, 386 aa, Erwinia carotovora subsp. atroseptica SCRI1043
MTRKQATIAVRSGLNDDEQYGCVVPPIHLSSTYNFTGFNQPRAHDYSRRGNPTRDVVQRALAELEGGAGAVMTSSGMSAIMLVCTVFLRPGDLLVAPHDCYGGSYRLFDSLSKRGAFRVKFVDQGDTHALNAALAEKPKLVLVESPSNPLLRVVDIAAICQAAREAGAVSVVDNTFLSPALQKPLELGADLVVHSCTKYLNGHSDVVAGAVIAKDVDTITELAWWANNIGVTGAAFDSYLLLRGLRTLSPRMAAAQRNAQQVVEFLQTQPLVKALYHPSLPNNPGHDIARRQQSGFGAMLSFELDGDEDTLRRFLASLELFTLAESLGGVESLISHAATMTHAGMAPEARAAAGISETLLRISTGIEDGDDLVADLDRAFQAAAKR

SEQ ID NO: 43529 - protein, 412 aa, Zea mays
MAALTSAKGALLPSWARSSSSGHGGDLWRVLGKALATAGGGGGGGCSLLLPRRWQSSLPQLDHVADRSNEESGGEIDWDNLGFGLTPTDYMYVTRCSPEDRGDFPRGELCRYGNIELSPSSGVLNYAQGLFEGMKAYRRPDRAGYTLFRPEENARRMQRGAERMCMPAPSVEQFVHAVRQTVLANRRWVPPQGKGALYLRPLLVGSGPILGLAPAPEYTFLIYAAPVGNYFKEGLAPINLVVHDEFHRAMPGGTGGVKTIANYAPVLRAQMDAKSKGFTDVLYLDSVHKRYLEEVSSCNVFVVKGGVVATPDTRGTILPGITRKSVIELARDRGYKVEERLVSIDDLMGADEVFCTGTAVVVAPVSTVMYQGERYEFRTGPDTVSQELYTTLTSIQMGMAAEDSKGWTVAVE

SEQ ID NO: 43530 - protein, 226 aa, Xanthomonas campestris pv. vesicatoria str. 85-10
MESLLEGFRHFRKEVYPRQSARFQELAGGQSPHTLFITCADSRVMPELIFSAQPGELFVYRNIGNVVPPYSQHVSGVVAAIEYAIAVLGVRHIVICGHTDCGAMKAVLKPESLEDVPSVAAWLKHTDAARHVTAHHGHDPQSHEALSCMTEENVVSQLDHLRTQPVVAARLAAGTLRIHGWIYDIAHGEIRAFDAEKGGFRPLLAESTPEATPRPRLQQVVRAELA

SEQ ID NO: 43531 - protein, 669 aa, Bacteroides fragilis YCH46
MNDSKLMNRAADNIRILAASMVEKANSGHPGGAMGGADFVNVLFSEFLVYDPQNPRWEGRDRFFLDPGHMSPMLYSVLAFTGKYTLDELKQFRQWGSPTPGHPEVNVDRGVENTSGPLGQGHTYAVGAAIAAKFLKARFGEVMNQTIYAYISDGGIQEEISQGAGRIAGTLGLDNLIMFYDSNDVQLSTNTEDVTTENVAMKYEAWDWKVITINGNDPDEIRKALTEAKAEKNRPTLIIGKTTMGKGARRADGSSYEADCATHGAPLGGDAYVNTIKNLGGNPENPFTIFPEVAELYAKRAEELKKIVADKYAAKAEWAKANPEKAAKLAEFFSGKAPKVNWDAIEQKAGGATRAGSATVLGALATQVENMIVSSADLSNSDKTDGFLKKTHAFKKGDFSGAFLQAGVSELSMACICIGMSLHGGIIAACGTFFVFSDYMKPALRMAALMEQPVKFIWTHDAFRVGEDGPTHEPVEQEAQVRLLEKLKNHKGHNSMLVLRPADVEETTIAWKLAMENMSTPTALILSRQNIVNLPAGTDYSQAAKGAYIIADADENPDVILVASGSEVSTLVAGAELLRKEGVKVRIVSAPSEGLFRNQSKEYQESILPAGAKIFGLTAGLPVNLEGLVGSNGKVFGLESFGFSAPYKVLDEKLGFTAENVYNQVKAML

SEQ ID NO: 43532 - protein, 502 aa, Avicennia marina
  misc_feature (158)..(158): Xaa can be any naturally occurring amino acid
  unsure (1)..(502): unsure at all Xaa locations
MAIRIPSRQLFIDGKWREPVNRKRLPIVNPATEETIGDIPAATAEDVNIAVEAARKAFFHNGGKDWATASGAHRAKYLRAIAAKVTEKKEELAKLEVLDCGKPLEEAAWDMDDVAGCFEYFADLAERLDSNQIPVSLPMDTFKCHVLKEPIGVVGLVXPWNYPLLMATWKVAPALAAGCTAILKPSEIASVTCLELAQVCKEVGLPAGVLNILTGLGPEAGAPLASHPHVDKITFTGSGATGSKIMTAAAQLVKPVTLELGGKSPIVVFEDVDLDTAAEWTLFGCFWTNGQICSATSRLLVHESIATTFLEKLVKWCEKIKISDPLEEGCRLGPIISRGQYEKVMKFISTAKEEGATILCGGARPEHLEKGYFVQPTIITDVKTSMQIWIEEVFGPVLGVKTFSKEDEPFELANDPHYGWAAAVLSQDLERCERMTKAFQAGIVWVNCSQPCFCQAPWGGKKRSGFGRDLGEWGLDNYLNVKQVTRYVSSEPWDWYKSPSKL

SEQ ID NO: 43533 - protein, 368 aa, Brassica napus
  misc_feature (157)..(157): Xaa can be any naturally occurring amino acid
  unsure (1)..(368): unsure at all Xaa locations
RPWLLGPHCIWRRGAKVWEISDSGNGTLKTTLTCPGSLGGVDDMLVGCLWQNDHIVTVSLGGTVRIFSASDLDKSPFQFSGHMKNISSLSVLRGSSDYILSGSYDGLICKWMMGRGFCGKLQRKQNSQIKCFAAHEEEIITSGFDNTISRISYQDGXCTNEESIGVGNQPNDLSLAPLSPGLLLVAFESGVVFLRGEKVVATINLGFTVTALAVTPDGTEAIVGGQDGKLRLYAVNGDSLTEEAVLEKHRGAISVIRYSPDLSMFASADLNREAVVWDRASREMKLKNMLYHSARINCLAWSPNSSMVATGSLDTCVIVYEVDKPASTRMTIKGAHLGGVYGLGFADDTHVVSSGEDACIRVGSLTPQ

SEQ ID NO: 43534 - protein, 298 aa, Zea mays
  misc_feature (194)..(194): Xaa can be any naturally occurring amino acid
  unsure (1)..(298): unsure at all Xaa locations
MDGYSSMSPGYFTNLLNREHDDVFILEENMRTENEVIEYPPVNELISQSKPKGRSKNFNEAEDILLISAYLNISKDAVVGKDQKDGRFWERVEKYFHDNKTFDSDRNWSSLKHRWSSTIHKEMSMFQGFVDAIERKNGSGKTMSDKLAEASTMFQELKGKTFSLFHAWNILKNEPKWAEEKIAKEDNGNGENHXNSERPLGRKAEKEKAKGKNRSEEEPDPFIEEVKKMRETREKIETERKERDDKFIELDTKKLNLEQDQHDKVIMTMDISSMDDQAKQYFRLLKDEILARRFGSQH

SEQ ID NO: 43535 - protein, 155 aa, Chlamydomonas sp. W80
GSPGLQALLEEAENERMHLLTFLEMRQPSWMFRAAVLLAQGAYFNMFFISYLISPKFCHAVVGYLEEEAVKTYTHLLHDIDAGHVWKDKPAPKTGIAYWKLSPDATMRDLILAVRADEASHSLVNHTLSEIPSDAPNPFIEPAKADAFSKAENKL

SEQ ID NO: 43536 - protein, 268 aa, Glycine max
MEKSGKRVLLTSNGDDISQGIAFHLVKQGCRLVLLGDQNSLRSIANKIMDSLSLADRGTVQVVGLDMEDQSESTFHHSVDKACQILGKLDAFVNCYAYEGKMQDHLELAESEFKKIVKINFMAAWFLLKAVGRKMREFNTGGSIVFLTSIVGAERGLYPGAAAYASALAGVQQLVRASALEIGKYQVRVNAISRGLHLHDEFPLSVGKERAEKFVKDAAPLERWLDVKNDLASTVIYLISDGSRYMTGTTIYVDGAQSITRPRMRSFM

SEQ ID NO: 43537 - protein, 491 aa, Burkholderia xenovorans LB400
MSDTPVTPSTSTFDQFGLAPDILKAVKESGYTIPTPIQEQAIPVVLAGRDMMGAAQTGTGKTASFSLPIIQRLLPQASTSASPARHPVRALILTPTRELADQVAANVQAYAKHTALRSAVVFGGVDMNPQSEQLRRGVEILIATPGRLLDHVQQKTANLGQVQILVLDEADRMLDMGFLPDLQRILNLLPKERQTLLFSATFSGEIKKLAATYLRDPQTIEVARSNSTATNVRQIVYEVAEGDKTGAVVQLIRERGLKQVIVFCNSKIGASRLSRSLERDGVIATAIHGDRSQNERMQALDAFKRGEIEALVATDVAARGLDIAELPAVINFDLPFNAEDYVHRIGRTGRAGASGDALSLCSPNERKQLADIEKLIKRPLEVQRLTVEAPVRHHHEERAPRRERSSEGREDRGGRRRSGASSSGSFDRPHHHRAQPVDDFFLKPYEPSPASVRKVEEADAASAAPQKPASKQPLAALLGGFGMPRKSPSSS

SEQ ID NO: 43538 - protein, 118 aa, Fusarium cerealis
TARRSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKD

SEQ ID NO: 43539 - protein, 337 aa, Rhizobium leguminosarum bv. viciae 3841
MSTIKTTVSAAALLAASAVGALAEPVLEPTTQKFIDGLAGGKPIYTLSPADARNVLAGAQKGDVKKLAAKEEDRVIKAGPTGSIKLRIVRPEHAKGTLPVILYFHGGGWVLGDADTHDRLVREIANGADAAVVFVDYERSPEARYPVAIEQAYAATKYVAEHAKEFKVDASRLAVAGDSVGGNMAAVVTLLAKERGGPAIDQQVLFYPVTDANFDNGSYNEFANGPWLTKEAMKWFWNAYLPDEAKRKEPTASPLQASLEQLNGLPPALVIVDENDVLRDEGEAYARKLSQAGVRVTSMRYNGTIHDFVLLNAIAETPAARSAIAVANDTLRSALHK

SEQ ID NO: 43540 - protein, 475 aa, Mesorhizobium loti MAFF303099
MDTQMLIGSKFENGAETEESILNPKTGATILNLPEASQAQIEAAVAAAEKAFVSWSRTTPAQRSGYLLKIADRIEAEAKEFAALEALNCGKPINSVLNDEIPAIVDCYRFFAGAVRSMPGVVAGEYLPGHTSMVRRDPIGIVASIAPWNYPLMMMAWKLAPAIGGGNTVVFKPSEQTPLTALRLARILAEILPEGVVNVVLGRGDSVGNALINHPKVNMISITGDVATGKKVLQAAAKSVKRTHLELGGKAPVIVFDDADLGAVVNGLRAFGYYNAGQDCTAACRIYAGKKIYDKLVADLSSAVSTIKYNQPDDTENEIGPLISRRQRDRVSSFVERASELKHIEITTGGRPGEGTGFYYQPTVVAGALQEDEIVRREVFGPVVSITRFTEVDEAVNWANDSDYGLASSVWTKDVSRAMATAARLQYGCTWINTHFMLTNEMPHGGLKQSGYGKDMSLYALEDYTAVRHVMVAHA

SEQ ID NO: 43541 - protein, 390 aa, Myxococcus xanthus DK 1622
MRALCWNGINDLGVETVGDPRIVNPHDVILQVRMSTTCGSDLHFIDGYIPTMRKGDVIGHEFMGTVVEKGPAVKKVQVGDRVVVPSFIGCGSCWYCQHDLWSLCDNTNPKGELQEPLFGYQTAGIYGYTHTFGGYAGAHAQFVRVPHADNDCFRVPEGVTDEQALFLSDAVPTGYMGADFCDIQPGQTVAVWGCGGVGLMAQKAAFLLGAERVIGIDRFPERLKLAREKVGAETISYEEVDSVLDVLKELTGGRGPDACIDAVGMEAHGTGVGAAYDRAKQAMRLQTDRGQALRQAILACRKGGILSVVGVYGFMDAFPLGAIMNKGLTVRSAQQHGQKYLPRLLEHVVKGELDPSFLATHRFSLEDAPKGYELFKKKQDGCVRAVFLPN

SEQ ID NO: 43542 - protein, 192 aa, Glycine max
  misc_feature (110)..(110): Xaa can be any naturally occurring amino acid
  unsure (1)..(192): unsure at all Xaa locations
MTVMMPAPIDQQEDEDVLVPDADLPENNHQPMEVVAQPENANTVESQPVEDPPSSRFTWRIDNFSRLNTKKLYSEIFVVGGYKWRVLIFPKGNNVDYLSMYLDVADSASXPYGWSRYAQFSLAVVNQMHNKYSVRKDTQHQFNARESDWGFTSFMPLGELYDPSRGYLVHDTLIVEAEVLGRRNGDYWTYDS

SEQ ID NO: 43543 - protein, 970 aa, Mesorhizobium loti MAFF303099
MNIKADFPSLVEEIDYGTPESRAQKQVTLNVDGRSITVPEGTSIMRAAMEGGVEIPKLCATDMLDSFGSCRVCLVEIEGRGGTPASCTTPVGEGMVVRTQSDRLDAIRRGVMELYVSDHPTGWNEKAGTGASEFDTVAKSVGLTENRYGVEGRNHVKQEDGVAPGHGSLAVDYIARDESNPYFTYDPAQCIVCSRCVRACEEVQGTFALTIEGRGFESRMVAGMHEDFIASECVSCGACVQACPTDALREKTVLEKGMPERSAVTTCAYCGVGCSFKAEVKDDEVIRMMPYKDGKANHGHSCVKGRFAYGYATHKDRILSPMIREKISDPWREVSWEEAIAHTAKEFRRIQYQYGRTSIGGITSSRCTNEETYLVQKLVRQGFRNNNVDTCARVCHSPTGYGLGQTYGTSAGTQDFDSVEFTDVAVVIGANPVSAHPVFASRLKKRLRQGAKLIVLDPRRTEMVKSAHIEADYHLPLKPGTNVAVLTSLAHVIVTEGLFDEAFIRERCDWTEFQDWASFVALPENSPETVGKLSGVDPDLIRGAARLYAKGGNGAIYYGLGVTEHSQGSTTVMAIANLAMATGNIGRPGVGVNPLRGQNNVQGSCDMGSFPHELPGYRHISGEAVRDIYESLWGVKLDDEPGLRIPNMLDAAVDGSFKGIYIQGEDILQSDPDTKHVAGGLAAMECVVVHDLFLNETANYAHVFLPGSTFLEKDGTFTNAERRINMVRKVLEPKARYADWEATQELARAIGLDWNYTHPSQIMDEIAQTTPSFANVSFELLDRVGSVQWPCNEKAPLGTPIMHIDGFVRGKGKFIRTEYVATDERTGPRFPLLLTTGRILSQYNVGAQTRRTDNVMWHSEDRLEIHPHDAENRGLRDGDWVRLTSRSGETTLRALITDRVSPGVVYTTFHHPDTQANVITTDFSDWATNCPEYKVTAVQVGASNGPSDWQREYDEQARNSRRIASLQAAE

SEQ ID NO: 43544 - protein, 481 aa, Blastopirellula marina DSM 3645
MENRPLDAAAVKATRIAVVGGGISGLAAAHRLRELAPTTEIVLYEAAERLGGVLETRRQDGFLAEQSADTFITNVPWGVDLCRRLGIESELLPTNDALRKAYVVCRGRLIEVPEGFLLMAPGKAWPIVQTPILSWRGKLRLAWEYFVAPRKDPSDESLKAFVVRRLGIEAYERLVQPLIGGIYTADPEKLSVAATMKQFVEMERQHGGLIRGMQQRKAREGNADSGARYSMFVAPRGGMSALVEAIAARLPSESIRLNSPVRSVSRQEDGVWQVATNSECETYDGVVVAAPAPAAAVLLHSQDEPLAAELEQIEYAGCAIVLLGVDRRQIAQPIAGFGFVVPEVEQRRILAASFASYKFAGRAPDESVLIRVFVGGACHPEMNELPDEQLRQIVLEELADLIGLSGELQTFSVRRWSAQMPQYHVGHLERVERIEALAAKHAGLTLAGNAYHGVGVPTCIHCGEQAAERLLEQLALGQVER

SEQ ID NO: 43545 - protein, 127 aa, Ralstonia eutropha JMP134
MNIIEQIEKEEIARLTANKTIPAFAPGDTVIVNVNVVEGNRKRVQAYEGVVIAKRNRGLNSSFIVRKISSGEGVERTFQLYSPLIAGIEVKRRGDVRRAKLYYLRERSGKSARIKEKLVSKAAKAAQ

SEQ ID NO: 43546 - protein, 614 aa, Arabidopsis thaliana
MASLSFTQFLSFPRCNADVPCLLQSHGFVKFRGERWNGKQSFSMAAGRRKLSESAPLEEEGNDGNGAVVGKKPSKSVKRTTKKKVVVKDEPLEEISEFLVDNDDVLDKESIVSALKPKKTRTRKKAAAASSDVEEVKTEKKVRRKRTVKKDKDVEDDLATIMDAEVSDVEEALAVESTDTESEEEEIDLSKHEGEDISHTYGWPPLVCCFGSAQHAFVPSGRPANRLLDYELHERMRDAKWAPEKYIRAPGGCAGGVAIALASLGGKVAFMGKLGADDYGQAMLYYLNVCKVQTRSVKIDGKRVTACSTMKISKRGRLKSTCIKPCAEDSLSKSEINVDVLKEAKMFYFSTHSLLDKKMMSTTIQAIKISKQLGNVIFYDLNLPLPLWHSSEETKSFIQEVWNLADVIEITKQELEFLCGIEPTEEFDTENNDISKFVHYPPETVEQLWHENLKVLFVTNGTSKIHYYTKEHNGAVSGMEDVPITPFTRDMSASGDGIVAGLIRMLTVQPDLMNNKGYLERTARYAIECGIIDQWLLAQTRGYPPKDDMEEEEDDEEEDEVESDPNGIRSITEKEYRTSKPYDEPDGPYVMKPVEEREYKKLELVGSMFEDGSL

SEQ ID NO: 43547 - protein, 427 aa, Bacteroides fragilis YCH46
MTFENLNLIEPILKALRQEGYTSPTPIQEQSIPILLQGKDLLGCAQTGTGKTAAFSIPILQKLYKTDHRKGIKALVLTPTRELAIQIGESFEAYGRYTGLKHAVIFGGVGQKPQTDALRSGIQILVATPGRLLDLISQGFISLSSLDFFVLDEADRMLDMGFIHDIKRILKLLPARRQTLFFSATMPPEIETLANSMLTKPEKVEVTPASSTVDIISQQVYFVEKKEKKDLLIHLLKDTSIESVLIFTRTKYGADKLARVLTKAGIGAEAIHGNKTQNARQRALTNFKNHTLRALIATDIAARGIDVDQLSHVINYELPNVPETYVHRIGRTGRAGHEGVAISFCESEELPYLKDIQKLIGKNIPVVKDHPFVTTEGIKAQEEKQEEIKVKAKANKTYRGSRANGDFWRRKKQKTNQPSSTKQEKRK

SEQ ID NO: 43548 - protein, 365 aa, Clostridium difficile 630
MKVLILTGKFGMGHYSASNSLSEDIKAKFDNSEIIIKDIFEYIMPNYSDKMYKTFSILVNRGSSLYNLFYKCAENGKKDIKFTFSDYFLNKLDTLLHEVQPTVVISTFPFCSQLVSRYKEKYNSNLPLITCITDISSHSEWISKNTDCYLVASKSTKEELVFKGIDESKIKVNGIPVKKEFKRIEHVNHSTKKNILIMGGGLGLLPKSEQFYKELNSLEGVKTTVITGNNKKMYYKLYGRYENIEVVGYTNEVYKYMKDSDLIISKPGGITLFETIYSELPILAFNPFLQQEIDNASFILNNEIGRILGKNKKYYVDEIKDLIYDDATLKEMSSNMKELKKQFDNNTLENILFSLDEQGACRECM

SEQ ID NO: 43549 - protein, 153 aa, Nostoc punctiforme PCC 73102
MQDIGNILDNRVLLVALVACLIAQALKLVIEIVKNRKLNIRVLVTTGGMPSAHSALVTALAAGVGQTLGWASPDFAVAMIFAIIVMYDAAGVRQAAGKQARILNQMIDELFHEKPDFSQDRLKELLGHTPVQVIAGAALGITIYWLARFAYLN

SEQ ID NO: 43550 - protein, 549 aa, Zea mays
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMYAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFNKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGIGREKGVDSLKNYLQVKAVVTPIKNAAWL

SEQ ID NO: 43551 - protein, 591 aa, Brassica napus
MPTWWVRKSSKNKDDSHLLQTQTRSVSDKSIRRISADNSKSSPDPVTPSRCTPRCSREFAGASGFSDEKKCHPLPLPSLSNDQVNGSVSGSGSVSSVSSSGSGEDQSQPTAPRKSNAAAASPKAGARPTSPLHNRFSGMTLESSSTGRNDDGRSSEYHPLPLPPGSPTSPSVVLPCSPTSPSSGVQGSWVVGGSEKEISKWKKGRFIGSGTFGKVYQGFNSEEGRICAIKEVKVISDDKNSKECLKQLNQEINVLSQLCHPNIVQYYGSELSEETLSVYLEFVSGGSIYKLLTEYGAFTEPVIQNYTRQILYGLAYLHGRNTVHRDIKGANILVDPNGEIKLADFGMAKHVTAYSTMLSFTGSPYWMAPEVVMHKNGYTLAVDVWSVGCTILEMATAKPPWSQFEGVAAIFKIGNSKDMPEIPDHLSNDAKNFIRLCLQRNPTVRPTAAQLLEHPFLRVHSPRVANTSMHKDVPPRPYDGSSSMPTREPPYSGRHPVFHPIKSPSRENVRAITSLPVSPCSSPLRQLGPAYKSCFLSPPHPSYAFPVQESGYNHQAEFAASPFRFKKDTSLIEPSSYRAQAPSSPFRSRLV

SEQ ID NO: 43552 - protein, 529 aa, Mycobacterium tuberculosis H37Rv
MGADLKQPQDADSPPKGVSRRRFLTTGAAAVVGTGVGAGGTALLSSHPRGPAVWYQRGRSGAPPVGGLHLQFGRNASTEMVVSWHTTDTVGNPRVMLGTPTSGFGSVVVAETRSYRDAKSNTEVRVNHAHLTNLTPDTDYVYAAVHDGTTPELGTARTAPSGRKPLRFTSFGDQSTPALGRLADGRYVSDNIGSPFAGDITIAIERIAPLFNLINGDLCYANLAQDRIRTWSDWFDNNTRSARYRPWMPAAGNHENEVGNGPIGYDAYQTYFAVPDSGSSPQLRGLWYSFTAGSVRVISLHNDDVCYQDGGNSYVRGYSGGEQRRWLQAELANARRDSEIDWVVVCMHQTAISTADDNNGADLGIRQEWLPLFDQYQVDLVVCGHEHHYERSHPLRGALGTDTRTPIPVDTRSDLIDSTRGTVHLVIGGGGTSKPTNALLFPQPRCQVITGVGDFDPAIRRKPSIFVLEDAPWSAFRDRDNPYGFVAFDVDPGQPGGTTSIKATYYAVTGPFGGLTVIDQFTLTKPRGG

SEQ ID NO: 43553 - protein, 518 aa, Candida glabrata CBS 138
MFAHKFLLVFLVQLLSAVLANKETIGHKYEQVCSGMYSKQDFHGKVDPFISFDLKKFSSNFDDDTIVVVIYDFQDYQHIGVYEGDSPYKTYICDDAAVERGVCEEEHLNEFIIKDTIYDPETGENQSMKNSVMTFSQSTTGLHDTKYSVVKTGFYCVMARPLYYDSENYKSSKYAAEVNFRNSYGQLAGAEINKLPMYGLLAIAYGVAMALYSFAFWKHKHELLPLQKYLLAFFVFLTTENIFVWAYYDIVNQKGITAGTTVYMVFLSIMSAGKATFSFFLLLIVALGYGIVYPKLNKSLMRKCQFYTIFSFALCVAFLIHSYTVDIEDPTPFIMITFIPFLLSMVVFYFLIIRAMSKTTQYLKEQRQVVKLKMYRNLLLVIWCSFIILSAGIVVSSVFYLGMNTIEMIERDWRTRFFFTDFWPSLVYFVVFCAIAFMWRPTDTSYMLAASQQLPTDPENVADFDLGDLQSFEDDNEDLDNNLVDDISIITEEEVPSNFRDANNTNNTNDDSDSTNKP

SEQ ID NO: 43554 - protein, 464 aa, Oryza sativa (japonica cultivar-group)
MDGRKKKGGTPEASDAAAAAPARTLGCGVGSATAALPFSRGGRGVGLAPPPRSLGRGGGPAVAAIPPGGFPSYSASMDGFPFPPPFDGSYRGGFPSSSAWLDASGGDESSPGSCDKDVHPRGGFMSYFGNHAQNSHLVGAPIYIADASSPPEVEILQGNDDGNGNGNVRTEKRILWTEEEDIRLMSAWIEHSTDSTCGADKGGGQYWGEVVESYNKTTPPLRKRNLKQCKDRWHKINRWTDLFECAYVKARRIFTSGYSNQMWIDAAHKFYVDDNKEAKLGPFVLMEVWKICREVSKWKTYNENMRNARKRKSFHLEGDSEEADDTFDEMPKRPMGQKAAKKAALDAKIKSNGLGSSDDGHSKESPIQLDKFDRYSKFQEENNDKRMKLLDRQEKISSEKLEATKIAHLTAQEYKEGRKLEKESKMMETYNSLISQDTSSMSAEEKAQRICQFCKWRLLSLAIW

SEQ ID NO: 43555 - protein, 404 aa, Mycobacterium sp. JLS
MRELPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSMNLIYDEDPDYIVVFGADHVYRMDPEQMVQFHIESGAGATVAGIRVPRAEASAFGVIDADESGRIRSFVEKPADPPGTPDNPDEAFVSMGNYIFTTKVLIDAIRADADDDDSDHDMGGDIIPRLVGDGMAAVYDFSNNEVPGATERDHGYWRDVGTLDAFYDAHMDLVSVHPIFNLYNKRWPIRGESENLAPAKFVNGGSAQESVVGAGSIISAASVRNSVLSSNVYIDDGAIVEGSVIMPGTRIGRGAVVRHAILDKNVVVGPGEMVGVDLEKDRERFSVSAGGVVAVGKGIWI

SEQ ID NO: 43556 - protein, 253 aa, Medicago truncatula
MKGIVTMFKKNYDHLPKDTYFGMYKDSVRGNPNYFLTYGNGKSVARVQDHLRPNGAHRWHNYMKTPNEIKLEEAAVLHYTYAKFSDLTSRRDRCGCKPTKEDVKRCFMLEFDRSAFIIASTATEEEMLKWYNEHVVWGDKEVKIKLLRKGILTRIYTPMVIIQSLRESGVFSSVIASAPSLSKEKFLHSIDSSNSTRAIASLSLPSRKVGRTKESQATARKVLDLESSVFQELAVPPQSPPGVVEDSNLISHS

SEQ ID NO: 43557 - protein, 535 aa, Medicago truncatula
MAVSSFHRVFTFECRSDPDFTSLPSTDNHHHNRRRHFPTTSLSSAAAISSPILRFPPNFQRQLSTKARRNCSNIGVAQIVAASWSNEGTGNPNAGVPTPVPAVASAVDATTAPVPLDLDADVTDGDVVENGAVQTNRSSYSSFLKSDASKTIHAAERLGRAIVTDGITTPVVNTSAYFFKKTADLIDFKEKRQTSYEYGRYGNPTSTVLEEKISELEGAESTILMASGMCASIVLLMALVPAGGHLVTTTDCYRKTRIFIETVLPKMGITTSVVDPADVGALQSALEQNKVSLFFTESPTNPFLRCVDIKLVSELCHKNGALLVIDGTFATPLNQKALALGADLVMHSCTKYIGGHHDVLGGCISGSLKLISEIRILHHILGGALNPNAAYLFIRGMKTLHLRVQQQNSTGMRMAKLLEAHPKVKRVYYPGLPSHPEHELAMRQMTGFGGVVSFEIDGDITTTIKFIDSLKIPYIAASFGGCESIVDQPAILSYWDLPASERAKWKIYDNLVRFSFGIEDFEDLKADVLQALEAI

SEQ ID NO: 43558 - protein, 255 aa, Erwinia carotovora subsp. atroseptica SCRI1043
MRHPLVMGNWKLNGSTNLVNELIAGLRKELSTVDGCGVAIAPPAIYLDQANHQLAGSRIALGAQNVDVNLSGAFTGETSAEMLKDIGAKYIIIGHSERRTYHKESDEFIAKKFGVLKDAGLIPVLCIGETEAENEAGQTEAVCARQLDAVLNTLGAKAFENTVVAYEPVWAIGTGKSATPAQAQAVHKFIRDHIAKQDAAVAEQVIIQYGGSVNAANAAELFTQPDIDGALVGGASLKADAFAVIVKAAADAKRG

SEQ ID NO: 43559 - protein, 899 aa, Schizosaccharomyces pombe
MNCEMVTSPESVNLGDSNRAVSPFCLPDCSENAVAQTRSKTLDNAALDLPYVGNRKKSEQDFFKMLSSRDRDAHSTLRKRSNSLSSFLSTKSTSASENKFHGGLNWLSLKLNLLLRLQGRMNSARTNTSMNPYSCDSNENLSTLSSVNQNFNSRQLLATIVPESIQNGCSLLRITKKKVRQRKVSLDPISGYLMLDKNTGKAYKKLCVDDIKEIRQGRDARNYREQYKISSENEKRWFTIIYCADNKLKAMHMISPTLDAHNQWIMALEGLKTYRLNEFIIGLNLVCHQGEKMIDYSENLNPWEKLEKEQSAQLDLGDVHRMCQMLHLNASMEFLEETFQKADADHSGKLSFEEFQHFVSLLKTRSEIVDIFKEYTSGSDKMSLEQFRHFLSTSQKARLDSDSIRTLYVSFCSNDDSKMGLIEFTSFLLSPHNSPVVPVIQDMSRPLNEYLISSSHNTYLLGKQFGGESSIEGYIRSLQAGCKCIEIDCWDGPNGPVVCHGHTFTSMIKFNDVIDAIRKYAFVVSPYPLFISLEIHCCPDQQRQMVSYMKQAFGDTLVMKPVTANESVLPSPEDLLNKILLKVKCSATPLHQFSTDILKVGITDSSTDTTESSELENSELTGLRKGKRRMKNIIVQELQQLAPYARSLKFRNFSLPESKTYSHIFSFSERTIKKHGKAMVPRLSKHNLRYLCRVYPGPLRVGSTNFNPQVYWRLGVQMVALNWQTYDTGLQINDALFIADPPTGYLLKPPCQRIIGTTVGEEGLPRKIKLTIDVISGQQLRRARELSNSETLSPYVEIQVHSMEESPFRWCSKVVHENGFRPFWGETMVYESIISDDFYSMIRFLVHHRGSNGNDSIFANFTCPIDRLQQGYRHIRLLDMQGENLLFSSLFLKIKKEDI

SEQ ID NO: 43560 - protein, 132 aa, Alteromonadales bacterium TW-7
MSAHASSSNVEFLNTTKVAPNLPFSQIVKAGNTLYMSGQIGINPETDKLAAGGFEGEAKQTLENIKRTLERHNYSMSNIVKCTVMLTNINDFKAFNAIYTQYFSAPYPARSAFAVKALALDSLVEVECIGAI

SEQ ID NO: 43561 - protein, 432 aa, Treponema pallidum subsp. pallidum str. Nichols [sequence omitted]

SEQ ID NO: 43562 - protein, 336 aa, Myxococcus xanthus DK 1622
MATRIAINGFGRIGRCILRAVLSRKEDLEIVAINDLDKPAALAHLFKYDSVHRTWPGEVKATEKGIVVDGKEITVTAEKDPTALPWKSLNVDVVLECTGRFTARDAAEKHLKAGAKKVIISAPAKGPDITIAYGINHNEYDPAKHHVISNASCTTNCLAPIAKVLVDNFGIEKGLMTTVHSYTNDQRILDLTHEDMRRARAAALSMIPTSTGAAKAIGEVIPQLKGKMHGLAVRVPTPNVSLVDLTVNTEKKVTAEAVIEAFRKAAEGPLKGVLEFSDAQTVSVDYNGNPHSAIFDSTNCFVMGDNLLKVMAWYDNEWGFSNRMVDTAKFLVSKGV

SEQ ID NO: 43563 - protein, 953 aa, Oryza sativa (indica cultivar-group)
MARRLRWHDLVGLGLGGMVGAGVFVTTGRATRLYAGPGVVVSYAIAGLCALLSAFCYTEFAVDMPVAGGAFSYLRVTFGELAAFLTGANLIMEYVFSNAAVARSFTAYLGTAVGVDAPSKWRIAVPGLPKGFNEVDLIAVGVILLISVCICYSTKESSVVNMVLTAVHVAFILFIIVMGFWRGDTRNLTRPADPAHNPGGFFPHGAAGVFNGAAMVYLSYIGYDAVSTMAEEVERPSRDIPVGVSGSVMLVTLLYCLMAASMSMLLPYDAIDTEAPFSGAFKGSSGWGWVSNVIGAGASLGILTSLMVAMLGQARYLCVIGRSGVMPAWLAKVHPCTATPVNASAFLGVFTAALALFTELDVLLNLVSIGTLFVFYMVANAVVYRRYVAADDDDADHRRAWPTLVFLAAFSLVALCFTLLWQFAPAGRARTGLLAACGAAAVATVGAFRALVAEARRPELWGVPAMPWVPAASVFLNVFLLGSLDRPSYVRFGFFTAAAVLVYVLYSVHASYDAEEGGGAGAGAAALDGAKVQDEAADFKISYSICFMPNLNCIFDKIYIIYVLSTKESSVVNMVLTVVHVAFILFIIVMGFWRGDTRNLTRPVDLAHNPGGFFPHGAAGVFNGAAMVYLSYIGYDAVSTMAEEVERPSRDIPIGVSGSVVLVTLLYCLMAASMSMLLPYDAIDTEAPFSGAFKGSSGWGWVSNVIGAGASLGILTSLMVAMLGQARYLCVIGRSGVMPAWLAKVHPCTATPVNASAFLGVFTAALALFTELDVLLNLVSIGTLFVFYMVANAVVYRRYVAADDDDADHRRAWPTLVFLAAFSLVALCFTLLWQFAPAGRARTGLLAACGAAAVATVGAFRALVAEARRPELWGVPAMPWVPAASVFLNVFLLGSLDRPSYVRFGFFTAAAVLVYVLYSVHASYDAEEGGGAGAGAAALDGAKVQDEAADFKV

SEQ ID NO: 43564 - protein, 223 aa, Mycobacterium tuberculosis H37Rv
MCHGGTWAGDYVLNVIATGLSLKARGKRRRQRWVDDGRVLALGESRRSSAISVADVVASLTRDVADFPVPGVEFKDLTPLFADRRGLAAVTEALADRASGADLVAGVDARGFLVAAAVATRLEVGVLAVRKGGKLPRPVLSEEYYRAYGAATLEILAEGIEVAGRRVVIIDDVLATGGTIGATRRLLERGGANVAGAAVVVELAGLSGRAALAPLPVHSLSRL

SEQ ID NO: 43565 - protein, 554 aa, Vibrio cholerae O1 biovar eltor str. N16961
MCSIFGILDIKTDAATLRPIALEMSKKLRHRGPDWSGIYASDKAILAHERLAIVGLNSGAQPLYSPDRKLILAVNGEIYNHKEIRERYKGQYEFQTDSDCEVILALYRDKGADLLEELNGIFAFVLYDEEKDEYLIGRDHIGIIPLYQGHDEHGNFYVASEMKALVPVCKTLSEFPPGSYLSSKDQAVTRYYVRDWNSFDEVKDNVSSKEELTQALEAAVKRQLMTDVPYGVLLSGGLDSSITSAIAKRFAAMRIEDDEKSAAWWPQLHSFAIGLEGAPDLKAAREVAEKIGTVHHEMTYTIQEGLDAIRDVIYHIETYDVTTIRASTPMFLMGRKIKAMGIKMVLSGEGADEIFGGYLYFHKAPNAKEFHEETVRKLLALNLFDCARANKSLAAWGVEGRVPFLDKEFIDVAMRLNPADKMCGNGKMEKHILRECFEHYLPESIAWRQKEQFSDGVGYGWIDTLKATAEAKISDQQMETAKFRFPYNTPTTKEGYVYREIFEELFPLESAARCVPGGPSVACSSAKAIEWDESFKNCIDPSGRAVKAVHKQAY

SEQ ID NO: 43566 - protein, 449 aa, Mycobacterium tuberculosis H37Rv
MASLQQSRRLVTEIPGPASQALTHRRAAAVSSGVGVTLPVFVARAGGGIVEDVDGNRLIDLGSGIAVTTIGNSSPRVVDAVRTQVAEFTHTCFMVTPYEGYVAVAEQLNRITPGSGPKRSVLFNSGAEAVENAVKIARSYTGKPAVVAFDHAYHGRTNLTMALTAKSMPYKSGFGPFAPEIYRAPLSYPYRDGLLDKQLATNGELAAARAIGVIDKQVGANNLAALVIEPIQGEGGFIVPAEGFLPALLDWCRKNHVVFIADEVQTGFARTGAMFACEHEGPDGLEPDLICTAKGIADGLPLSAVTGRAEIMNAPHVGGLGGTFGGNPVACAAALATIATIESDGLIERARQIERLVTDRLTTLQAVDDRIGDVRGRGAMIAVELVKSGTTEPDAGLTERLATAAHAAGVIILTCGMFGNIIRLLPPLTIGDELLSEGLDIVCAILADL

SEQ ID NO: 43567 - protein, 342 aa, Blastopirellula marina DSM 3645
MNLLTIETTCDETAAAIINEDLEPLASVVASQEKLHQRFHGVVPEIAARAHLERIMPVIDETLAQANLTLADINAVAVAHTPGLAGSLLVGVSVAKTLAWSLGVPLVGVNHLHGHIYACRLAAGRDIFPCVGLIVSGGHSSLYDCLGPSDFVPLGGTIDDAAGEAFDKVASMLGLPYPGGPSISRCAADGNPQAIPFPRPFLQDSSRLDFSFSGLKTAVRYEIAGPGRPDFSAIEISAQRRADIAASFEQAVVDCLVGKAELAIRKAGRTRLCVGGGVAANRRLRDALQEMADRNQIELIIAPFALCTDNAVMGAIAWEKIKAGSYDELSLDAAPGLIRERV

SEQ ID NO: 43568 - protein, 429 aa, Pseudomonas fluorescens PfO-1
MADKKAQLIIEGAAPVELPILTGTVGPDVIDVRGLTATGRFTFDPGFMSTASCESKITYIDGDNGILLHRGYPIEQLAEKSDYLETCYLLLNGELPTAEQKAQFVGTVKNHTMVHEQLKTFFNGFRRDAHPMAVMCGVVGALSAFYHDSLDINNPQHREISAIRLVAKMPTLAAMVYKYSMGQPMMYPRNDLSYAENFLHMMFNTPCEIKPISPVLAKAMDRIFILHADHEQNASTSTVRLAGSSGANPFACIAAGIAALWGPAHGGANEAVLTMLDEIGDVSNIDKFIAKAKDKNDPFKLMGFGHRVYKNRDPRATVMKQTCDEVLKELGIQNDPQLELAMRLEEIALTDPYFIERSLYPNVDFYSGIILKAIGIPTSMFTVIFALARTVGWISHWKEMLSSPYKIGRPRQLYTGYESRDITKLEDRK

SEQ ID NO: 43569 - protein, 129 aa, Arabidopsis thaliana
MEKVSIVCFFFFLLFGSGYGGLPPFWRATVVTMTNLIGGPPLTIHCKSKQDDLGIHVVPFKQEYHFKFQPNLWKSTLFFCSFQWDSQFKSFDIYDAQRDQGICDDCQWEIKPDGPCRLGKKAKCFPWKG

SEQ ID NO: 43570 - protein, 221 aa, Brassica napus
MAGIDTQKQLLSLIRDFTSERSRGEQRVVGLKKRIESLQSEVEAANEEVEKAKRIKEVAEEELNGYEVESSLNDATIQSLEARIALLQDEVSTVGNEVDALKNKEGLLRDQFISQMVELNKEIRVFQRTVASSVGNDDSTSITANVEVFEDGHGADSQAIKDMLSDVNSQLAKEEEGYLAEQNIKEQLQKELDEYEKKMSLMEAITEKTNSVHALAEQSSE

SEQ ID NO: 43571 - protein, 170 aa, Clostridium difficile 630
MDLKNFIRNIDDFPKPGIDFKDVTTLFKDGDAFKYAVDSIVEELKDKDVDLVIGPEARGFLMGTPVAYALGVGFVPIRKPGKLPGEVESYEYGLEYGTDTLEIHKDAIKKGQKVAIVDDLLATGGTMEAAAKLVEKLGGEVVSMQFLIELKFLNGREKLSNYDVNSLIKY

SEQ ID NO: 43572 - protein, 444 aa, Triticum aestivum
MDPQTFVRLSVGQLGLRLPGASARKAFHCEIRLRGFPVQLAPVPLENSSEFHLDPHANAAVFSLDEPGLKALPTSRWFRTPEPPYLEIAVYVSRRDGGGHCVGLKRRLVGAVRVDVGPEWRDGKPVLLRHSWTGIGRAAELHVRVRVEADPRYVFRFEDEVALNPQVVQLHGGASQPIFSCKFIRDVRRASQPDHLGGKYWSSSGSGEEKETEMAGRRRERKGWKVAIHDLSGSAVAAAFMATPFVPATGSDTVARSNPGAWLIVRADTTGSSESWQPWGRLEAWRECAAPAGGKDAVCLRLHLLPERRDACVLVSETPLSCDKGGEFSIDMDRQSILPEDAVASETPSASSYCAASMGESCAGGGFVMSCSVQGEAATSSRPPLVHLAARHVMCMEDAAMFLALAAAVDLSVKACRPFRSKTAAAKKKTAAGSSSPDSLELDT

SEQ ID NO: 43573 - protein, 262 aa, Azoarcus sp. EbN1
MCLIVVGWQAHPDYPLVVAANRDEFLARPAVPAHWWTDAPDLLAGRDLEGGGTWMGITRGGRFAALTNYRDPTLHRPGAPSRGIVVRDCLAPADNANTQATLGRIAAVSPDYAAFNLLVSDGADLGIHESTTGAVRLLDAGIYGLSNHLLDTPWPKVRLARERFGAALARLPEDEEDAFLPLLRDDAAAPDSHLPETGVSADWERWLSSAFIRAPGYGTRCSTVITVRRDGDVKFVEWTWDDQGELASEVRHRFTARTPVAR

SEQ ID NO: 43574 - protein, 297 aa, Streptococcus pneumoniae R6
MMRIKQMTENRYELNKNLAQMLKGGVIMDVQNPEQARIAEAAGAAAVMALERIPADIRAAGGVSRMSDPKMIKEIQEAVSIPVMAKVRIGHFVEAQILEAIEIDYIDESEVLSPADDRFHVDKKEFQVPFVCGAKDLGEALRRIAEGASMIRTKGEPGTGDIVQAVRHMRMMNQEIRRIQNLREDELYVAAKDLQVPVELVQYVHEHGKLPVVNFAAGGVATPADAALMMQLGAEGVFVGSGIFKSGDPVKRASAIVKAVTNFRNPQILAQISEDLGEAMVGINENEIQILMAERGK

SEQ ID NO: 43575 - protein, 352 aa, Spinacia oleracea
MTATIAPSRVESLASSGIESIPKEYVRLNEELTSMGNVFEEEKKDDGYQIPTIDIKDIASKDQEVRDKAIQELKRAAMEWGVMHLVNYGISDELIHRVKVAGETFFELPVEEKEKYANDQASGNLQGYGSKLANSASGRLEWEDYYFHLCFPEDKRDFSIWPKTPADYIPAVSEYSKELRSLATKILSALSLALGLEEGRLEKEVGGIEELLLQFKINYYPKCPQPELALGVEAHTDVSALTFILHNMVPGLQLFYEGKWVTAKCVPNSIIMHIGDTIEILSNGKYKSILHRGLVNKEKVRISWAVFCEPPKEKIVLMPLPDLVSGEEVARYPPRTFAQHVQYKLFRKTQDP

SEQ ID NO: 43576 - protein, 740 aa, Ustilago maydis 521
MAQPAVRQPTVTRSRISRPGGIPASRSGDRIHLTEAASTSHLAKAKSTKLVGPSTAGKLRADSRSMPQRAALSDVSNRAGVARANALADGAVKLAPGHNGLRSQHTKSMTRLRDARSRSTSEQRLSGPTRSVSEQRDCAPAAAESMHVEASQLLPPFQSSASVKVGISDEAGSSRLHEDADIRDLAGSQHSDHVEEDEMSDVASTSSSDDDTAEDIGVDKANWLDSERLDAEGLVSLHPELEEAARRKVALIKSRYQEEVIQPRAARAQAQHAEAVAAGQLSAELAAHEDELIVMGLDPEEVRDTSMVAEYSNEIFSYMARCERETMANPNYMEFQSEIHWHMRATLVDWLLQVHMRYHMLPETLWIAINVVDRFLSVRVVSLAKLQLVGVTAMFIAAKYEEILAPSVKEFVYMTEGGYSQEEILKGERIILSTLDFNISSYCSPYSWVRKISKADDYDIRTRTLSKFLMELALLDHRFLRARPSLVAAVGMFLAKKMLGGEWDDAFVYYSDFTEEQLVPGANLLLERLLDQGFEEQFVYRKYSNKKFLRASVFARDWAFQNHSALLAAAAAAAGSTQAVHSCLVTTTVQHRFREQRTYVQRRRAGASVWRDERKDPRGSTFGSGCGEWKDKDRIEADVKREASRMKLVHAVSDMAKLYLHTHPHHCSHKRVHAWYESVSVMCIHDFRSAQLAWLRLEPVIARCEAQAIHDRACSQSLWPTQRSCLTRNGTHDEKLSCNS

SEQ ID NO: 43577 - protein, 358 aa, Phytolacca americana
MVGEISPSRVETLATSGIQSIPKEYVRPKEELTSIGNVFEEEMKDGGPQVPTIDIRDIASDDREVRDRAILELNRAAMEWGVMHLINHGIPNELIDRVKAVGGAFFELPIEEKEKYANDQATGNVQGYGSKLAENASGQLEWEDYFFHLIFPEDKRDLSIWPTTPSDYICAVSEYAKELRALATKILSALSLALGLEEPRLEKEVGGLEELLLQLKINYYPKCPQPELALGVEAHTDVSALTFILHNMVPGLQLFYEGKWVTAKCVPNSIIMHIGDTIEILSNGKYKSILHRGLVNKEKVRISWAVFCEPPKEKIILKPLTELLTEEEPARFPPRTFAQHIQYKLFRKTQDVQAPVSN

SEQ ID NO: 43578 - protein, 658 aa, Candida glabrata CBS 138
MFLFRKPSIRSCQRINSLCSLLELQRGYATTTRENTLYPPHADTSSPHKTPVGEAAKEYLKQKKRKLQEKGTPKSTRLTVEGVIECPLESFQLLNSPLFNKGSAFTQEEREAFNLEALLPPQVNTLDEQLERAYKQLCYLKTPLAKNDFMTSLRVQNKVLYFALVRKHIRELVPIIYTPTEGDAIASYSHRFRKPEGVFLDITEPNSVEKRLAVYGEAKDVDYIVVSDSEGILGIGDQGVGGVRIAISKLALMTLCGGIHPGRVLPVCLDVGTNNKKLARDELYMGNKFSRIRGKQYDDFIDSFIQAVKKLYPSAVLHFEDFGVKNARRILDKYRYDLPCFNDDIQGTGAVVTASLLAALKHTDRELKDTKVLVFGAGSAGLGIADQITNHMVTHGLTPEEARSNIYLMDRRGLILESMEENSTVAQHRYAKPDEDWDDIDTTKLFNVVSKMKPTCLVGCSTQAGAFTKEIVQEMYKYNPRPIIFPLSNPTRLHEAVPSDLMEWTNNDALVATGSPFAPVNGYRISENNNCFSFPGIGLGAVLSRATAITDTMISAAVDQLAALSPLKPGDSRPGLLPPLEDITNTSAKLATAVILQSLKEGTARIEDEEVPGSPGEKVTVPRDFDQCLEWVKSQMWEPVYRPMVKVNYDPEVHTNQM

SEQ ID NO: 43579 - protein, 712 aa, Caulobacter crescentus CB15
MSLWLYLAIGAGLLAVLYGAVQTASLMRASAGNARMQEIAAAIQEGAQAYLKRQYTTISIVGVVVIAALAFFFKSWEQPVGFALGAILSGAAGFAGMLISVRANVRTAQASSESLAKGLSMAFTSGAVTGMLVAGFALLGVAGYYYVLLATGHEATGRVVIDSLVALGFGASLISIFARLGGGIFTKGADVGGDLVGKVEAGIPEDDPRNAATIADNVGDNVGDCAGMAADLFETYAVTTVATMVLAAIFFRGTEAVSAMMLLPLAICAVCIVTSIIGAFFVRLGKSQNIMGALYQGLIVTGVLSIPAVWYVIHQLVPTAVEVDGRSYGADALFYCGLAGLVVTAAIVMITEYYTGTGFRPVKSVAQASVSGHGTNVIQGLAMSLESTALPALTIIVGIVVTYNLAGLFGIAIATTTMLSLAGFIVALDAFGPVTDNAGGIAEMAGLPPEVRVTTDALDAVGNTTKAVTKGYAIGSAGLGALVLFAAYTEDLKFFSENAAPGSFFHGMGAVTFDLSNPYVVVGLLFGGLLPFLFGGLSMTAVGRAAESVVAEVRRQFRDNPGIMTGEVKPEYGKAVDILTKAAIREMIVPSLLPVVSPVALFFVIQAIAGKVDAFAALGAMLMGVIVTGLFVAISMTSGGGAWDNAKKVIEEGFTDKNGVLHKKGGETHKAAVTGDTVGDPYKDTSGPAVNPMIKITNIVALLLLAVLAHGV

SEQ ID NO: 43580 - protein, 345 aa, Medicago truncatula
MVVPSPTSMIRTKKTKAVGIPTIDLSMERSELSELVVKACEEYGFFKVVNHGIPKEVISRLENEGTEFFSKNSTEKLQAGTSTPFGYGCKNIGPNGDKGDLEYLLLHTNPNSISERSKTIAKDHPIKFSCIVTDYIEAVKELACEILELAAEGLWVPDKSSLSKVIKDVHSDSVLRINHYPPVKKLSKDNLDPSKFQNNNNTIGFGEHSDPQILTILRSNNVGGLQISTQHGLWIPVHPDPNEFYVMVGDSLQVLTNGRFVSVRHRVLTNTTKPRMSMMYFAAPPLNWWISPLSKMVTAHNPSLYKPFTWAQYKQAAYALRLGDSRLDQFKLQKQEDNTHYHHDT

SEQ ID NO: 43581 - protein, 407 aa, Pseudomonas fluorescens PfO-1
MAIEIKAPTFPESVADGTVATWHKQPGDAVKRDELIVDIETDKVVLEVLATADGVLGAIVKGEGETVLSDEVLGSIVEGGAASAAPAAAAAPAAAAAAPAAADGEDDPIAAPAARKLAEENGINIASVAGTGKGGRVTKEDVVAAVAAKKAAPAAAPAKAAAPAAAAPVFAAGDRIEKRVPMTRVRATVAKRLVEAQSNMAMLTTFNEVDMTEVMALRSKYKDLFEKSHNGVRLGFMSFFVKAATEALKRFPAVNASIDGNDIVYHGYADIGVAVSSDRGLVVPVLRNAEHMSLAEIEGGIATFGKKARDGKLSMDEMTGGTFTITNGGTFGSMMSTPIVNPPQAAILGMHNIIQRPMAINGQVVIRPMMYLALSYDHRLIDGKEAVTFLVTIKNLLEDPARLLLDI

SEQ ID NO: 43582 - protein, 478 aa, Pseudomonas fluorescens PfO-1
MSQKFDVVVIGAGPGGYVAAIKAAQLGLSTACIEKYTDAEGKQALGGTCLNVGCIPSKALLDSSWKYKEAKESFNVHGISTGEVKMDVAAMVGRKAGIVKNLTGGVATLFKANGVTSIQGHGKLLAGKKVEVTKPDGSVEVIEAENVILAPGSRPIDIPPAPVDQKVIVDSTGALEFQSVPKRLGVIGAGVIGLELGSVWSRLGAEVTVLEALDTFLMAADTAVSKEALKTLTKQGLDIKLGARVTGSKVNGDEVVVNYTDANGEQTITFDKLIVAVGRRPVTTDLLAADSGVTLDERGFVHVDDHCATTVPGVYAIGDVVRGMMLAHKASEEGIMVVERIKGHKAQMNYDLIPSVIYTHPEIAWVGKTEQALKAEGVEVNVGTFPFAASGRAMAANDTGGFVKVIADAKTDRVLGVHVIGPSAAELVQQGAIGMEFGTSAEDLGMMVFSHPTLSEALHEAALAVNGGAIHIANRKKR

SEQ ID NO: 43583 - protein, 420 aa, Dechloromonas aromatica RCB
MKARFTPALFAHAEAVLGQLLRFDHPADAVVSRYFRDHRELGHADRAFVAETVFAVLRRGRSLEARCGGQMSDRHRLLAALAVARGWSQRELAPVLKASEEEWLSGVKAVREEDLPPAVRCDLPDWLYQRLEAQFGAEETLLLSKALNQPAPLDLRVNTLKMNREVLLEKLAADGIAAEAAPLSPMAVRLRDKPALAKTALFLEGAYEVQDEGSQLLGYLMEPKRGEMVVDFCAGAGGKTLLLGALMRNTGRLYAFDVSDKRLANLKPRLARSGLSNVHPARIEHERDTKIKRLAGKADRVLVDAPCSGLGTLRRNPDLKWRQSETSVAELTVKQASILEAAAKLVRPGGRLVYATCSLLSAENDEIIAAFLEKHPDFTLTPASAVLAKQDIAYEGDVLRLLPHKHNTDGFFAAILDKKA

SEQ ID NO: 43584 - protein, 502 aa, Zea mays
MATANGSSKGPFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 43585 - protein, 503 aa, Zea mays
MATANGSSKGSFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDNKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 43586 - protein, 570 aa, Clostridium difficile 630
MAYKGIGASPGVALGKALVVEHSELVIEKKSIDNVEAEIAKLEDAVAVSKEELVKVKEKASEELGAEEAEIFEAHLLVLEDPELIGSAIDKIKTESVNAEYALNEIKEMFVSMFESMDNEYMKERAADIKDVTNRILRHILGIKVVDLSALSEEVVLIAHDLTPSDTATMNKKMVLGFLTDIGGRTSHTAIMSRTLEIAAIVGLNDITSKVKDGDFVVFNGDTGEVIVNPDEETINKYTELKAKYEDERKALQLLKGKPSVTLDGKHVELAGNIGTPNDIEGLIKNDAEGVGLYRTEFLYMDRDSFPTEEIQYEAYKAVLEGMDGKPIVIRTLDIGGDKELSYLSMEPEMNPFLGYRAIRLCLDRKDIFKTQLRALYRASVHGRLRIMFPMISSLEELLQAKEVVKEVLAELDSEGVAYAKDVEIGMMIEVPSAAVISDVLAKHVDFFSIGTNDLIQYTCAVDRMNQKISYLYNQFNPAVLRLIKTVIDNAHKEGKWAGMCGESAGDQKMIPILLGMGLDEFSMSPISILPARKLITSVKESDMKKLADDVLNMGTAEEIKSYIEKTFNI

SEQ ID NO: 43587 - protein, 466 aa, Zea mays
KTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 43588 - protein, 511 aa, Zea mays
MASNGCNGNGNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 43589 - protein, 166 aa, Arabidopsis thaliana
  misc_feature (28)..(28): Xaa can be any naturally occurring amino acid
  misc_feature (66)..(66): Xaa can be any naturally occurring amino acid
  misc_feature (113)..(113): Xaa can be any naturally occurring amino acid
  misc_feature (132)..(132): Xaa can be any naturally occurring amino acid
  misc_feature (161)..(161): Xaa can be any naturally occurring amino acid
  unsure (1)..(166): unsure at all Xaa locations
KFGGSVSPEIKLLETLQVLFKNKGRDLXKNLNRPSRFLKRHPLPVPCIPLGVWAESSHETVLEVHXQFDEISSKSLRDAGAYDLIWQECAQFSRVRSVGVQRVKRTHCQLVLXRAVRTQDGMLQLVHFEHKXMDDVSAKICNSVQGVHRVVIDNTSNPPSXTIEWE

SEQ ID NO: 43590 - protein, 447 aa, Azoarcus sp. EbN1
MRYKSLEEFLSHVEQRNPGQPEFIQAVAEVMESLVPFITEYPRYAEHGLLDRLIEPERAIQFRVSWVDDRGEVQVNRGYRIQHSSAIGPFKGGLRFHPSVNLSVLKFLAFEQTFKNALTTLPMGGGKGGSDFDPKGRSPGEVMRFCQSFMTELYRHVGSDTDVPAGDIGVGGREIGFLAGMMKKLSNKASCVFTGKGLSFGGSLIRPEATGYGMVYFAEEMLRHVGKTMAGMTVSVSGSGNVAQYGIEKAMALGAKVITASDSSGTVIDEAGFTPEKLAVLMDVKNVHYGRVSEYAERLGLHFEPGRRPWHVPVDIAFPCATQNELDGDDAAVLVRNGVSCVAEGANMPSNAAAVRVFEKNGVLYAPGKASNAGGVATSGLEMSQNAMRLSWTREEVDGRLLEIMQGIHHMCLQYGTKPDGSVNYSDGANVAGFVKVADAMLSQGVI

SEQ ID NO: 43591 - protein, 534 aa, Arabidopsis thaliana
MASRRVSSLLSRSFMSSSRSIFSLRGMNRGAQRYSNLAAAVENTITPPVKVEHTQLLIGGRFVDAVSGKTFPTLDPRNGEVIAQVSEGDAEDVNRAVAAARKAFDEGPWPKMTAYERSKILFRFADLIEKHNDEIAALETWDNGKPYEQSAQIEVPMLARVFRYYAGWADKIHGMTMPGDGPHHVQTLHEPIGVAGQIIPWNFPLLMLSWKLGPALACGNTVVLKTAEQTPLSALLVGKLLHEAGLPDGVVNIVSGFGATAGAAIASHMDVDKVAFTGSTDVGKIILELASKSNLKAVTLELEESHHSFVCEDADVDQAVELAHFALFFNQGQCCCAGSRTFVHERVYDEFVEKAKARALKRNVGDPFKSGIEQGPQVDSEQFNKILKYIKHGVEAGATLQAGGDRLGSKGYYIQPTVFSDVKDDMLIATDEIFGPVQTILKFKDLDEVIARANNSRYGLAAGVFTQNLDTAHRLMRALRVGTVWINCFDVLDASIPFGGYKMSGIGREKGIYSLNNYLQVKAVVTSLKNPAWL

SEQ ID NO: 43592 - protein, 160 aa, Brassica napus
GKTEAKLNYNRIWATEHVVRPRVRGDIWAWLISFFFLIALVGIIVYQLVCLADLEFDYINPYDSAARINYVVLPEFIVQGVLCVFYLFTGHWFMAILCLPYMYYNFQLYSKRQHLVDVTEIFNLLNWEKKKRLFKLAYIILNLFLTIFWMIYSALDDYED

SEQ ID NO: 43593 - protein, 173 aa, Coccidioides immitis RS
MEYWVLRRSICQGDMFKRVLAPQRLSQRLLLTTPLRHQTVPRTFHSSIDPQSRRTMAEMSKVFTTEACPPIKANGQIFVSGQIPFDSSAKHVGGTIAEQTEQCCKNVAAVLAAAGSSLDKVVKVNVFLVDMGDFKEMNGVFEKYFAHKPARSCVAVRELPAKVPVEIECIALA

SEQ ID NO: 43594 - protein, 135 aa, Triticum aestivum
  misc_feature (51)..(51): Xaa can be any naturally occurring amino acid
  misc_feature (70)..(70): Xaa can be any naturally occurring amino acid
  misc_feature (103)..(103): Xaa can be any naturally occurring amino acid
  misc_feature (123)..(123): Xaa can be any naturally occurring amino acid
  unsure (1)..(135): unsure at all Xaa locations
MAPTVMASSATSVAPFQGLKSTAGLPVSRRSNGASLGSVSNGGRIRCMQVXWPSEGIKNSETLSYLPPLXSTGGLPLSKSDYLDSVPSWVLSSEFKKVGFIFXVEHNASPWGTTMARYWACWXLPISGCTDARST

SEQ ID NO: 43595 - protein, 299 aa, Mycobacterium tuberculosis H37Rv
MDPAGNPATGTARVKRGMAEMLKGGVIMDVVTPEQARIAEGAGAVAVMALERVPADIRAQGGVSRMSDPDMIEGIIAAVTIPVMAKVRIGHFVEAQILQTLGVDYIDESEVLTPADYAHHIDKWNFTVPFVCGATNLGEALRRISEGAAMIRSKGEAGTGDVSNATTHMRAIGGEIRRLTSMSEDELFVAAKELQAPYELVAEVARAGKLPVTLFTAGGIATPADAAMMMQLGAEGVFVGSGIFKSGAPEHRAAAIVKATTFFDDPDVLAKVSRGLGEAMVGINVDEIAVGHRLAQRGW

SEQ ID NO: 43596 - protein, 475 aa, Rhodopirellula baltica SH 1
MHAPVVVLGGGPGGYAAAFLAADEGMEVTIVEAEPRLGGTCLIRGCIPSKALLHVAKVISEVEELKSEWGIEYSGEPKIDVDVVRARKDKVIDNLTGGLGGLAKRRNVTVIQARGSFVSSNELKLEGDHESIPEGGKLTFDKCIVATGSIPAMPPAFDIGSDRVMDSTGALALKDIPETLLVVGGGYIGLEMGTVYAHLGSKVSVVELGEGLLPGADRDLVKPLAKKIDKMCDGRVFLNTKVGSLAEDGDKVVVSFEGPSKFGTESYDRVLISIGRRPVTRGLGLENTKVEVNERGFIVCDEQQRTADPNILAIGDVAGDPMLAHKATHEGRVAAEVLAGKNVAFDKAAIPAVVFTDPEIAWAGLTEGEAKAAGRKVDVEVYPWAASGRAQAIGVTNGLTKWLVDPETHRVLGCGIVGTGAGELIAEAVLAIEMGCEVTDITESVHPHPTLSETLMNAGEVHFGTATEIYKPKRK

SEQ ID NO: 43597 - protein, 837 aa, Xanthomonas campestris
MSSPSIAPVTPDLVRLRATARDKDDAIAQAAQLLVAAGCVAPGYDASMRRREGLANTFLGHGLAIPHGVGEDRHLVRRDGIAVLQLPEGVEWNPGQTTRLVVGIAAQSDTHITLVRRLTRLIQDPAQLEALFTTDDPAVIVAALTGDRAPDTSAAPATDLAERFEWTIAYPSGLHARPATRWAETARGFSARAQVRAGDQAADAKSLVGLLQLGLRAGDSITVSAKGSDAPALLKRLRAVMDSLTAQEKADAERAAQRRAAPVIGWTPPQAQPAIVGIGASPGVAIGIVHRLRAAQTEVADQPIGLGDGGVLLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDAAAAGAGLTDLPEQPCILLAGDLSPSDTANLDTDCVLGLATAQGGPTSHTAILSRTLGLPALVAAGGQLLDIEDGVTAIIDGSSGRLYINPSEQDLDAARTHIAEQQAIREREAAQRALPAETTDGHHIDIGANVNLPEQVAMALTQGANVGLMRTEFLFLERGSTPTEDEQYHTYLAMAQALNGRPLIVRALDIGGDKQVAHLESPHEENPFLGVRGARLSSRRPDLLEPQSRALYRAAKDGARLSIMFPMITSVPELISLREICAAIRAELHAPELPIGIMIEVPAAAAQADVLARHADFFSIGTNDLTQYVLAIDRQNPELAAEASSLHPAVLRMIRSTIDGARKHDRWVGVCGGLAGDPFGASLLAGLGVQELSMTPNDIPAVKARLRGRALSALQQLAEQALHCETAEQVRALEAQREGQA

SEQ ID NO: 43598 - protein, 416 aa, Arabidopsis thaliana
MEATKRERRREDDDGEKASPESLVLPPEIITEILLRLPAKSIGRFRCVSKLFCTLSSDPGFAKIHLDLILRNESVRSLHRKLIVSSHNLYSLDFNSIGDGIRDLAAVEHNYPLKDDPSIFSEMIRNYVGDHLYDDRRVMLKLNAKSYRRNWVEIVGSSNGLVCISPGEGAVFLYNPTTGDSKRLPENFRPKSVEYERDNFQTYGFGFDGLTDDYKLVKLVATSEDILDASVYSLKADSWRRICNLNYEHNDGSYTSGVHFNGAIHWVFTESRHNQRVVVAFDIQTEEFREMPVPDEAEDCSHRFSNFVVGSLNGRLCVVNSCYDVHDDIWVMSEYGEAKSWSRIRINLLYRSMKPLCSTKNDEEVLLELDGDLVLYNFETNASSNLGICGVKLSDGFEANTYVESLISPNSYGIES

SEQ ID NO: 43599 - protein, 324 aa, Pseudomonas putida GB-1
MSQSSELIQSAQRTLRLELEAVEALLARIDDNFVKACELILASKGRVVVVGMGKSGHIGNKIAATLASTGTPAFFVHPAEASHGDMGMITRDDVILALSNSGSTAEIVTLLPLIKRLGIKLISLTGNPDSPLAQAAEVNLDARVEQEACPLNLAPTSSTTASLVLGDALAIALLEARGFTAEDFAFSHPGGALGRRLLLKVENVMHSGDELPQVPRGTLLKDALLEMSRKGLGMTVIVEPDGKLAGIFTDGDLRRSLDRNIDVHTTLIDQVMTVHGKTARAEMLAAEALKIMEDHKIGALVVVDREDRPTGALNMHDLLRAGVM

SEQ ID NO: 43600 - protein, 229 aa, Brassica napus
  misc_feature (129)..(129): Xaa can be any naturally occurring amino acid
  unsure (1)..(229): unsure at all Xaa locations
MDHREGAAAEKQIVSVAEAAAKIDPCHLMDHLVKALREVWRPKERLSRYTDYFAEALSGVSFPWVKMFKDAPLSTLIDVPLSHIPQSVYRTALNWLALPPVKLEDFSAFVLRAFDQILVDLEAQQGGGXDSKSQVGMFVALAIVLRSKPQALTTVLPILRENPKYQGHDKLPVTVWMMAQASPGDLCLGLYSWAHNLLPLVSVSSKKRCCIPQSMDLVLQFVEENLSRQ

SEQ ID NO: 43601 - protein, 550 aa, Zea mays
MAATVRRAASSVLSRFLLTKPSPSPASAAGNNSALLGSGAAALHRFSTAPASAAAAAEEPIQPAVEVKHTQLLINGNFVDAASGKTFPTLDPRTGEVIARVAEGDSEDIDRAVAAARRAFDEGPWPRMTAYDRCRVLLRFADLIERHAEEVAALETWDNGKTLAQAAGAEVPMVARCVRYYAGWADKIHGLVAPADGAHHVQVLHEPVGVAGQIIPWNFPLLMFAWKVGPALACGNTVVLKTAEQTPLSALYVANLLHEAGLPEGVLNVVSGFGPTAGAALSSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRVGDRGFYIQPTVFADAKDEMKIAREEIFGPVQTILKFSGVEEVIRRANATPYGLAAGVFTRSLDAANTLSRALRAGTVWVNCYDVFDATIPFGGYKMSGVGREKGIYALRNYLQTKAVVTPIKNPAWL

SEQ ID NO: 43602 - protein, 446 aa, Triticum aestivum
  misc_feature (180)..(180): Xaa can be any naturally occurring amino acid
  misc_feature (332)..(332): Xaa can be any naturally occurring amino acid
  misc_feature (383)..(383): Xaa can be any naturally occurring amino acid
  unsure (1)..(446): unsure at all Xaa locations
MAAHAALAATRIPTSARLHSKAASRQRVDFADFSGLRPGSCSVSAAAREASFSDVLGAQLVARASGENTVRAPAEAKLKVAINGFGRIGRNFLRCWHGRENSPLEVIVINDSGGVRNASHLLKYDSMLGTFKADVKIVDNETISVDGKNIQVVSNRDPLKLPWAELGIDIVIEGTGVFVXDGPGAGKHLQAGAQEGHHHPLRAKGADIPTYVVGVNEGDYDHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINTVKXGITADDVNAAFRKAADGPLKGILDVCDEPLVSVDFRCSDVSTSIDASLTMXMGDDMVKVVAWYDNEWGYSQRVVDLAHLVAAKWPGAGTGGSGDPLEDYCKTDPNAVECKVFDE

SEQ ID NO: 43603 - protein, 321 aa, Shigella flexneri 2a str. 301
MTKYALVGDVGGTNARLALCDIASGEISQAKTYSGLDYPSLEAVIRVYLEEHKVEVKDGCIAIACPITGDWVAMTNHTWAFSIAEMKKNLGFSHLEIINDFTAVSMAIPMLKKEHLIQFGGAEPVEGKPIAVYGAGTGLGVAHLVHVDKRWVSLPGEGGHVDFAPNSEEEAIILEILRAEIGHVSAERVLSGPGLVNLYRAIVKADNRLPENLKPKDITERALADSCTDCRRALSLFCVIMGRFGGNLALNLGTFGGVFIAGGIVPRFLEFFKASGFRAAFEDKGRFKEYVHDIPVYLIVHDYPGLLGSGAHLRQTLGHIL

SEQ ID NO: 43604 - protein, 412 aa, Shigella flexneri 2a str. 301
MTNYRVESSSGRAARKMRLALMGPAFIAAIGYIDPGNYATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELIFSQPNLAQLGKGMVIPSLPTSEAVFLAAGVLGATIMPHVIYLHSSLTQHLHGGSRQQRYSATKWDVAIAMTIAGFVNLVMMATAAAAFHFSGHTGVADLDEAYLTLQPLLSHAAATVFGLSLVAAGLSSTVVGTLAGQVVMQGFIRFHIPLWVRRTVTMLPSFIVILMGLDPTRILVMSQVLLSFGIALALVPLLIFTSDSKLMGDLVNSKRVKQTGWVIVVLVVALNIWLLVGTALGL

SEQ ID NO: 43605 - protein, 335 aa, Solanum lycopersicum
MVHQKQVKDVVSGWLTVFDDGSVDRTWTGPPEVKFMAEPVPPHDDFIDGVAVKDVVAGENSGSRFRIYLPERNDSSVDKLPVILHFHGGGFCISQADWFMYYAVYTRLARVANAIVVSVFLPLAPEHRLPAACDAGFAGLLWLRDVSREQGHEPWLNEYADFNRVFLIGDSSGGNVVHQVAARAGEEDLSPMKLAGAIPIHPGFMRSQRSKSELEQEQTPFLTLDMVDKFMELALPIGSTKDHPITCPMGDAAPAVEELKLPPYLYCVAEKDLIEDTEMEFYESLKTGEKDVELLINNGVGHSFYLNKIAVDMDPVTGSATEKLFEAIAEFINKH

SEQ ID NO: 43606 - protein, 578 aa, Zea mays
MSYPIHCSVRVNAISGVTLSRSPLLGANYRTCTRLSSERRRSAPSPAAGRRHARQGRAPSARGRDVLRRPGSTPDEAEAGAASLDPEAEAGAASGSGGGGGRGEPGSGGGGGTGPRRGNLEQAKPYPRSGGLEVGGGEEEVGSAQGSAKGNRKRRRSKEVEASSEESSTARSARPFRRFRMDGTHNSRGDSSQPQGQAGWNPYQPPPPPAWNPYMFPMQPQPGGWYPQPIHHPPHNVSIFPPPGGPNIVSVDHTQANVVLGADEVDVLHPEDSVPSILKRGRTKLGNFSPQEDVNLVKAWLEVSCDPVIGNGQKGDRFWKRVVERYNFRRGANSERSLRSLQSRWTNNIKPEVGKFAGYYAEALRQNPSGMSDADKTSLAATNFAEVEGHAFGFMHCWDRMKDEPKWGNPTQLGTEAHLEGDGLEEDSNRVHGDADKSAGKRPVGRDRAKAANKKSKSVSGDTSSSEYASRMQDLSIQKINIMQEESVRKGERFQQLATIDEKRYQEMRSHNQSVLDIEQEKVRIMREKHDREEKKEDERILSINLDSCTPSLRMYYEALQEDIMAKLAARRQGRHAP

SEQ ID NO: 43607 - protein, 94 aa, Glycine max
  misc_feature (28)..(28): Xaa can be any naturally occurring amino acid
  misc_feature (36)..(36): Xaa can be any naturally occurring amino acid
  unsure (1)..(94): unsure at all Xaa locations
LNGPGDRILLLVLGDLHIPHRCKNITAXFKKLLVPXKIQHILCTGNLCTKESYDYLKTLAGDVHIVRGDFDENLNYPEQKVVTVGQFKIGLIHG

SEQ ID NO: 43608 - protein, 1448 aa, Aspergillus oryzae
MENPANDPLNSGAPTECGEYDKDADTEKETLTVPEIRGAASAETLIVPGTSNAVSTETIASPNCSDIISTPKNDPGWGMTDHVISTREREEAAGYKPRQLGITWQNLTVEVPSAETAVNENVISQFNIPRVIGDFLRKPPLKSILQGSHGCVKPGEMLLVLGRPGSGCTTLLKLLANMRRGYYNITGDIRFGSMSSDEAQKYRGQIVMNTEEELFYPRLTVGQTMDFAARLKIPFHLPDGTKSNADYTAETTKFLLEAMKISHTVDTKVGNEYVRGVSGGERKRVSIIECMATRGSIYTWDNSTRGLDASTALEWAKALRAMTDVLGLSTVVTLYQAGNGIYNLFDKVLVLDEGRQIYYGPAAAAKRFMQDLGFVYTDGANVGDFLTGVTVPTERQIRPGYESRFPQNADAILAEYKNSPVYQHMVAEYDYPNSDIAHQRTEDFKESIAWEKSKYLPKNSPLTISFWSQVEACTIRQYQILWGDKSTFLAKQILSTIMALIAGSCFYDSPPTSLGLFTKGGAVFFALLYNCIVAMSEVTESFKGRPVLLKHKSFAMYHPAAFCLAQIAADFPVLLIQCSVFSIVIYWMSGLRHTAAAFWTFWVILFTVTLCITALFRCIGAGFSTFEAASKVSGTAVKAIVMYAGYMIPKGQVKNWFLELYYTNPFAYAFQAALTNEFHDETIPCVGNNLVPNGPGYENVPSGHKACTGVGGAALGADFVTGDQYLTSLHYKHSQLWRNYGIVWAWWAFFAGLTMICTSFWSDGGNSASLYIPREKVKHGHKSDVEAQNEKNPNRGAGSRVSGPEDEHLTRNTSIFTWKDLTYTVKTPAGDRVLLDQVCGWVKPGMLGALMGSSGAGKTTLLDVLAQRKTDGTIKGSIMVDGRPLPVSFQRMAGYCEQLDVHEPYATVREALEFSALLRQSRDIPEDEKLKYVDTIIDLLELHDLENTLIGTVGKGLSIEQRKRVTIGVELASKPSILIFLDEPTSGLDGQSAYNTVRFLRKLADAGQAILVTIHQPSAQLFEQFDTLLLLARGGKTVYFGDIGENAATIKYYFGKNGIECPPESNPADFMIDVVTGSLEAAKDKDWHQIWLDSDEHTRMMINLDNMIAEAASKPSGTHDDGYEFSMPLWEQIKIVTKRMNVSLFRNTNYINNKASLHVISALLNGFSFWRVSPNLSALHLKMFTIFHFVFVAPGCINQLQPLFLQRRDIYDAREKKSKMYSWFAFTTALIVSEFPYLIICAVLYFLCWYYCVRLFPHDSNRSGAMFWIMMWFEFVYTGIGQFIAAYAPNAVFAALVNPLIISILLLFCGVFVPYTQLNVFWKYWLYYLNPFNYVVGGMLTFGIWDARVTCNEDEFAVFDPLNGTCGEYLATFMAGNGQRINLTNPDATSQCKVCEFRTGSDFLATLNINHYYVGWRNGAITVLYAISGYALVYGLMKLRTKASKKAE

SEQ ID NO: 43609 - protein, 406 aa, Caulobacter crescentus CB15
MSTDFHRIRRLPPYVFEEVNKIKARLRAEGTDIIDFGMGNPDMPTPQHIVDKLIETARDPKAGRYSASKGVPGLRKAMANYYGRRFGVKLNPDTEVIATLGSKEGFANLAQALTGPGDVIICPNPAYPIHAFGFIMAGGIIRHVPALSPEEYLSNISRAVKHSVPPPSVLILSYPSNPTAQWVDLDFYKDAVALAKKHDLLVISDVAYGEIYFDNNPPPSILQVDGAKDIAVEVNSLSKTYAMAGWRVGMVVGNARICAALARVKSYLDYGAYTPVQVAAATALNGPQDCVDEIRGIYKSRRDTLIKSMKAAGWDIPNPPASMFAWAKIPEAYREAGSMLFSRLLIEEAGVAVAPGIGFGEYGEGYVRIGLVENEHRIRQAARNVKKFIANADSILAKAHNKMEQA

SEQ ID NO: 43610 - protein, 362 aa, Wolbachia endosymbiont of Drosophila simulans
MDKKVLLELSNGLKIELPVLSGTTGPDVLNIKDLYKMTGLFTYDPGFVSTASCSSTITFIDGDEGVLKYRGHNIADLAENNNFTAVIYLLLYGELPSSEQHKKFLLKIQESSKVSEQVTNVIKAFPKTAHPMSILVACFASLSASYHEKHGNNVNGEDLDFGISAIAQVSTIIAMICRHNNNQEFINANNELSYSENFLKMIFGDAVDNDKSALFAKALDKIFTLHADHEQNASTAAVRLVGSAGSNLFASLSAGVATLWGPAHGGANEAVINMLKEIEQSGDIDKFIEKAKDDKDPFKLMGFGHRVYKNYDPRARILKGACHEVLSKLEQNNELLKIAKKLEEIALKDEYFIVRKLYRIPP

SEQ ID NO: 43611 - protein, 336 aa, Caulobacter crescentus CB15
MGRSAFGSRTRMTAFVDLAARLAAEPADAALKDVVLTIAETCAQISRVVASGALSGSLGAAGSTNVQDEEQKKLDVITNDMLSDALKACGPVAGLASEELEEVEPTGRVGGYLVTFDPLDGSSNIDVNVSVGTIFSVLPAPAGHAPTEGDFLQPGRNQVAAGYAVYGPQTMLVVTLSGGVNGFTLSADGRWLLTHPDLAIKPDTAEFAINMSNQRHWAPAVRRYIDGCLQGKDGARGKNFNMRWVASMVADVHRIMMRGGVFMYPWDAREPDKPGKLRLMYEANPMSLLAERAGGKSIEGLNEILDINPAKLHQRVPVVLGSANEVEVIRAEMRAG

SEQ ID NO: 43612 - protein, 212 aa, Coccidioides immitis RS
MSNPSATTQTNREQSDVSSKVPGHPSTTSASSSELASLKIRLQNALRQFPDFPSPGIIFLDILPIFADPSLHEDLIRSLELHVLETYGDQKPDVIVGLDARGFLFGPSLALRLGASFVPVRKKGKLPGPVETQVYEKEYGSDHFEMQAGAIKPGQKVIVVDDIIATGGSASAAGNLVQKLGGNLLGFVFMLEIDFLKGRAKLHAPVYTLLSS

SEQ ID NO: 43613 - protein, 391 aa, Pseudomonas viridiflava
MEQQCEVAVLGLGAMGAATLYQLARQGADVLGIDRYAPPHTQGSSHGDTRITRLSVGEGPQYLPLVRHSQRIWRELEALTGESLFEQCGVLVMTSSPTYDPHDPEDFTHKTIALAREYGVKHEVLSAGAIRERFPQFSPILETAIGYFEPDGGFVRPERCIAIQLQLAEKLGARIRMNETVTRLQPQGDQVRITTDHGSILANKVVVSAGMWSSQLLGEPFTDLLRVCRQQLFWFALEDTAAFAPVSPSFILTHGPGEMDINYGFPPLPGEGSMKIATEQYLQASAACELDRSVSTEDERTMFQTQVSGKIAGLKAEVVKSSVCAYTVTPDYHFIIDDHPHLKNVTVVSACSGHGFKHSAGLGLALAQRCLHGTSDVDLSAFSLKRFGKKA

SEQ ID NO: 43614 - protein, 391 aa, Pseudomonas viridiflava
MEQQCEVAVLGLGAMGAATLYQLARQGADVLGIDRYAPPHTQGSSHGDTRITRLSVGEGPQYLPLVRHSQRIWRELEALTGESLFEQCGVLVMTSSPTYDPHDPEDFTHKTIALAREYAVKHEVLSAVAIRERFPQFSPILETAIGYFEPDGGFVRPERCIAIQLQLAEKLGARIRMNETVTRLQPQGDQVRITTDQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFKTQVSGKIAGLKAEVVKSSVCAYTVTPDYHFIIDDHPHLKNVTVVSACSGHGFKHSAGLGLALAQRCLHGTSDVDLSAFSLKRFGKKA

SEQ ID NO: 43615 - protein, 302 aa, Zea mays
  misc_feature (149)..(149): Xaa can be any naturally occurring amino acid
  misc_feature (228)..(228): Xaa can be any naturally occurring amino acid
  unsure (1)..(302): unsure at all Xaa locations
MYTLIPRCHLQPVHRSPPPCQAATTTSSAPPSPSPSLSIRFRPDQDELRSTWPQRAWTLAGTAAILSSLSTSASLAASGSGSPAEPIAAALAAYSLADLATGVCHWFVDNYGDAATPVFGSQIAAFQGHHRYPSTITLRETCNNLHALXRGAALALAPVDAALSATGAPAAAHAFVGAFTACVVLSQQFHAWAHEKRRRLPPGVEALQDAGVLVSRAQHAAHHRQPYXTNYCIVSGMWNGLLDRYKVFEALEMVVYFRTGIRPRSWGETDASWKEDTGAEAAAAAASNAGLLQTAGISSDSD

SEQ ID NO: 43616 - protein, 290 aa, Juglans nigra x Juglans regia
MDQYEKVEKIGEGTYGVVYKARNRKTNQTLALKKIRLEQEDEGVPSTAIREISLLKEMQHGNIVKLQDVVHGEKRLYLVFEYLDLDLKKHMDSSPEFANDLRQIKMFLHQILRGIAYCHSHRVLHRDLKPQNLLIDRRSNSLKLADFGLARAFGIPVRTFTHEVVTLWYRAPEILLGSRHYSTPVDVWSVGCIFAEMVNQRPLFPGDSEIDELFKIFRVLGTPNEDTWPGVTSLPDYKGAFPKWPPKDLAAVVSSLDSTGVDLLSKMLSLDPSRRITARTALEHEYFKDI

SEQ ID NO: 43617 - protein, 391 aa, Pseudomonas viridiflava
MEQQCEVAVLGLGAMGAATLYQLARQGADVLGIDRYAPPHTQGSSHGDTRITRLSVGEGPQYLPLVRHSQRIWRELEALTGESLFEQCGVLVMTSSPTYDPHDPEDFTHKTIALAREYGVKHEVLSAGAIRERFPQFSPILETAIGYFEPDGGFVRPERCIAIQLQLAEKLGARIRMNETVTRLQPQGDQVRITTDQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFKTQVSGKIAGLKAEVVKSSVCAYTVTPDYHFIIDDHPHLKNVTVVSACSGHGFKHSAGLGLALAQRCLRGTSDVDLSAFSLKRFGKKA

SEQ ID NO: 43618 - protein, 457 aa, Trichodesmium erythraeum IMS101
MSLKPGKASIYLQSPHHVVIVGGGFAGLEAAKQLGKAPVKVTLVDKRNFHLFQPLLYQVATGSLSPGDIASPLRGVVAEQKNTHVIMGEVVDIDPEEKKLTLHDQELNYDSLVIATGVSHNYFGNDWSEKAPGLKTVEDALEMRRRIFASFEAAEKETDLEKRKALLTFAIVGAGPTGVELAGALAELAHTKLKEEYRSINTTEAKIYLIQSGDRVLPSFKPALSQKARLELEKLGVTVMTKTRVTNIENNVVTVSSGETKTEIPAHTILWGAGVKASKVSEIISNRTGAKLDRAGRVFVNKDLTIPNYSDIFVIGDLANFSHQGDSPIPGVAPAAMQEGFYVAKLIRKRLKGESLKPFYYIDYGSLAVIGRHQAVVQYKAIRFSGPIAWLAWLFIHIYYMIEFDNQLIVMIQWAWSYFTGQGGARLITEKSMKTPSYEERQARYTPLVPSKSSIET

SEQ ID NO: 43619 - protein, 175 aa, Mycobacterium avium subsp. paratuberculosis K-10
MFTFLKLIAGFRVTFSAMFKKPVTEGYPEKPGPVAPRYHGRHQLNRWPDGLEKCIGCELCAWACPADAIFVESADNTEAERFSPGERYGRVYQINYLRCIGCGFCIEACPTRALTMINDYEMADDNRADLIYGKDQLLAPLQPGMAAPPHPMAPGSTERDYYLLDNIAAANREAR

SEQ ID NO: 43620 - protein, 802 aa, Listeria monocytogenes str. 4b F2365
MLVSYNWVKEFFQDFPLTAEELGEAITRTGIEIEGVEELSASLKNVVVGEVLSCERHPDAEKLNKCLVQTDETEPVQIICGAPNVAAGQKVIVAKVGARLPGGLKIKRAKLRGEVSEGMICSLAELGFESKVVPKAYAEGIYVLPAHVETGVSAITLLGLDDAILDMAITPNRADALSMNGVAHEVGAIIHQKPAQPTEPDVSEKGKADDFISVEVENPAETPYYAIKMVENIEIKESPLWLQTKLMKAGIRPHNNVVDVTNYINLLYGQPLHSFDYDKIGSKKIVVRSAKEQEEITTLDGEKRTLQAGHTVITNGVEPIAIAGVMGGEFSEVTENTTTVALEGAIFSSSSIGKASRELYLRTEASIRYDKGSDAWKVEKALAHGGALIAELSGGTLVGGVVEVDNREKAVNKIETSLTRINRILGTAITLAEIETIFDRLGFVLEVKNDALIIEVPTRRWDITIEADILEEVARIYGYDEIPVTLPATSTTGGLSDSQKARRVMRAYLEGAGLNQALTYSLTSKKDATRLALSDEKTVALSMPMSEEHSHLRTSIVPQLIRSASYNIARKNMDVALYEMGTVFYATEGDNLPIEQEHLAGLITGNWHTIDWQKTPKPVDFFVLKGIVEGLVNKLGIKSELHWKQTEKEELHPGRTASLILEGQEIGYLGALHPAVEANYDLKETYVFEINVAALLDATKEKVVYHPIPRYPEMTRDLALLVDKNTDHATISQVIQEHGGKLLVDIELFDIFEGESIGENKKSLAYTLTFLDSERTLVEEDVQKATNKVIEALQEKLHAIIR

SEQ ID NO: 43621 - protein, 375 aa, Rhodopirellula baltica SH 1
MRVASHLPLPPDRSMNFHRWSQSLAAAMCLTLVSSGLNAQDDAPAGVLHQQFIYDEAPFPSCHASTICQTSNGLAAAWFGGEREGAKDVSIWVSDHDGNSWSAPRMVADGVQPDGSRHPCWNPVLFHAPSGATWLFIKVGPSPKDWWGEVLFSDDSGKTFRDRTRLPEGVLGPIRCKPELVDHGKTLLCGSSTEHDGWRVHFERLTLTGKADSDAVSASHWDRGEAIHDGKEFAAIQPTILRLADGRLRALCRTMQSVIVQTDSNDNGRTWTKPIATDMPNPNSGIDVVTAKDGRHWLISNPLPSKENGWGGRSRLTLSVSTDGKTYREVAVLENEPKGEFSYPAIIQADDGKLHMTYTWKRKKIKHVIFDPNAI

SEQ ID NO: 43622 - protein, 202 aa, Myxococcus xanthus DK 1622
MLDLDALDFAKGNGLVTVVTQDASTGDVLMVAHADREALERTLATGEMHYRSRTRGPWHKGATSGNVQRVVALRADCDGDAVLARVAKAGPACHLGTKTCFGPGRWDALSALDDTLARRAAPAERPDDAPPSYTRRLLEDRNLRLKKLGEEAAELVTACADVDPSRAAEEAADVLYHVLVAVRPLGLSLDDVKAVLARRASR

SEQ ID NO: 43623 - protein, 694 aa, Arabidopsis thaliana
MSCWRKKSKKKNSEANQRQRWFQENGKVLLEDLIELCNGKSNPIKTFSAEEILQATDNFSESNLVIRFNFMYRGILQNRPVLIKRATWNYYKSDTLEKICRDIAVSSMVSGHKNFLKLLGCCLEFEHPVLVCEYAERIPFNTPNPEMLLPWRMRIKIAKEIAIAVSYLHTALSRTMIHTDIQPFNIFVDSNGTAKLSDFCLCIAIPEGETFVKVHADRVEGTLDYLEYNYAATGLITEYTDVFSFGVLLQNFFTRTYGVVDCCCSEDESLFEEFEDKQNVMNLRISDRISKFVEEGRIFDMLDPKMLESMGDDETEEHKIRRMKAVLMLSLRCTGHRVVDYHKSSLLLCKSQSFELSPIEMSKNNKKKRRWDLKNGGILLEELIASFDGKTNPIRCFSSDQILKATDNFSESRIISSWGYFIWYKGVIEERQVSIKKWSSQNLSSFTEAYRDISVSSQMSGHKNALKLIGCCLEFDLPALVCEYTEHGPLNRDGGLSSGVVLPWKVRLKIAKEIASSVTYLHTAFPETIVHRNINPTNIFIDENWTAKLSDFWFCVAIPEGELYVEDDVKGVIGFVDPDYYWTMKVTEKVDIYSFGVVMLVLLSGRAAVFNGPDEAPMSLNDHVSEVMEKGEFDEIVDKEIWNDLGGDDDLVLRRSQVKAFLRLALRCVRYKKEDPVSGMLEVAKELKLIEKLS

SEQ ID NO: 43624 - protein, 1832 aa, Podospora anserina
MYNPPGQRDATRPFHVPPPPPPMSPPPPTVGINNPMMTIPPPPPRHPNAPSTTGNVLLPPPPSGPPPNSGFPNSAIAPPSALGSTAPWHGAWGRAYDGRTAFNIPPPPPGGGAGGGGGGGSGGVLRAYDPKYHAQVLAAANNGATYTVPPPPPPQQQQQQQQQQQQQQQQQQQQQQQQQQQQQQQQQQQQQQQQQQQQQQQQQQQQQQQQQQQQSDQMGALTSATYIPQGDTYGEGVGIPGLGLEDSAIGWNMGAHLESATATPLDESSGRDRLYANAMAQRGSSTTSNATVSSVSVPPELAAQWPMEKVLGWLQANSFSSHWQETFKYLGLDGARFLELGSSHGGRGNFGMMHQQVYPRLLALSGPEWNQAREREEGKRMRRLVRSIVTGRPVEVKGGRLGGGQQQPQHARQNSTSAPPAVTGGQTGNRSAESPNVSVDDGFWDTGVTDADDGDKQTPNPIKIPEFGFSRRFSQSRATTMPTLSSTMPTDHRNMMKEIDTSRRHSPTLSESGEAGGTFRGGSTPLGGGGGGGGGGGRDSPSAGSPNPASGLFPSSTAGNLSASPHSSRFGHRSRNSTDSVSSSAAIYGSGVPADAAAMLKSGMNIADVVNAARNANDRRHAQDGGRPSPQESGGGDRSAGEPPGSAKGSGSFLSIFTRKKHGRKDDGFGGDEDSPTSPGLSFKPQSLGDNRPGSSAGTYGHHHAGNVRANRGGPRVFILATADCWNYRMLDVTDIETASDLRQLICINLGLPESEGAHLYPTELGKFEHDGEALDDSKLLAIKTQRADAIGTLKLFVRVGGPPQMRQTGAQIAMDEETYVKLNGRMRSSSSPPTSRQNTLTGKEGEDKMLTAEAIEYRTEQLRKQKEYLAKRKQVAENNHVADRSPSSSIVGRTVDFDQPRHSPFEDRKMDTLLPQRKPPAPPSDPSATLIKANSLKKTGHGLRLSGDSGYHPKRKTSSDLRSSGDVVFEKQKRWGPVADPSAGIGALLVGMSDGMASIARPRPGGGMMQQRQPSPHRVATEPITSQELQRGKKAMSTVNFGPAHQRERSGSGGGSPRPGGMPGSPGSYTWSSKNVPFLVPDYSPNGTPAPPTASRMPDGGGNSGDGCLDQNHNHQAQNGTIAKMRNVARAPSPGNVSPSSRRRPSDSFSSQAAVAKKRKSHGPDTDFTDNDVTFSASSTRASKKVDDSDSDDDSDDGLFAIPIAARNSGPDKGKTTAPAEGNSGDSDGASGTGTGKRPSLRLNTRSGSNSRAKKTLSVAFAVSPQSSSAGGKTPLEDDDSGRSSSQRRGTPGTPQSEGGWDSEEKDSKISRRKSFIEKDVWANRPPTDALVNNLEDFFPDLDVDQPVLEEGVDQEPPSPIAEGDENNQGSASVPPLPPLPPGLSTGKLHTFYNDNDTLGSDESTLKALESRPVSMQSLAHRSIRRSGGGGGLGRMKSIREVARGANEFGKRYTQGPGQIDAQSSAAAAGNRNTNLMRRKSTKMFNANIVQIQPDRGSLNLAMGGLTTIPQDSLPTRSTNSRESIPKRQTTFRWFKGQLIGKGTFGRVYLGMNATTGEFLAVKEVEVNPKAAQGDKKKMQELVAALDQEIDTMQHLDHVNIVQYLGCERKETSISIFLEYISGGSIGSCLRKHGKFEEPVVASLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGRRPWSKEEAVGAIYKIANGETPPIPEDIREVISPVAIAFMLDCFTVVSSERPTADVLLSQHPFCELDPTYSFLDTELYAKIAGRVNDLGRGQ

SEQ ID NO: 43625 - protein, 590 aa, Arabidopsis thaliana
MDICCKDIISDHSKKDIISDLPEALICHILSFLPIEDSALTSVLSKKWQHLFAFRPNLEFDDAVVYLNPDGERNETIFENFVDRVLSLQGDYPINKFSLTCRDFTDPTCVSRWISNVMERGVSDLDLRCIVYWDNGTMPPDIFVSKALVHLRIETGNGAFIDVEDVFLPNLKTLYLNKVLLRHSDNGFVKLITSCHVLEDLFIMNICWDGYLKRSLSSKTLKRLTFFCEDVHAVNPESVSFDTPNLVYFVYHDCVADKYKNMNFDSLVYASICLQMTSHQRTHASYEHLVGNATDFLLGISNVQILELFANTIEVCIVIPSSSFLATLKQKEDKQTDQKAGWESLPVLLKNCPDLESLIFDGLHHNDTIKCEDVDGCLCKSSRGIPSCLSSSPVQFLTIWKFGEICDDYDDMEKQIELVMYFLETMPNLEEMKLFYDTQIYEDVISKLQMDLRRTLSLRSLFNARCYQPSCSGIIQRDDVHEEKPHYGSFLHQRSFSSSMILSQQHMMRSPSHFPLCSPFGVSTYRPMSTSHISGSDESGDVNHVAETLTDLVQQDTVIEVADAAIDSSIQLDFVQQIVHNVHSLTGLNW

SEQ ID NO: 43626 - protein, 594 aa, Oryza sativa (japonica cultivar-group)
MASSASLQRFLPPYPHAAASRCRPPGVRARPVQSSTVSAPSSSTPAADEAVSAERLEPRVEQREGRYWVLKEKYRTGLNPQEKVKLGKEPMSLFMEGGIKELAKMPMEEIEADKLSKEDIDVRLKWLGLFHRRKHQYGRFMMRLKLPNGVTTSEQTRYLASVIEAYGKEGCADVTTRRQIRGVTLPDVPAILDGLNAVGLTSLQSGMDNVRNPVGNPLAGIDPDEIVDTRSYTNLLSSYITSNFQGNPTITNLPRKWNVCVIGSHDLYEHPHINDLAYMPAVKGGKFGFNLLVGGFISPKRWEEALPLDAWVPGDDIIPVCKAVLEAYRDLGTRGNRQKTRMMWLIDELGMEAFRSEVEKRMPNGVLERAAPEDLIDKKWQRRDYLGVHPQKQEGMSYVGLHVPVGRVQAADMFELARLADEYGSGELRLTVEQNIVIPNVKNEKVEALLSEPLLQKFSPQPSLLLKGLVACTGNQFCGQAIIETKQRALLVTSQVEKLVSVPRAVRMHWTGCPNSCGQVQVADIGFMGCLTKDSAGKIVEAADIFVGGRVGSDSHLAGAYKKSVPCDELAPIVADILVERFGAVRREREEDEE

SEQ ID NO: 43627 - protein, 391 aa, Pseudomonas viridiflava
MEQQCEVAVLGLGAMGAATLYQLARQGADVLGIDRYAPPHTQGSSHGDTRITRLSVGEGPQYLPLVRHSQRIWRELEALTGESLFEQCGVLVMTSSPAYDPHDPEDFTHKTIALAREYAVKHEVLSAGAIRERFPQFSPILETAIGYFEPDGGFVRPERCIAVQLQLAEKLGARIRMNETVTRLQPQGDQVRITTDQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFKTQVSGKIAGLKAEVVKSSVCAYTVTPDYHFIIDDHPHLKNVTVVSACSGHGFKHSAGLGLALAQRCLHGTSDVDLSAFSLKRFGKKA

SEQ ID NO: 43628 - protein, 550 aa, Arabidopsis thaliana
MELLLPHPSNSTPLTVLGFLDRAASVYGDCPSILHTANTVHTWSETHNRCLRIASALTSSSIGIKQGQVVSVVGPNVPSVYELQFAVPMSGAILNNINPRLDAHALSVLLRHSESRLVFVDHRSISLVLEAVSLFTQHEKPHLVLLDDDQENDSSSASDFLDTYEEIMERGNSRFKWIRPQTEWQPMVLNYTSGTTSSPKGVVLSHRAIFMLTVSSLLDWSVPNRPVYLWTLPMFHANGWGYTWGTAAVGATNICTRRVDAPTIYNLIDKHNVTHMCAAPMVLNMLINYPLSTPLKNPVQVMTSGAPPPATIISRAESLGFNVSHSYGLTETSGPVVSCAWKPKWDHLDPLERARLKSRQGVRTLGFTEVDVRDRKTGKSVKHDGVLVGEIVFRGSSVMLGYYKDPQGTAACMREDGWFYSGDIGVIHKDGYLEIKDRSKDVIICGGENISSAEIETVLYTNPVVKEAAVVAKPDKMWGETPCAFVSLKCDNNGDGSVPVTEREIREFCKTKLPKYMVPRKVIFQEELPKTSTGKIQKFLLRQMAKTLSG

SEQ ID NO: 43629 - protein, 391 aa, Pseudomonas viridiflava
MEQQCEVAVLGLGAMGAATLYQLARQGAHVLGIDRYAPPHTQGSSHGDTRITRLSVGEGPQYLPLVRHSQRIWRELEALTGESLFEQCGVLVMTSSPAYDPHDPEDFTHKTIALAREYAVKHEVLSAGAIRERFPQFSPILETAIGYFEPDGGFVRPERCIAIQLQLAEKLGARIRMNETVTRLQPQGDQVRITTDQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFKTQVSGKIAGLKAEVVKSSVCAYTVTPDYHFIIDDHPHLKNVTVVSACSGHGFKHSAGLGLALAQRCLHGTSDVDLSAFSLKRFGKKA

SEQ ID NO: 43630 - protein, 250 aa, Zea mays
WAAWEDYEQEQDMEVEALQAILMDDIKEIDPSESGIATTARCFQILLSPQDDDFDESAYVPVQLALIFAHTEKYPDEPPLLNVKSVRGIKPHDLASLKEKLEQEAKENLGMAMVYTLVSSAKEWLSEIYGQNGGDEEPEESEAEKEEVIIPHGEAVTVESFLAWRERFEAELALQRAKLMPDSALTATKEKKLTGRQYFETGRHAVKGASTVADEDEEEEEDIDFDDDFEDDEEDMLEHYLAEQSGKSTA

SEQ ID NO: 43631 - protein, 412 aa, Zea mays
MHDAHDDSENFLELLNSRTLVPELFADPPACDYLKKMEYGSSHGGGGWPDHHQFTTAAALEKHLSSGYGGGALAHQHQHAAAGGAPERLTANLSDLVSNWSIAPPNPCLGDAHHHHRTGVVAAACDNDNAKAGMFLGSGGGVCNHEIGGHGAMLEGAATGGGGGGGQEFLRPAAGAGYSSMLGLSRNNRTMYMEAPWGSNAAGATRSLSDLISFGGAPLGKAEEPAPPTSTKALAEYKKQGHDIPSPAKTSSGGGSKGSSEGKKKRSEQQQGSSEGNTKKSKSEVSSPTSSLKASSQQVPKVKLGDKITALQQIVSPFGKTDTASVLYEAINYIKWLHEQVQLLSDPYMKTSSKDYNYNAWGRLEDKEGAEMVDLRSRGLCLVPVSCTPQAYRDSNDGPDYWTPPYRSCLYR

SEQ ID NO: 43632 - protein, 844 aa, Oryza sativa (japonica cultivar-group)
MQMPFCPKLWSSAAPAPVQPGSVVINGTVVVANHFGLSAPGKSTTLRLFSGTEVDHGDAESLKRIAETRKGRLSAEAALRGGKKTRHGKASTTMYQVTFFVDGEFGTPGAVAVKNGNRNDQFFLRHVRLDLAEDRSIHFDCNSWVYPYKKTTSDRVFFINTSYLPDKTPEALRLLREEELRSLRGNGRGERKDWERIYDFDYYNDLGNPDNDDHVRPVLGGTKTHPYPRRCRTGRPLSKTDGVTETRKHKLINLDYYIPPDERFSPGKLAEVLAMGVQAVTHFVIPEARSIFHGDVVNFKSTEQLRADLYGKPPQPAADARVMDELKSSVPSHKTYKQVSRIVKDNPAKFPTPQVIHYDTEAWRSDEEFAREMLAGLNPVVIKRLEVFPPNKSKITTDDIMTQIGGLTIQQAMEQKRMYILDHHDYLMPYLRRINTEGVCVYASRTLLFLRDDGALRPVAIELSLPDGGVGGSEISRVFLPASQGTDAHLWHLAKTHVAVNDSGYHQLISHWLFTHATVEPFIIATRRQLSAMHPIHKLLDPHFKDNMQINTLARSILLNAGGLLEKTMYPGKYSMEMSSDIYAHWRFTEQSLPNDLIKRGMASRDPKARGGVSLHIEDYPYAVDGIDVWLAIEGWVRSYCDHFYHADAAVAGDAELQAWATPRAGWTSTPSRASSRRLSTLIWTASALHAAVNFGQYGYAGYPPNRPTRCRRFVPLPGSPEMAQLEADPGRFFLETVPDRFTATLGIALIEVLSNHTSDEVYLGQRATSTWTDDGEVLLLLDRFRDELRRVEKRVEERNKDPRLVNRRGPVRVPYTLLYPDAGDVAGKEKGITGRGIPNSVSI

SEQ ID NO: 43633 - protein, 375 aa, Myxococcus xanthus DK 1622
MSAAAGQKRDYYEVLGVQKSVSAQELKSAFRKVALQYHPDRNPGNSDAEEKFKEASEAYEVLSDPERRAKYDRFGHAGNPFDGFGGAGGGFQGVNINDIFGEIFGDIFGGGRGGRRTSSRGADLRYNLEITFEEAAFGCRPKVTIPRPKKCDTCSGSGSKSNTGPRPCSACGGSGELRYTQGFFAVSRPCGDCGGTGAVVPDPCTRCKGSGKVPSEEVIEVAIPGGVDNGTRVRLSGMGEPGDRGGPPGDLYVTVIVKEHPLFQREEYEVFCEVPISFTQAALGAKIDVPTLDGKVKMTVPNGTQSGKVFRLKGKGIPHLHSQQRGDQHVRVVVETPTELSSKQRELLEKFAEASGEESHPQSKSFIAKVKELFG

SEQ ID NO: 43634 - protein, 319 aa, Triticum aestivum
  misc_feature (172)..(172): Xaa can be any naturally occurring amino acid
  misc_feature (184)..(184): Xaa can be any naturally occurring amino acid
  misc_feature (298)..(298): Xaa can be any naturally occurring amino acid
  unsure (1)..(319): unsure at all Xaa locations
MASDGSGVVTVYGSGNNGAGTQLEPKSSPFSVKVGLAQMLRGGVIMDVVNAEQARIAEEAGACAVMALERVPADIRAQGGVARMSDPGLIREIKRAVTIPVMAKARIGHFVEAQILESIGVDYVDESEVLTLADDAHHINKHNFRVPFVCGCRNLGEALRRIREGAAMIRTXKGEAGTGNVIEXAVRHVRSVMGDVRALRSMDDDEVFTYAKSIAAPYDLVMQTKQLGRLPVVQFAAGGVATPADAALMMQLGCDGVFVGSGVFKSGDPARRARAIVQAVTHYSDPNVLAEVSCDLGXEAMVGINLSDPKVERFAARSE

SEQ ID NO: 43635 - protein, 427 aa, Acidobacteria bacterium Ellin345
MKPSLPSRPPGFVYKSNKLHVEKIAASDLARRFGTPLYTYSATTIRERFDIFNRAFGKVPHTICYSVKANSNLTILKMLVKLGSGFDVVSGGELERVLVVDKKAAKKVVFSGVGKTAPEMDLAIKSDILLFNIESESELELLASRASKLRKKPRIAFRVNPDVPAETHPYISTGLREHKFGVPITDAALLYAQAASTEWLEPAGVSVHIGSQITDVAPFNATMERVADLVRGLRAQGHNIRLIDGGGGLGIAYRDGDTSLKAFEASAKNYSAALLPPLNSLGIHLLLEPGRAIIGPAGALLTRVVYSKKNGRKTFVIVDAGMNDLIRPALYGAYHEIVAAEPRGTGAETVDVVGPVCETGDFFARDRELTHLEEGDLVAILDAGAYGMSQTSNYNTRPRPAEVLVEGSRAKVVRRRETIKDLLGPER

SEQ ID NO: 43636 - protein, 535 aa, Arabidopsis thaliana
MGKKGSGGWFSTVKKKVFKSSPKDSKRENNIGSNNADIWQQQHDTQEVVSFEHFPAESSPEISHDVESTASTPATNVGDRKHAMAVAIATAAAAEAAVAAAQAAAKVVRLAGYNRQTEEDSAAVLIQSHYRGYLARRALRALKGLVRLQALVRGNHVRKQAQMTMKCMQALVRVQGRVRARRLQVAHDRFKKQFEEEEKRSGMEKPNKGFANLKTEREKPKKLHEVNRTSLYQTQGKEKERSEGMMKRERALAYAYTYQRQMQHTNSEEGIGLSSNGPDRNQWAWNWLDHWMSSQPYTGRQTGPGPGPGQYNPPPYPPFPTAAATTTSDDVSEKTVEMDVTTPTSLKGNIIGLIDREYIDLGSYRQGHKQRKSPTHIPSYMAPTASAKAKVRDQGPTVKLQGTSFMPYWNSSTKNGSVNGSGCDSSSSGGAITTGYPGPRSPNPKSDIRRKPVSPSQSPTGVVFELCANEKTSHEVTPIPTEALSLWHYKEKSEDSHSKTRTSRACCLQRNCVVLDLALMLEHFRKTWGQSAESS

SEQ ID NO: 43637 - protein, 452 aa, Pseudomonas putida GB-1
MQDQSTPERLQRGLKNRHIQLIALGGAIGTGLFLGIAQTIQLAGPSVLLGYAIAGLMAFLIMRQLGEMVVEEPVAGSFSHFAHQYWSEFAGFVSGWNYWVVYVLVGMAELTAVGIYVQYWWPEFPTWATAAIFFVAINLINLTQVKVYGEMEFWFALVKVVAIVSMIGFGAWLLSSGHGGPDASVANLWQYGGFFPNGVSGLVMALAVIMFSFGGLELVGITAAEADNPRQSIPKATNQVVYRILIFYIGALAVLLSLYPWQKVVQGGSPFVMIFHELDSDLVATILNIVVLTAALSVYNSCVYANSRMLFGLASQGDAPRQLLKVSRSGVPLTALGVSAFATGLCVLINYLMPGEAFGLLMALAVSALVINWASISITHLKFRKAKLAAGIIPFYKSLGHPLTNYLCLAFIVLILVVMYLTPPIRISVMLIPAWIAVLWVAFKLKKARQAK

SEQ ID NO: 43638 - protein, 682 aa, Ralstonia eutropha JMP134
MKNPFFNLYSHGFARVAVGVPVCRVADPAFNAAETIALATQAAKQGAVLVAFPELGLSAYTCDDLFHQRALLDACEAALGTIVEASRKLSAAMIVGMPLRVEHQLFNCAVVVARGRVLGVVPKSYLPNYWEFYEARQFSEADNAATDSIRLLGQDVPFGAGLLFEIEDIPFFRFHAEICEDVWVPIPPSSFAALAGATVLVNLSASNIVIGKSGYRHQLVSQQSARCLAAYLYTSAGKGESSTDLAWDGQALICENGELLAESERFADTSHVLFADVDVERLSRERMHQVTFGHSVRRHKAEVDKFRVVRFPLEVSRDKALPLERKVARFPYVPADPRQRDERCHEVYNIQVQALVQRLSASKISKVVIGVSGGLDSTHALLVCAKAMDRLGLPRSNILAYTMPGFATSDRTLRQARQLMELVGCTAREIDIRPSCLAMLKDLDHPYARGEKVYDVTFENVQAGERTNHLFRLANHNGAIVIGTGDLSELALGWCTYGVGDHMSHYNVNASVPKTLISHLVRWVAETGQVGDSGSEVLIHVLDTDISPELVPGDSNHGPEQKTESTIGPYELQDFNLYYTLRFGFAPSKIAFLSLHAWGDRERGIWPNGPHVVRNQYGLPDIKRNLGIFLDRFFRTSQFKRSCIPNAPKVGSGGSLSPRGDWRAPSDSESVVWLKDLEKVPD

SEQ ID NO: 43639 - protein, 119 aa, Arabidopsis thaliana
PLPTFKVRKENLRDQITSLQQLVSPFGKTDTASVLQEAIEYIKFLHDQVTVLSTPYMKQGASNQQQQQISGKSKSQDENENHELRGHGLCLVPISSTFPVANETTADFWTPTFGGNNFR

SEQ ID NO: 43640 - protein, 391 aa, Pseudomonas viridiflava
MEQQCEVAVLGLGAMGAATLYQLARQGADVLGIDRYAPPHTQGSSHGDTRITRLSVGEGPQYLPLVRHSQRIWRELEALTGESLFEQCGVLVMTSSPAYDPDDPEDFTHKTIALAREYGVKHEVLSAGAIRERFPQFSPILETAIGYFEPDGGFVRPERCIAVQLQLAEKLGARIRMNETVTRLQPQGDQVRITTDQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFKTQVSGKIAGLKAEVVKSSVCAYTVTPDYHFIIDDHPHLKNVTVVSACSGHGFKHSAGLGLALAQRCLHGTSDVDLSAFSLKRFGKKA

SEQ ID NO: 43641 - protein, 250 aa, Solanum lycopersicum
MWRRFSSQLRALTPSQSPPKCNLFVTGSVSSSSLTSEIFRPSVALYNRHFSSEFGNASKEDEVEHGNLFKTRLNNIHASLTSPYKGYTSCLSQYNAAVPSFPRRFIATGATSVNMVSEDASALATPRIKFKRLDKTAKHIMQILDKEAVEEVRAQNEIPDIKPGYIIQLKLEVPENKRRVSTIKGIVIARRNAGLNTTFRLRRLVAGVGVENLFHLYSPNLKEIKVLDKKRVRRAKLYYLRDKMNALKKH

SEQ ID NO: 43642 - protein, 461 aa, Listeria monocytogenes str. 1/2a F6854
MSLFSLKRKNHFVPLEIQRQQWFKHFIVAFMSVFICYLTVYLLRNNFKAAQTLLIEQNHFSTTELGMIGLAFSVMYGIGKTILGYAVDGRNAKKIMSFLLGVSAIISIIIGILLVTKQATVGILFILWGANGFVQSPGGPASYSTITRWTPKLKRGRWLGFWNASHNIGGALAGIVAFWGATTFFNGGAGGMFIVPGIIAIIIAIICFSVGHDEPEELGWNSAAEIFEEREEQGDSETKDLSRFQIFCRFVINNPWVWTLCVINIFIYIVRIGIDNWAPVYCIQALGWSTKDAIMTISFFEIGALLGSLSWGWLSDIMKGRRMLCSIIAVVIEFFMLISYSQVTSVYSMYTVLFILGFLVFGPQLLIGVSVIEFVPRNALAVTNGLTGTFAYLFGDSFAKVFLGYIADPTKAGMQIFGYNLHGWGATFTIMFTALIIAGLMMIPVALKQEKIIRQAKVLHL

SEQ ID NO: 43643 - protein, 695 aa, Alkalilimnicola ehrlichei MLHE-1
MRVYDPHAEAVAFEDGTKLPRRPGSDFFEGPLPAGLSAPYRLRRTSQDGAAHTAHDPYAFGPALPDYDLHLFGEGRHYHAQRFLGAHPLEHEGVPGVRFAVWAPNAERVSVVGDFNRWDGRCHPMRVRGGSGVWELFIPGLPDGSLYKFELRNRDSGAVLVKTDPYGRRYQLRPDSAAVVEPPADYAWNDREWMAARREDQWQSIPISIYEVHLGSWQRAGDGSFLDYRTLAHRLVDHVLATGFTHIELLPITEHPFDGSWGYQTTGYFAPTTRFGAPDDFRYFVDHCHRHGIGVILDWVPAHFPRDDWALANFDGTPLYEHADPRRGEHRDWGTLIFNFGRNEVRNFLTASALYWLEEFHIDGLRVDAVASMLYLDYSRDEGDWVPNIHGGNENLEAIDFLQELNRITHGEQPGTMIMAEESTSWPQVTRPTWLGGLGFTMKWNMGWMHDTLTYMGEDPIHRRYHHDQLTFGMLYAFTENFVLPFSHDEVVHGKRSLLWRMPGDEWQRFANLRLLYAYQFTYPGKKLLFMGCEFGQGNEWNAEAALDWYVLDYPLHQGVLRLVGDLNALYREVPALHRHDFDEHGFAWIDCHDTEQSAISYLRRDGGHDGEATPPAATVLNFTPVPRHDYRLGVPAPGYWRERLNTDSTHYGGTNLGNGGGVWAEAVPWMGHPWSVVLTLPPLAGVVLSPEAGP

SEQ ID NO: 43644 - protein, 417 aa, Haemophilus somnus 2336
MDFFLYKDGHLMAENVSVKKIAEQFGTPAYIYSRATLERHWHAFDNALGDHPHLICFAVKSNPNIAILNIMARLGSGFDIVSQGELERVLFAGGDPKKVVFSGVAKSEQEIARALEVGIRCFNVESAAELTKINQVARKMGKIASISLRVNPDVDAHTHPYISTGLKENKFGVSVEQAREVYRQASQLENIKIVGIDCHIGSQLTELQPFLDATDRLIVLMEQLKKDGITLEHVDLGGGLGVTYSDEKAPHPSEYATALLEKLKNYQNLEIILEPGRAITANAGILLTRVEYIKSNESRHFAIVDTGMNDMIRPALYQAYMNIIEVDRTLSRETKVYDVVGPICETSDFLGKQRSLAIAQGDFIVQRSAGAYGASMASTYNSRPRAIEIMVDGEQVHLIKRREEFAELWHLEKLLEM

SEQ ID NO: 43645 - protein, 422 aa, Alkalilimnicola ehrlichei MLHE-1
MSSSPSPRFVSRLTRNTLVLILAGGRGSRLMDLTTWRAKPAVPFGGKFRIIDFTLSNCINSGIRRIGVLTQYKAHSLIRHLRLGWGSLRGDFGEFVEILPAQQRTEGSWYRGTADAVYQSLDIVRMHDPDYVLILAGDHVYKMDYGPMLARHVETGADVTVGCLEVPVEEASAFGVMAVDGDNRVVRFQEKPADPPSIPGQSDRALASMGIYIFNRAFLFNQLIADARKESDHDFGKDIIPSLIDQARVIAFPFRDAATGGQAYWRDVGTIDAFWRTNLELVGVNPQLNLYDKEWPIWTHQEQLPPAKFVFDDDDRRGMAVDSMVSGGCIISGAYLRRSLLFSSVVVEDGSRVEDAVILPEAHIEPGCRIRKAVIDKHCRLAAGTVIGEDPEEDARRFHLSPGGVVLVTPDMLGQEIHNVYT

SEQ ID NO: 43646 - protein, 326 aa, Kineococcus radiotolerans SRS30216
MTRRDVAEQVVVVLGASSGIGRATALEFARRGATVVCASRGEQALRTLVEEITAAGGRAQAFRADITRVQDLQALVAAAESAHGRVDTWVTMAGVSVYGTVDDIPLEEFRRVAEVNYLGHVAAAKVAVPALERSGGGVLVGMASVEGVRSLPFHAPYTASKFAARSFYDALRVELAHAGSPVAVSTILPAGIGTPFWENSRNRTSHLTKPPPPPYAPELVADVVVRMATHPRRQAVVGGASLGFILGEKFNPGLTDVVLSLVGRRMQTSRRPDNGTDIVSTPTPGPGQVHGEHAGHLIRRDLFTTLSARLPRPGEALLALRARWAR

SEQ ID NO: 43647 - protein, 181 aa, Vibrio cholerae O1 biovar eltor str. N16961
MTTETLSLIKSSIKSIPDYPKKGILFRDVTSLLEDAQAYQATIQLLVEKYKDMGFTKVVGTEARGFLFGAPLALELGVGFVPVRKPGKLPRQTVAQSYELEYGTDTLEIHVDAIKPGDKVLVVDDLLATGGTIEATTKLIRQLGGEVEHAAFVINLPEIGGDKRLEGLGLQVYSICEFEGH

SEQ ID NO: 43648 - protein, 506 aa, Ehrlichia canis str. Jake
MNNIYITTPIYYVNDVPHIGHVYTTLISDIIARFMRLDGYNVKFVTGTDEHGQKVEKAAQERNISLLEFTNGTSAVFRQLADVMNYSYNDFVRTTEMRHKKAVTALWTSLCDNDMVYLGSYSGWYSVRDEAFYQEKELIDGKAPTGAEVEWIEEPSYFFRLSDFQEKLLTFYEEHPDFIIPKYRYNEVISFVKSGLKDLSVSRKNVVWGIKVPNDDEHVIYVWVDALANYLTVLGFPDVKSKDYQTYWGNDNSTVLHVVGKDILRFHAVYWPAILMAAGLPLPKKILAHGWWTNEGQKISKSLGNIIKPFDLVEEFGVDQLRYFLIKEMPIGNDGDFKRSSFIKCINSDLANNIGNLVQRTVSLLYKECEGKVPLVNNSLLRNEEVLPDYQEILEKARGCIKYYNLNGLIHIIEQLSSMANEYITARVPWKLSKSDREIMKAVLYKLLEYIRCIGLLLQPVIPELSSKMLDQINLPRCNRDFSKFSIPISMGEILPKPEPIFAKIV

SEQ ID NO: 43649 - protein, 385 aa, Populus alba
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 43650 - protein, 191 aa, Suillus bovinus
MQTIKVVVVGDGAVGKTCLLISYTTNKFPSDYVPTVFDNYAVTVMIGEDPYTLGLFDTAGQEDYDRLRPLSYPQTDVFLVCFSVTSPPSFENVREKWIPEVHHHCPGVPCLIVGTQIDLRDDAQVIEKLSRQKQRPVPTEHGERLSRELGAVKYVECSALTQKGLKNVFDEAIVAALEPPVVKKTHKCVVV

SEQ ID NO: 43651 - protein, 311 aa, Oryza sativa (japonica cultivar-group)
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGVKLLLINHPDLSCLDTCHFKSEHVVKYSTNCQDTLLANKDFEGAVVSRTPLRRVGEPEEVSSLVAFLCMPGSSYITGQTISVDGGNRYKSSVSMMVLAEQ

SEQ ID NO: 43652 - protein, 695 aa, Xanthobacter autotrophicus Py2
MTAHASTAKAMTAASATTADAVPTLDRSPGSLAWPVTAALRALAMDGVEQAKSGHPGAPLGMADISAVVWREHLRHNPADPAWPDRDRFVLSNGHGSMLIYALLHLTGYDLPVAELKRFRQVHSRTPGHPEYGMTPGVETTTGPLGQGLANAVGMALAEKTLAAQFNRPGLAIVDHRTFVFLGDGCLMEGVSHEACSLAGRLGLGKLVAYYDDNGISIDGKVEEWFADDTPARFEAYGWHVVRNVDGHDPAAVRAATEQALAETGKPSLICCKTVIGRGAPTKQGHQDTHGAPLGPDEIARTRAAMGWDHAPFEIPDDIYAQWDARKVGAARQQAWEARMVAYERAYPKEAAEFRRRLKGDLSPVFADTYAAALKTTLEKAETVATRKASQQALAALAPAVPEFLGGSADLAHSNLTTFPGAVPVTRDPAGNQIYYGVREFGMSAIANGIALHGGFIPFVATFLVFSDYARNAMRMSALMGQRVIYILTHDSIGLGEDGPTHQPVEHVESLRLIPNLDVWRPCDTVETLAAWHAALTRTDGPSALILSRQNLPMWPRSAAQVEAIAGGGYVLRESEGVARAILVATGSEVKLAVAAAEALDTAGIATRIVSMPCRERFEALTETERAALFPKGVPVVAVEAGVTRGWRGLTGTREEGVTVIGIDRFGESAPEKDLWPLFGFTVEKVAEAVRRAVG

SEQ ID NO: 43653 - protein, 385 aa, Populus alba
MAIDCIKTMPSITTPHHHPKDQDQCKDDGKSFVFDAQVLRHQTNIPQQFIWPDHEKPNTNAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEESSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYRSCLHRAVVNSQTPRKSLAFFLCPKNDKMVTPPHELVDTCNPRIYPDFTWPMLLEFTQKHYRADMKTLEVFTNWLHQRSLS

SEQ ID NO: 43654 - protein, 371 aa, Xanthobacter autotrophicus Py2
MTTRRTGRAEKTLRETTAMPTADHRAAPGITLACALEEWAGEDARRRDVAATLNALAAGTIQIARAIAEGPLAGDLARTLSSGEAGEGQKALDIISNDMVIDALRKAPVAAVASEENDAPVLLDPEAPLLVAIDPLDGSSNIDTDISVGTIFAVFPHQDGTDAASVTAFLQNGRDMLAGGYVIYGPHTALMLTVGAGTWHFALDRDGSFRLVNAAVRVKEDAAEFAINMSNYHHWDDPIRAYVDDCLAGRKGPREREFNMRWVASMVADAHRIFQRGGIYLYPGDGRKGYTHGRLRLLYEAFPVAFLMEQAQGSAIDGRSSILDLSATGVHQRVPFIFGSRDEVARAARYHLEPSGHGERSPLFARRGLFI

SEQ ID NO: 43655 - protein, 391 aa, Pseudomonas viridiflava
MEQQCDVAVLGLGAMGAATLYQLTREGADVLGIDQYAPPHTQGSSHGDTRITRLSVGEGPQYLPLVRNSHRIWRELEALTGESLFEQCGVLVMTSSPAYDPNDPEDFTHKTIALAREYGVKHEVLSAGAIRERFPQFSPVLDTAIGYFEPDGGFVRPERCIEVHLQLARKLGARIRMNETVTRLQAHGDQVRITTDQGSIIANKVVVSAGMWSSQLLGEPFTDLLRVCRQQLFWFALEDTAAFAPISPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGTSDVDLSAFSLKRFGKTA

SEQ ID NO: 43656 - protein, 391 aa, Pseudomonas viridiflava
MEQQCDVAVLGLGAMGAATLYQLAREGADVLGIDQYAPPHTLGSSHGDTRITRLSVGEGPQYLPLVRNSHRIWRELEALTGESLFEQCGVLVMTSSPAYDPNDPEDFTHKTIALAREYGVKHEVLSAGAIRERFPQFSPVLDTAIGYFEPDGGFVRPERCIAAQLQLAGKLGARIRLNETVTRLQAHGDQVRITSDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFQTQVSGKIAGIKADVVKSSVCAYTVTPDYHFIMDDHPHLKNVTVVSACSGHGFKHSAGLGLALAQRCLRGTSDVDLSAFSLKRFGKTA

SEQ ID NO: 43657 - protein, 638 aa, Cryptococcus neoformans var. neoformans JEC21
MNRNCSSSTPTSSHSPQQSEHKRRWWDDLTFTKCKKMFLRHLHFVGPGLVSSVAYIDPGNWATDLEAGADYGYKLLFVVLLASLAAVVLQLLSVRLGTTTGLSLPAQTRLLFLRLKSRYPRYRIPLTIALWTLYALAEIAIIATDLAELLGSAIALHLLFPKLPLFAGVLITAVDVLVVLVFFRSSSGRQGMMFFEIIIVSLVLAVFISFMILLKLTSPVWRDVFLGLVPSETLVKPGALYLGVGIIGATVMPHALFLGSFLSGVDRLNMIPQPPSMRKPRNVTMPSFNPFRRTRSIRSDSEQGEGVSTGISPVLLQAPRPSSGSEAAVLENDGAKDEVHLQDSVVELTKEEKLFAIEQKEYERNVRMFDRIKWVDVHLFHSTIDTAISLLSFALTINASILTLAGAVYYYNESPPSEGADLFGAFDLIKSYISHAAAIVFALALLCAGQSASITATLAGQVVSEGFINWKTSPFLRRLITRLLGVIPSAVVASAVGTKGLNTMLVASQVLLSIVLPTVVFPLVYLCSKHEIMTVQGPEVESIEMERIANSGASVSDPFALAATTPSLSPTTLGDDLAALGIESTTVRVEPDQSVDRPSRRSKSYVSPKWVTVLGYVLFVVIVLANVYVIVELCLGNG

SEQ ID NO: 43658 - protein, 122 aa, Glycine max
  misc_feature (117)..(117): Xaa can be any naturally occurring amino acid
  unsure (1)..(122): unsure at all Xaa locations
EQHGFARNKIWFIEKDPPSLAGDFNGKVYIDLLLKPSEDDMKIWPHRFEFRLRVSLAADGNLTLTSRIRNVNGKNFSFSIAYHTYFSVSDISEVRVEGLETLDYLDNLHQKERFTEXGDALT

SEQ ID NO: 43659 - protein, 391 aa, Pseudomonas viridiflava
MEQQCEVAVLGLGAMGAATLYQLARQGADVLGIDRYAPPHTQGSSHGDTRITRLSVGEGPQYLPLVRHSQRIWRELEALTGESLFEQCGVLVMTSSPTYDPHDPEDFTHKTIALAREYGVKHEVLSAGAIRERFPQFSPILETAIGYFEPDGGFVRPERCIAIQLQLAEKLGARIRMNETVTRLQPQGDQVRITTDQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFKTQVSGKIAGLKAEVVKSSVCAYTVTPDYHFIIDDHPHLKNVTVVSACSGHGFKHSAGLGLALAQRCLRGTSDVDLSAFSLKRFGKTA

SEQ ID NO: 43660 - protein, 74 aa, Herbaspirillum seropedicae
LPVKSVGVMGDGRTYEYVVALRAVQTQDFMTAHWAHLPHELLGRVSNRIINEVRGLNRVVYDISGKPPATIEWE

SEQ ID NO: 43661 - protein, 445 aa, Photobacterium profundum SS9
MIGFLKSEQHVQPVKDPKQIDELYKYWRFHIMLTMYAGYALFYFTRKSFNYAMPAMIADLGLDKSDIGLMGTLFYITYGVSKFLSGIVSDRSNPRYFMGIGLVMTGIVNILFGFSSSIVMFTLLWMTNAWFQGWGWPSCSKLLTTWYSRSERGFWWSLWNTAHNVGGALIPLLVGVVTLHYGWRYGFIIPGILAVFVGLFLCWRLRDKPVTLGLPTVGHWRNDALELAQENEGLGLTNTEILKKYVLNNKYIWLLAFSYVLVYIVRTAINDWGNLYLTEQHHYSLITANAALSLFEVGGFVGSLVAGWGSDKIFDGNRGPMNLIFAIGIFLSVAALWLMPMTGFVLQAGCFFAIGFFVFGPQMLIGMAAAECSHKDSVGAATGFVGLFAYMGAALAGYPLALIMEQYHWAGFFTVISCAAAVVGLLLLPFLKAQTSDVSAAAIPK

SEQ ID NO: 43662 - protein, 391 aa, Pseudomonas viridiflava
MEQQCEVAVLGLGAMGAATLYQLARQGADVLGIDRYAPPHTQGSSHGDTRITRLSVGEGPQYLPLVRHSQRIWRELEALTGESLFEQCGVLVMTSSPAYDPHDPEDFTHKTIALAREYGVKHEVLSAGAIRERFPQFSPILETAIGYFEPDGGFVRPERCIAIQLQLAEKLGARIRMNETVTRLQPQGDQVRITTDQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFKTQVSGKIAGLKAEVVKSSVCAYTVTPDYHFIIDDHPHLKNVTVVSACSGHGFKHSAGLGLALAQRCLHGTSDVDLSAFSLKRFGKKA

SEQ ID NO: 43663 - protein, 263 aa, Arabidopsis thaliana
DRHEQDATTNPSLILAATRNPGYARLIDIAVAYGKAQGGTIDEQIDATLDRLLVEFGKEILNVVPGKVSTEVDAAFSFSITGSVEKALHIIKLYKSINIDKSRILIKIASTWEGIQAARILQRDHGINVNLTLMFSQVQAIAAAEAGAFLISPFVGRILDWHKAKTGKTYSKEEDPGVESVKNIFNYYKKFGYQTIVMGASFRNVGEITELAGCDYLTISPNLLEELSASHEPVHKKLDASTATSLNIEKKSYIAYESNFRFD

SEQ ID NO: 43664 - protein, 125 aa, Listeria monocytogenes str. 1/2a F6854
MAKEIIQTSSAPKALGPYSQAVKVNGLIFTSGQLGINPENGELAEGATKQAEQAFKNLAAVLEEAGSGLEKIIKATVFFKDLKEFTAVNEVYATFFSSDFPARSAFQVAKLPLDAEIEIEVIAEA

SEQ ID NO: 43665 - protein, 485 aa, Photobacterium profundum SS9
MFITFSKQAYFEQICRGFHMFKLLEQVRKPTLDLPVDERRKMWFKPFLQSYLVVFIGYMAMYLIRKNFNVAQNDMISTYGLSMTELGLIGLGFSITYGIGKTAVSYYADGKNTKQFLPFMLILSGIAMLGFSVSMGGSGVSLFLMIAFYGLSGFFQSTGGPSSYSTITKWTPRNKRGSYLGLWNMSHNVGGAAAAGVALFGSNYLFGGHVIGMFVFPSIIAIVLGFIGLRYGNDSPEAYGLGTAEELFGEAASAEDLEAEENQMTKREIFMEYVLKNKVIWLLCFANIFLYVVRIGIDQWSTVYAYQELGLSKETAITGFTLFEVGALVGTLMWGYLSDLANGRRAIVACVSLVLIIFTLEFYQNATNEYMYLGSLFALGFLVFGPQLLIGVAAVGFVPKKAISVADGVKGTFAYLIGDSFAKLGLGMIADGTPIFGLTGWKGTFAALDTSAAICIVLLLFVAIAEEKKIRHEKRRLQQLATDAA

SEQ ID NO: 43666 - protein, 391 aa, Pseudomonas viridiflava
MEQQCEVAVLGLGAMGAATLYQLARQGADVLGIDRYAPPHTQGSSHGDTRITRLSVGEGPQYLPLVRHSQRIWRELEALTGESLFEQCGVLVMTSSPTYDPHDPEDFTHKTIALAREYGVKHEVLSAGAIRERFPQFSPILETAIGYFEPDGGFVRPERCIAIQLQLAEKLGARIRMNETVTRLQPQGDQVRITSDQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFKTQVSGKIAGLKAEVVKSSVCAYTVTPDYHFIIDDHPHLKNVTVVSACSGHGFKHSAGLGLALAQRCLRGTSDVDLSAFSLKRFGKKA

SEQ ID NO: 43667 - protein, 132 aa, Brassica napus
MTMIRSISMLTLLVTLAASISMVSSASSADFVKKTISSHKIVIFSKSYCPYCRRAKSVFSELNQVPHVVELDEREDGGSIQSALGEIVGRRTVPQVFINGKHIGGSDDTVDAHESGELAKLLGVSENTRAEL

SEQ ID NO: 43668 - protein, 594 aa, Zea mays
  misc_feature (242)..(242): Xaa can be any naturally occurring amino acid
  misc_feature (318)..(318): Xaa can be any naturally occurring amino acid
  unsure (1)..(594): unsure at all Xaa locations
GYLEAGRAPPPLSREQQTASPSKSNPTVPLLRAGPGLHRLPGAVHSPHSTSFYKYTSVSVPHNIRSPPSASLPPASPTNETPAPWGAFAKEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMGKILPEGIGEVQEIIDMCDYAVGLSRQLNGSIIPSERPNHMMMEVWNPLGXVVGVITAFNFPCAVLGWNACIALVCGNCVVWKGAPTTPLITIAMTKIVASVLEKNNLPGAIFTSFCGGTEIGQAIXLDIRIPLVSFTGSTRAGLMVQQQVSARFGKCLLELSGNNAIIVMDDADIQLAVRSVLFAAVGTAGQRCTTCRRLILHENIYQTFLDQLVEVYKQVRIGDPLEKGTLLGPLHTPASKENFLKGIQTIKSQGGKILFGGSAIESEGNFVQPTIVEITPSAPVVKEELFGPVLYVMKFQSLKEAIEINNSVPQGLSSSIFTKRPDIIFKWLGPHGSDCGIVNVNIPTNGAEIGGAFGGEKATGGGREAGSDSWKQYMRRATCTINYGSELPLAQGINFG

SEQ ID NO: 43669 - protein, 1075 aa, Salmonella typhimurium
MPKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLEEFGVTMIGATADAGDKAEDRRRFDIAMKKIGLDTARSGIAHTMEEALAVAADVGFPCIIRPSFTMGGTGGGIAYNREEFEEICERGLDLSPTNELLIDESLIGWKEYEMEVVRDKNDNCIIVCSIENFDAMGIHTGDSITVAPAQTLTDKEYQIMRNASMAVLREIGVETGGSNVQFAVNPKNGRLIVIEMNPRVSRSSALASKATGFPIAKVAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKDAGADRIWYIADAFRAGLSVDGVFNLTNIDRWFLVQIEELVRLEEKVAEVGITGLNADFLRQLKRKGFADARLAKLAGVREAEIRKLRDQYDLHPVYKRVDTCAAEFATDTAYMYSTYEDECEANPSIDRDKIMVLGGGPNRIGQGIEFDYCCVHASLALREDGYETIMVNCNPETVSTDYDTSDRLYFEPVTLEDVLEIVRIEKPKGVIVQYGGQTPLKLARALEAAGVPVIGTSPDAIDRAEDRERFQHAVDRLKLKQPANATVTAIEQAVEKAKEIGYPLVVRPSYVLGGRAMEIVYDEADLRRYFQTAVSVSNDAPVLLDRFLDDAVEVDVDAICDGEMVLIGGIMEHIEQAGVHSGDSACSLPAYTLSQEIQDVMRQQVQKLAFELQVRGLMNVQFAVKDNEVYLIEVNPRAARTVPFVSKATGVPLAKVAARVMAGKSLTEQGVTQEIIPPYYSVKEVVLPFNKFPGVDPLLGPEMRSTGEVMGVGRTFAEAFAKAQLGSNSTMKKQGRALLSVREGDKERVVDLAAKLLKQGFELDATHGTAIVLGEAGINPRLVNKVHEGRPHIQDRIKNGEYTYIINTTAGRRAIEDSRVIRRSALQYKVHYDTTLNGGFATTMALNADATEKVTSVQEMHAQIKKS

SEQ ID NO: 43670 - protein, 551 aa, Haemophilus somnus 2336
MTALFTTAQNWLAQDPDAETRAELQTLLNQAKAGDMNAQKELHNRFNGRLQFGTAGLRGRLQAGSMGMNRVLVAQAAGGLAEYLKGYDSEPSIVLGYDGRKNSDVFVRDTAEIMAGAGIKTFLLPRKLPTPVLAYAIKHLNTTAGVMVTASHNPPEDNGYKVYLGKANGGGQIVSPADVDIAKLIDKVANGDIRDLPRSQHYTVLDDEIVEAYIAKTASIAKEPQANINYVYTAMHGVGYEVLSKTLAKAGLPQPHLVEEQIQPDGSFPTVNFPNPEEKGALDLAIKLAKAKNAEFIIANDPDADRLAVAVPDSEGNWKPLHGNVIGCFLGWYLAKQYHAQGKQGKLACSLVSSPALAEIAKKYGFQSEETLTGFKYIGKVNDLLFGFEEALGYLVDPDKVRDKDGISAAIAFLDLVRSLKKEGKTLTDYANDFTAEFGAYVSGQISIRVNELSDIGKMMTALRKEPLTELGGFVTQFIDHSKTDRASDILVFVLENGSRLIVRPSGTEPKVKFYLDVCGTDPKNADEVLAEFDENVRQILRQEKYGKQDC

SEQ ID NO: 43671 - protein, 338 aa, Desulfovibrio vulgaris subsp. vulgaris str. Hildenborough
MRKTRIGINGFGRIGRQVFRAIHERYGDKAEVVAINDLFDAATNFHLLEYDTNYGRAPFTPEVDGNMARVGDWQVTCFAQRDPAQLIWGDVGVDVVIESTGIFRSAKQAHVHIENGAKKVIISAPAKEEDITIVMGVNHHAYDPQKHHVVSNASCTTNCLAPVALIIQEKYGIATGAMTTVHAYTNDQRILDLPHKDLRRARAAGLNIIPTSTGAAQAVAKVIPELKGKFTGYSLRVPIPTVSVVDFTAILERDATTEGLRADLKEAAQGRLSGILAFSEKPLVSSDFKGDPHSSIVEAEYTTVQDGRLAKVVAWYDNEWGYSCRLADLIMLMQEKGL

SEQ ID NO: 43672 - protein, 374 aa, Zea mays
MAIPLVLVVLPLGLLFLLSGLIVNAIQAVLFVTIRPFSKSFYRRINRFLAELLWLQLVWVVDWWAGVKVQLHADEETYRSMGKEHALIISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDEDVSKWCKDIFVAKDALLDKHLATGTFDEEIRPIGRPVKSLLVTLFWSCLLLFGAIEFFKWTQLLSTWRGVAFTAAGMALVTGVMHVFIMFSQAERSSSARAARNRVKKE

SEQ ID NO: 43673 - protein, 1113 aa, Oryza sativa (indica cultivar-group)
MEIPAVESSAAGRMPPRIRRRLLEGSRVGGGAPTSAEEIEAKLKEAELRRQQFHEWVSCKARKKPRSPSWSSQEEDQGQRLEAKLQAAEQKRLSLLAKAQNRLAKLDELRQAAKNIVEMRIEKEREELGTRVESRVRQAEANRMRLLHAHMQKRAAMKERTARSLVRKQTSERKYTERVKSLILQKRNAAEKKRLALLEAEKRKAQARILHIQRAAKTVCSKRESERRQLQEQLESKLQKAKRQRAEYLKQRVSPRSSAHADYIKHAEFLSTKLARCWKRFLKSNKTTYALVQAYDALGINEMSVKSMPFENLAMLMESPTTLQTTKAVLDRFEKRLLLSQPTGSSSAENIDHLLKRLGSPKRKAPASRSRVAAKKPAKGSETSKLSRYSLRVVLCSYMILAHPGAVLSGQGEKENLLMESAENFVKEFELLVKTVLDRPGGASTQSTDAASQKKFRTQLAAFDKAWCAYLYHFVVWKLKDAKSLEQDLVRAACKLELSMMQTCKLSSDGQSHDLSHDMKAIQKQVTDDQKLLREKIQHLSGDAGIERMNSALSDTRSKFFEAKENGNPLATSVANVSTPLSINSSGQVPNPTSKPTVEGSSFTAQSLPGAASSSSSTSPMKPPTDNEQMVNEMLHEDDVSFARNSDNVSSAEKDFQAKVKATMEKAFWDLVTDSMRGDKPDNSQLINLVKEVRNSLHELASNELKEEILENIDLEILSQVLQSGSQDTRYLGQILQYSLDMVRKLSAPAKEDDMKRSHEKLLNELAASSEVNDNGISSFVIAVIKGLRFTLEEIKQLQTEVSKARIQLMQPIIKGSAGVEYLQKAFTDRYGPPANASVSLPITKQWVSATKSIVEQEWSSHLESLQALPADHAQHVVPVLRAGHGAPAPQASSSAASSSGLPECKGEKIDKLTRVGLLQLISNVEGLNMQSTPETFQINLLRLRAVQDQFQKVIVIATSMLVLRQVLMSKIAPPELQNTISELYDALVKLLDNNADASTKEIVEAMTRSLASVGSLPEEQIQDTTELATKMLLKSLQAGDIVFGKVSRAVYFAFRGVVLGGGAKGKKLAEAPLLRLGAAKLADRVVKAGEVLIKMAVISEKVHGPWYKALAL

SEQ ID NO: 43674 - protein, 802 aa, Oryza sativa (indica cultivar-group)
MAVAAMELPAVRAYDALGINETSVKSMPFENLATLMQSPATLQATKAVLDRFEKLLPLLSSPVINIDHLLKHLGSPKKKKTPPPAAASASRYSLRVVLCSYMILAHPGAVLSGQGEKEKLLMDSAGSFVKEFELLVKTVLEKQSTDAAAGQKMFSAQLADFDRAWCAYLYCFVVWKLKDAKSLEDDLVRAACKLERSMMQTCKLSSDGQSHNGLSHDMKAIQKQVADDQKLLREKVHQLSGDAGIERMNSALSDTRSKFFEAKENGNPLAASVANVSTPLSIGSSGSSFTAQSLPGAASSSSSSSLMKQPTDNEQMLNEMLHEDDVSFGGNSDNVSSAEEFQAKVKSTMEKAFWDLVTDSMKGDKPDYTQLINLVKEVRDSLHELASKELKEEILENIDLEILSQVLESGSQDTRYLGQIMHYSLDMIRKLSAPAKEDDMKKSHEKLLNELAASSEVNDNGISSFVIAVIKGLRFTLEEIKQLQSEVSKARIQLMQPIIKGSAGVEYLQKAFADRYGPPANASASLPITKQWVSATKSIVEQEWSSHLESLQALPADHAQRVVVPALRAGHGAPMAQASSSAASGSGLPECKGEKIDKLTRVGLLQLISNVEGLNMQSTPETFQINLPRLRAVQDQFQKVIVIATSILVLHQVLVSKVAAPELQNAISELYDALVKLLDSNPDASTEEIVEAMASSLATVGSLSLPEKQAQATAELATKMLLKSLQAGDVVFGKVSRAVYCAFRGVVLGGGGVKGKKLAEAPLRRLAAAKLADRVVKAGEVLVKMAAISEKVHGQWYKALAL

SEQ ID NO: 43675 - protein, 409 aa, Zea mays
MRGTMPATDSSSSSSPAAAPLSSIGRSIRSLRRDQNQIHSFPPPPDATDAFQRRAAQLLADLPAADDVLSLAWTRRLLESFLLCLEEFRALLFGSGDSPAARPPLDRLVADFSDRAVKALDLCNAVRDGLDLVRQWRKHLAIAAAVLASSSDSSSPLGEAQIRRARKALTDLTILMLDDRDGGGVVGQRNRSFGRANEKPPRHHRRSSSGGSSGSGSGSHLRSLSWSVSRAWSAARQLQAIGGGLPVPRPHDNAATGGLASAVYTMGAVLFIVAFALVAAIPCQDRGLHAHFSVIRNLPCSAPITTLYERILDESKKKDRKNSCGLLKEIHQIELCSRHLMEITDAADFPLREDKDAVLREAAQDLVHLCESIKEGLDPLERQVREMFHRIVRTRTEILDCLSKPHGTG

SEQ ID NO: 43676 - protein, 387 aa, Pseudomonas putida GB-1
MSIQVEDYFARDTFQKMKAFADKQETPFVLIDTQMISQAYDDLRAGFEFAKVYYAVKANPAVEIIDLLKEKGSSFDIASIYELDKVMDRGVSADRISYGNTIKKSKDIRYFYEKGVRLYATDSEADLRNIAKAAPGSKVYVRILTEGSTTADWPLSRKFGCQTDMAMDLLILARDLGLVPYGISFHVGSQQRDISVWDAAIAKVKVIFERLKEEDGIELKLINMGGGFPANYITRTNSLETYAEEIIRFLKEDFGDELPEIILEPGRSLIANAGILVSEVVLVARKSRTAVERWIYTDVGKFSGLIETMDEAIKFPIWTEKKGEAEEVVIAGPTCDSADIMYENYKYGLPLNLAIGDRLYWLSTGAYTTSYSAVEFNGFPPLKAYYL

SEQ ID NO: 43677 - protein, 316 aa, Shigella flexneri 2a str. 301
MNELDGIKQFTTVVADSCDIESIRHYHPQDATANPSLLLKAAGLSQYEHLIDDAIAWGKKNGKTQEQQVVAACDKLAVNFGAEILKIVPGCVSTEVDARLSFDKEKSIEKARHLVDLYQQQGVEKSRILIKLASTWEGIRAAEELEKEGINCNLTLLFSFTQARACAEAGVFLISPFVGRIYDWYQARKPMDPYVVEEDPGVKSVRNIYDYYKQHHYETIVMGASFRRTEQILALTGCDRLTIAPNLLKELQEKVSPVVRKLIPPSQTFPRPAPMSEAEFRWEHNQDAMAVEKLSEGIRLFAVDQRKLEDLLAAKL

SEQ ID NO: 43678 - protein, 391 aa, Pseudomonas viridiflava
MEQQCDVAVLGLGAMGAATLYQLAREGADVLGIDQYAPPHTLGSSHGDTRITRLSVGEGPQYLPLVRNSHRIWRELEALTGESLFEQCGVLVMTSSPAYDPNDPEDFTHKTIALAREYGVRHEVLSAADIRERFPQFSPVLDTAIGYFEPDGGFVRPERCIAAQLQLAGKLGARIRLNETVTRLQAHGDQVRITSDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGTSDVDLSAFSLKRFGKTA

SEQ ID NO: 43679 - protein, 165 aa, Zea mays
MDSVMYIRCRSGSALLAITVELPHHGLALKEQISSTKIPARLKSGSGLCSACENFTSEAVTYLGKEQTQDRIMEFLHDACSQSFSFEQKFFSNNFPISQCVELMDSYATLLFAKITEIRPEAFCKRYGLCRDTALLSGVGSDSTCVFCHHLLDEIMSKLKDPDAE

SEQ ID NO: 43680 - protein, 151 aa, Triticum aestivum
MRLLAALLLFAAAAVAASSSSSAAAELPEFREAPAFRNGAGCAGAPTIHIAMTLDGTYLRGSLAGVLSVLRHAACPESIAFHFVASSASPARRLARLRAALAAAFPTLPATVHRFDARLVRGKISSSVRRALDQPLNYARIYLADILPRSV

SEQ ID NO: 43681 - protein, 333 aa, Vibrio cholerae O1 biovar eltor str. N16961
MAIKVGINGFGRIGRLALRASFDWPEIEFVQINDVAGDAATLAHLLEFDSVQGRWHHAVGSEADAILINGKRIRTTQEKSIDAVDWSGCDVVIEATGKHRKGEFLNQYLAQGVKRVVVSAPVKEEGIANIVVGVNDHIFNPEQHRIVTAASCTTNCIAPVVKVIHEKLGIAQASFTTIHNLTNTQTILDAPHKDLRRARACGMSLIPTTTGSAKAIIEIFPDLKGKIDGHAVRVPLANASLTDIIFDVQRDTTVEEINQLLKQASENELKGILGFEERPLVSIDYQGDQRSTIVDALSTMVVGKRMVKIYTWYDNEMGYATRTAELVRKVGLA

SEQ ID NO: 43682 - protein, 319 aa, uncultured archaeon
MKLKTLKGVYPALITPFKKNGEIDEDGFRRNIDYVIEGGVDGIVPCGCTGEAATLRFEEQKKLLEIAVDQVDRNKRKVPVIGGSGSNNTQEALELTQYAKEAGAAAAMLITPYYNKPMPAGQILHYRTIAAKAEMPIILYNVPGRTGTNMLPETIAELAKDEFIVGVKEASGNMEQVEKIIELTRDYRKKFTVLSGDDNLTLPIMAMGGKGVVSVLANIMPKEMCTIVRYYEEGNHDKAIDMYYKIAPIMKAMFIETNPIPVKAAANMMGIAAGSLRLPLTEMAPENQKKLRGLLEAYGVKLGGKVAPKAAPVKKTARK

SEQ ID NO: 43683 - protein, 297 aa, Trichodesmium erythraeum IMS101
MLPNYQSLPKNRIVIKSELQNSTIWDLIKPRNTDIVISSCYKSGTTLTQQIVNLMVNGHDDFESLHDLSPWVEEIFITPPENKKSWIESLSSPRILKSHLLFEALPCYPEWKYIYLVRDGRDVGLSLYHHYQSFLPEYFHENLPQDFAAFWDDFVETKEDKNQYWSYWKHIKSWWQVRNLPNVLLVHYHNLIYDKSQEIDRISEFLNLNINSSKKEMVLEKSSLEYMKSNWQKFQQKGVFQPNTFINKGVNGRWHNLLTTEQLKRYDIIMSEELETECAKWVKNAGFLPEINSIAFD

SEQ ID NO: 43684 - protein, 391 aa, Mesostigma viride
MLQTKTDPMVISMGPHHPSMHGVLRLIVTLDGENVIDCEPVLGYLHRAMEKIAENRTIVQYLPYVTRWDYLATMFTEAITVNAPEKLANIEVPKRASYIRVIMLELSRIASHLLWLGPFMADIGAQTPFFYILREREMIYDLFEAATGMRMMHNYFRIGGVASDLPYGWVDKCLDFSDYFLPKVDEYERLITNNPIFLKRVRDVGFISREEAINWGLSGPMLRASGVQWDLRKVDNYECYGELDWNVQWQSDGDCLARYLVRLGEMRESTKIIQQALKAIPGGPYENLEARRLSKGRKSEWNNFEYQFVGKKPSPTFKIPKQEHYVRVEAPKGELGVFLMGDDNVFPWRWKIRSPGFINVQILPELVRGMKLADIMTILGSIDIIMGEVDR

SEQ ID NO: 43685 - protein, 528 aa, Gibberella zeae PH-1
MSFQPTQIFEEGTTEEKGENARLSAFVGAIAVGDLVKSTLGPKGMDKILQSASTAEIMVTNDGATILKSIALDNAAAKVLVNISKVQDDEVGDGTTSVAVLAAELLREAEKLVDKKIHPQTIIEGYRIASHAALKALEGSAVDHSKNPEAFRQDLLAIARTTLSSKVLAQDRNQFAELAVDAVLRLRSSDLNHIQIIKKAGGKLSDSYLDEGFILDKKIGVNQPKRLEKAKILVANTSMDTDKVKIFGARVKVGSTSKLAELEKAEKDKMKAKVEKIKAHGINCFINRQLIYNWPEQLFTDAGIMSIEHADFDGIERLALVTGGEIASTFDHPEQVKLGHCDTIEEVIIGEDTLIKFSGVSGGEACTIVLRGATEQLLDEAERSLHDALAVLSQTVKEPRTTLGGGCAEMLMAKAVEGAATRVEGKRQLAVQSFAIALRQLPTILADNAGLDSGDLVARLRKALYDGLTTYGLDLMTPGGGITDMRDLGVIESYKLKKAVVSSASEAAELLLRVDDIIRAAPRRRERI

SEQ ID NO: 43686 - protein, 498 aa, Zea mays
MGKRGKWFSAVKKVFSSSDPDGKEAKAQKADKSKSKRRWPFGKSKHSEPSISTVPGTAPAVAPLPSPPATQPHSLEIKDVNPVETDSEQNKHAYSVALASAVAAEAAAVAAQAAAEVVRLTAVTTAAPKMPVSSREELAATKIQTAFRGYLARRALRALRGLVRLKSLVDGNAVKRQTAHTLQCTQAMTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRAPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 43687 - protein, 89 aa, Arabidopsis thaliana
MQTDTASVLLEGMQYIQFLQEQVKCSLSASNPFYYRVEEYSLRSKGLCLVPLEYTSEVAQTNGADIWAPVKTPTSSHAFNLSSSNSPFQ

SEQ ID NO: 43688 - protein, 245 aa, Desulfovibrio vulgaris subsp. vulgaris str. Hildenborough
MQGWVISLGWPFIWSRRRETIRLNDQDRGHSMPQRDLDRFIAGFRRFQRNYFCHDHNLFESLREGQAPRALVIACSDSRVDPAHLTDCNPGDLFVIRNVANLVPPYGPDANFHGVSAAIEYAVTCLDVEHIIVLGHACCGGIHSLMQQAEGQGEFIGPWMGIARRARMQVLESLPHATPEVQERACEQAALLVSLENLLTFPWIAKRVEEGTLALHGWFFDMEKGKLLRYDGDEDSFVELVTACA

SEQ ID NO: 43689 - protein, 265 aa, Arabidopsis thaliana
MALAYDPLFITSDKSLSAFDVASSPPQPMNLTQDELKRIAAYKAVEFVESGMVLGLGTGSTAKHAVDRIGELLRQGKLENIVGIPTSKKTQEQALSLGIPLSDLDAHPVIDLSIDGADEVDPFLNLVKGRGGSLLREKMIEGASKKFVVIVDDSKMVKHIGGSKLALPVEIVPFCWKFTAEKLRSLLEGYGCEANLRLGEKGKAFVTDNGNYIVDMHVEEDMGDLGAVSDAILRLPGVVEHGMFLDMASTVIIAGELGVKIKNKH

SEQ ID NO: 43690 - protein, 335 aa, Geobacillus stearothermophilus
MAVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 43691 - protein, 1021 aa, Symbiobacterium thermophilum IAM 14863
  misc_feature (195)..(195): Xaa can be any naturally occurring amino acid
  unsure (1)..(1021): unsure at all Xaa locations
MNLNRREFLRLSGVSAAGAALLLFAEEREALARDLKESRIARAKEVPSVCPHCSVGCGLIGYVREGQLLQVEGNPDSPVSEGSLCPKGAATMQFAYDGVGRPNPLRQLTAKIRRPGSDRWEEIGIEEALDRIARRIKETRDASFVERNADGLVVNRTESIAHIGSACIDNEECYLVTKLMRALGVVYLEHHARIXHSSTVPGLGTSFGRGAMTTALWDIPNADVVVFMGSNAAENHPISFKWFLRAKQKGATVICVDPRYNRTASKADWWIPFRSGTDTAVLGGLINYAITHNKFHREYVVKYTNASLLVHPDFRFDDGLFSGWDPEAKKYDQSTWAFQTGPDGQPLSDPTLEHPQCVFQHIKRIYAEYTPEKVSEISGIPVDDFIKFAETVCATGTAGKSAVFVYAMGWTQHTKGVQNIRTATILQMLLGNIGVAGGGIAALRGHANVQGATDLAVLYHDLPGYLGQPTEAHKSLSDFLAKTTTKNSYWENKPKFLISLLKAWWGEHATAENDFCFDYLPKMAAGETYSHYDIFQSILDGRVKGLIVVGQNPAVGSANARKVQAALAKLDWLVVSDLFLNETSEFWKLEGMNPAEIQTEVILLPAAGPLEKEGSFTNTHRLIQWKHKMIEPMGESHSDGWYMVQIGKRLKQLYADSTAAKDLPIKHLVWDYDDPDNPNEFDHLKVLKEINGYDVATGKPVSGFGALQDDGSTACGCWIYSGIYPEEGVNKADARLRAAPNRPDGWTEAKADGSADYLHLGWGFAWPANRRVIYNRASADPSGKPWSKVPLVWWDEAEGKWTGVDVPDMLPVAPGQVHAVGVPGDTPFIMKAWGLGGIWGPLPDGPLPVHYEPMESPTPNLLYRKQGTIPTMKIYDSEFDLFGDPERFPYVATTYRLTEHLTSGVMTRTLPYLAEAFARHFCEIPRELAQREGIRNGDWVEVESARGKVRVQAMVTNRLRPLRIGGRETFLIGLPIHWAPNSGHVQGDITNTLTPQAVDVNVQIQESKVFLANLRKVSVGG

SEQ ID NO: 43692 - protein, 434 aa, Zea mays
TRPTLSTSMVSSASASVFSTVATCTTSVKTFSLAQLQKATDGFDSRRVLGQGGFGRVYHGTIEDGNEIAVKLLTREDRSGDREFIAEVEMLSRLHHRNLVKLIGICIERSKRCLVYELIRNGSVESHLHGADKAKGKLNWDVRMKIALGAARGLAYLHEDSNPHVIHRDFKASNILLEEDFTPKVTDFGLAREASNATQPISTRVMGTFGYVAPEYAMTGHLLVKSDVYSYGVVLLELLSGRKPVSISESKDPENLVTWARPLLSHKEGLEKLIDPSLEGNFNFDNVAKVASIASMCVHADPSQRPFMGEAVQALKLIYSDPDEACDDSYSPRNSSDQDGGYDGDLVFGSGSWGFGASGSGCLDYRNSLPFVTMDYSSGRIEGPRDPRAALSAGSHAQPPVLQNRSGPLRVKKKLAASYRSRGSVSEHGHLPRH

SEQ ID NO: 43693 - protein, 123 aa, Treponema pallidum subsp. pallidum str. Nichols
MSCHLIQQIENQQRKEPAETFRVGDTVRVHFKIVEGKTERIQAYEGLVLCFKNSGVRRTFTVRKNSYGVGVERIFPLHSPRIERVDVVRAGKVRRAKLYYIREKIGKAARIKARIVKKPSPSA

SEQ ID NO: 43694 - protein, 391 aa, Pseudomonas viridiflava
MEQQCEVAVLGLGAMGAATLYQLARQGADVLGIDRYAPPHTQGSSHGDTRITRLSVGEGPQYLPLVRHSQRIWRELEALTGESLFEQCGVLVMTSSPTYDPHDPEDFTHKTIALAREYGVKHEVLSAGAIRERFPQFSPILETAIGYFEPDGGFVRPERCIAIQLQLAEKLGARIRMNETVTRLQPQGDQVRITTDQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFKTQVSGKIAGLKAEVVKSSVCAYTVTPDYHFIIDDHPHLKNVTVVSACSGHGFKHSAGLGLALAQRCLHGTSDVDLSAFSLKRFGKKA

SEQ ID NO: 43695 - protein, 540 aa, Oryza sativa (japonica cultivar-group)
MEEAHAMPVTSFFPVAGIHKLIAIFLVVLSWILVHKWSLRNQKGPRSWPIIGATVEQLKNYHRMHDWLVEYLSKDRTVTVDMPFTSYTYIADPVNVEHVLKTNFTNYPKGEVYRSYMDVLLGDGIFNADGEMWRKQRKTASFEFASKNLRDFSTVVFREYSLKLSSILSQACKAGRVVDMQELFMRMTLDSICKVGFGVEIGTLSPDLPENSFAQAFDAANIIVTLRFIDPLWRLKKFLHVGSEALLEQSMKLVDDFTYSVIRRRKAEILQARASGKQEKIKHDILSRFIELGEAGGDEGGGSFGDDKSLRDVVLNFVIAGRDTTATTLSWFTYMAMTHPAVADKLRRELAAFEDERAREEGVALADAAGEASFAARVAQFASLLSYDAVGKLVYLHACVTETLRLYPAVPQDPKGIVEDDVLPDGTKVRAGGMVTYVPYSMGRMEYNWGPDAASFRPERWLSGDGGAFRNASPFKFTAFQAGPRICLGKDSAYLQMKMALAILFRFYTFDLVEDHPVKYRMMTILSMAHGLKVRVSTSV

SEQ ID NO: 43696 - protein, 391 aa, Pseudomonas viridiflava
MEQQCDVAVLGLGAMGAATLYQLAREGADVLGIDQYAPPHTLGSSHGDTRITRLSVGEGPQYLPLVRNSHRIWRELEALTGEFLFEQCGVLVMTSSPAYDPNDPEDFTHKTIALAREYGVKHEVLSAGAIRERFPQFRPVLDTAIGYFEPDGGFVRPERCIAAQLQLAGKLGARIRLNETVTRLQAHGDQVRITNDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGTSEVDLSAFSLKRFGKTA

SEQ ID NO: 43697 - protein, 391 aa, Pseudomonas viridiflava
MEQQCDVAVLGLGAMGAATLYQLAREGADVLGIDQYAPPHTQGSSHGDTRITRLSVGEGPQYLPLVRNSHRIWRELEAMTGEPLFEQCGVLVMTSSPAYDPQDPEDFTHKTIALAREYGVRHEVLSAEDIRERFPQFSPVLDTAIGYFEPDGGFVRPERCIAVQLKLAGKLGARIRLNETVTRLQAHGDQVRVTTDQGSIIANKVVVSAGMWSSHLLGEPFTDLLRVCRQQLFWFALEDTAAFAPVSPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGSSDVDLSAFSLKRFGKTA

SEQ ID NO: 43698 - protein, 352 aa, Oryza sativa (indica cultivar-group)
MAPAIAKPLLSDLVAQSGQVPSSHIRPVGDRPDLDNVDHESGAGIPVIDLKQLDGPDRRKVVEAIGSACETDGFFMVKNHGIPEEVVEGMLRVAREFFHMPESERLKCYSDDPKKAIRLSTSFNVRTEKVSNWRDFLRLHCYPLESFIDQWPSNPPSFRQVVGTYSREARALALRLLEAISESLGLERGHMVSAMGRQAQHMAVNYYPPCPQPELTYGLPGHKDPNAITLLLQDGVSGLQVQRNGRWVAVNPVPDALVINIGDQIQALSNDRYKSVLHRVIVNSESERISVPTFYCPSPDAVIAPAGALVDGALHPLAYRPFTYQAYYDEFWNMGLQSASCLDRFRPNDQAV

SEQ ID NO: 43699 - protein, 322 aa, Rickettsiella grylli
MNLAPIVALVKKDLDEVDALINRCLYADIPLIPQLAKHLINSGGKRLRPLIALLSAKAFGYQGKEHRRLAASLELIHGATLLHDDVIDGSVLRRGKKTANSLWGNSASVLVGDFLYSRAFQLISQINNSRVLTSLADATNTLAQSEVLQLINCYNVDVDEAYCLKVIQGKTGVLFSIAAEQPAMLTERPEAEISAMAHYGMHLGIAFQLIDDSLDYSGDPQQLGKSLGNDLSEGKPTLPIIYALQHASAEQAQLLKTALTQGDQNKLMTIIPILQSTSALEYTRTLARHYIEKSLTYLNLIPDSDYRQALAHLTTFAIERSY

SEQ ID NO: 43700 - protein, 128 aa, Triticum aestivum
  misc_feature (53)..(53): Xaa can be any naturally occurring amino acid
  misc_feature (71)..(71): Xaa can be any naturally occurring amino acid
  misc_feature (76)..(76): Xaa can be any naturally occurring amino acid
  misc_feature (83)..(83): Xaa can be any naturally occurring amino acid
  misc_feature (85)..(85): Xaa can be any naturally occurring amino acid
  misc_feature (89)..(89): Xaa can be any naturally occurring amino acid
  misc_feature (91)..(91): Xaa can be any naturally occurring amino acid
  misc_feature (96)..(96): Xaa can be any naturally occurring amino acid
  misc_feature (99)..(100): Xaa can be any naturally occurring amino acid
  misc_feature (102)..(102): Xaa can be any naturally occurring amino acid
  misc_feature (104)..(104): Xaa can be any naturally occurring amino acid
  misc_feature (107)..(107): Xaa can be any naturally occurring amino acid
  misc_feature (110)..(110): Xaa can be any naturally occurring amino acid
  misc_feature (112)..(112): Xaa can be any naturally occurring amino acid
  misc_feature (116)..(116): Xaa can be any naturally occurring amino acid
  unsure (1)..(128): unsure at all Xaa locations
MAPAVMASSATTVAPFQGLKSTAGLPVSRRSSASLGSVSNGGRIRCMQVWPIXGHQEFRALSYLPPLSTEXSLKQXDYLIRPXGXPCLXFXKVGSXSRXXKXPXGNXNGXIXEIWXCQWVETKQQGEK

SEQ ID NO: 43701 - protein, 365 aa, Oryza sativa (japonica cultivar-group)
MVDLVNGVLNWVATPAMVASLLLFYPPYYLFKTVHSFLSYLFPDDLARKVVLITGASSGIGEQLAYNYALNRASLVLVARREWSLRKVADQAFELGAPDVIILPGDVANPEDCKRFVQTAIDHYGRCKSPISLICSVNFFSKMDHLVCNAGIASVGAFQEIPDVTNYSSQFDVNFWGSVQSTFEALPHLKRSRGRIVVTASATGWNPVPRMTFYNAANAALINFYETLRTELGSQVGITIVTPGWIESEMSKGKFLKDHGEMEVDQEMRDAQIGLFPVEYAKNCAKAMVQAVRQGKRCLTVPPWFSTMYLWRVFAPEVVEFCYRLLYMHRHGGSQADAPSKKMAEAGGKKLLYPTSLRSDDIKDE

SEQ ID NO: 43702 - protein, 177 aa, Triticum aestivum
  misc_feature (19)..(19): Xaa can be any naturally occurring amino acid
  unsure (1)..(177): unsure at all Xaa locations
VQCVEYAFGAHDYPTNGVXEVEPRQCPGFRFRRSIFLGTTCLDPIQVRQFMELQSVNYNGDSYHLIMKNCNHFCKDMCYKLTGSKIPKWVNRLARIGAICNCLLPESLKISPVGHDPNSQPEDSEKRRLRNPLSCFSSISSQRALPPSSSPFPPSPVKEPILSSSLRKSSTASLKSR

SEQ ID NO: 43703 - protein, 216 aa, Brassica napus
MMISEKPLGEESIRKDLEGLTVSKRLVKSVSQKLKKKISKTEAVEDEVDARGGGGAVNCLNISGRGVGCKVADTGDDFEDKRWSSAGEGLTTTTICGTEETRLDCFSYGVKEMFFKKHNNRKYLEPEHNHHVFLPDDILEMCLMRLPLTSLMNAHLVCKKWRHMATTQRFLQLRRQGSFQSPWLFLFSGEIHGYDVSQDKWHRVESVVLKGRFMYS

SEQ ID NO: 43704 - protein, 316 aa, Arabidopsis thaliana
MGNSVVRMDCEYEYDSDYSYPDNYMSDYSAYEEESEPEFDYGDDSPFEGIPASFCRRWLQMGYNFIGYLSLYLEVADNGSLPFGWRRHARYTLTLVNQNSKKSFQPNEVQEWFDDSIKWGCPSMFPLNEIHAKDSGFLVNGELKIVAEIDILEVIGDVDVSEGISTVKETIHVNGFQLLPSQAKSVSHIFERHPEIASEIHPKNSSLRTGYMSLLLSLIETLSQSPQELSKDDLCDVYIAIGCMKNAGFKLDWLENKLYEVAQKKEDDEAGETRLREMEEKLKDLKLKCSKMEALVEEEKAKVSAAKAHLSFDDVV

SEQ ID NO: 43705 - protein, 300 aa, Oryza sativa (japonica cultivar-group)
MSLSHHLPPPPGDPYYVYAPHPYPDPQRQGVLTLFVAGLPDDVKPREIHNLFSSRPGFDHCLLEYTGRGNQVVAFVSFVNHQAALSAMSALNGTVFDPDTGDRLHIELAKSSSRKRHGDGGVYRVVDKRLKRKERAADHENAGDGGNDDDAWGEDDNGGNDGDGGSDEPLDTENDDSDEKNELPAERSSGQPGLKQHRGQSLSDDQPDKLSSDIPPCSTLFVANLGHSCTEEELKEVLSKQPGFHLLKMRRRGGMPVAFADFTDIESSTAAMDALQGTVLASSDADGLQIEYARSKMRKS

SEQ ID NO: 43706 - protein, 153 aa, Brassica napus
  misc_feature (146)..(146): Xaa can be any naturally occurring amino acid
  unsure (1)..(153): unsure at all Xaa locations
MVMYEENFVLNSRGMKLFTCVWKPVEQEPKALLFLCHGYAAETSITMNSTATRLAKAGFAVYGMDYEGHGKSEGLSGYISNFDDLVDDVSIHYSTICEKEENKGKMRFLLGESMGGAVVLLLARKKPDFWDGAVLVAPMCKLSEEXKPHPVVI

SEQ ID NO: 43707 - protein, 305 aa, Ehrlichia ruminantium str. Welgevonden
MIKNIEVLQMNSEKFKGVFTALVTPFKNDFSVDQDAFTQLIEYQISNNVHGLVPCGSTGESTTLTFEEYCEIIKLCIKTTNNRVPIIAGSGSCSTQETIKRTLFVNSLNVDAALVVVPYYNRPTDEGIYQHFKVVHDATNIPIIIYNIPKRTGVDVSDTLLARILSLPRVIGVKDATCDISRPLNLKTLVQKDIVLFSGDDFTCLAFNSHGGSGCISAVSNVAPKICSDMQSAFFSNNIKEAIEISKTILKLSQALFCESNPSPAKYALSLITEYISPIVRLPLVELTQENKLKVENTLKELGFI

SEQ ID NO: 43708 - protein, 195 aa, Brassica napus
  misc_feature (154)..(154): Xaa can be any naturally occurring amino acid
  unsure (1)..(195): unsure at all Xaa locations
MFAVENGLQGDPRLQAISDAIRVIPHFPKTGIMFQDITTLLLDPVAFKHVVDIFVDRYKHMNISLVAGVEARGFIFGPPIALAIGAKFVPLRKPGKSPGRVISEEYELEYGHDRLEMSVEAVKSHERALVIDDLVATGGTLSASINLLAPNYTXLERAGAEVVECACVVGLPKFKGECRLKGKPLYVLVEPSQLD

SEQ ID NO: 43709 - protein, 734 aa, Oryza sativa (indica cultivar-group)
MEVADLENPTSRSSSQKSSRRSGSRRSQKSAGQQSSPTVFPEKKGKSKSSRQKHLVFDNKDSKKAKNNEQKNDVVDEKSNFSGYEIYSGKLFFDKKNRITGDQISANGKADISDVRLTSKALIWGSSLLSLEDVISVSYSSGVQHFIVHAYPSKKYLFGKTHRVRKDLRFIAPTVEEAISWVTCFAEQNIYVNMLPLPPTSSTEQDLDGPLSGALFDHPPIKCRTPPRILVILNPRSGHGRSCKVFHDKAEPIFKVPSDTLIMQASTYCSALAGFHMEVVKTTHAGHAKSLASTFDFSAFPDGIVCVGGDGIVNEVFNGLLSRSDRAEAVSIPVGIIPAGSDNSLVWTVLGVKDPISASLLIVKGTREVPHANELVLFVSAQITINRLSKNVVLELSEKYQKKFGPLRYFVAGILKFFCLPSYFYELEYLPSSKEMTGHGKGIGQENFVSDVYTNVMRSRSKREGIPRASSLSSIDSIMTPSRMSLGDVDTSGSTAASTEPSEYVRGLDPKAKRLSLGRSNIVSEPEEVLHPQPHHSSFWPRTRSKTRTERNSVGVTTNDTRLSWAAPSIHDKEDISSTISDPGPIWDSEPKWDNGPKWDTELTWESDHPIELPGPPEDNEIGPSVELVPNLDDKWVVRKGHFLGVLVCNHSCKTVQSLSSQVIAPKANHDDNTLDLLLVGGKGRWKLLKFFILLQFGRHLSLPYVEYVKTRDFSFEYQWQIFRIPVYYLGPLK

SEQ ID NO: 43710 - protein, 289 aa, Porphyromonas gingivalis W83
MGVALITPFDEKGGVDHESLRLLADYQVAGGANYIVVLGTTGESPTIEDAERSAILQTVREAVAGRCPIIVGAGGNYTERLVNRIQAMDKTGVDAILSVAPYYNKPTQEGIYRHYRTLAESTDTSIILYNVPGRTGVNIKSETTLRLATDCPNIIGIKEASGNVDQVRAIVLEKPDPFIVLSGDDHLSLSFIKEGAEGVISVIGNAYPELFSRLIHLCLENRFEEAETIQQRLEGMYYLMFVDGNPAGIKELLYQKGLIRHNILRLPLVSASDSTSTLIARVRNQIEQR

SEQ ID NO: 43711 - protein, 394 aa, Synechocystis sp. PCC 6803
MSLNWISRADRLQALPPYVFARLDELKAKAREQGLDLIDLGMGNPDGKAPQPIIEAAIAELENPESHGYPPFEGTQSFRQSITRWYARQYGVDLDPDSEALPLIGSKEGLGHLALAYVNPGDLVLVPTPSYPAHFRGPLIAGAEIYPIMLSAKDDWLIQLDQIPEAIAQRAKILYFNYPNNPTTATAPREFYEAITDWARHYQIMLVHDLCYAELAFDGYQPTSLLEIPGAKDFSVEFHTLSKTYNMAGWRVGFVVGNQEIIQGLRTLKTNLDYGIFRVVQKAAETALSLPESYIEVVRKRYQERRDFVINGLSKLGWSITPSQATMYLWVPCPVGMSSTDFALTVLEKTGVVMTPGNAFGEGGERYVRLSLIADGDRLGEALQRIEQAGIRYS

SEQ ID NO: 43712 - protein, 357 aa, Leuconostoc mesenteroides subsp. mesenteroides ATCC 8293
MTSVKKIVVLKGDYIGPEIMTAGLAVLDAATKDTTFAYELIDAPFGGDGIDRAGDPLPQSTIDVSKQADAVLLSAIGGPKWDNAPRRPEQGLLEIRSKLNLFANIRPTKVTAAQIDRSPLKPEYVENTDFVIVRELTSGAYFGKPRKLEAHQAIDTMYYSEEEVTRIMHQGFKMAQKRNKHVTIVDKSNVLATSKFWRKIANEVGKSYQDVTIDYYYVDAMTMAIMAKPTTFDVVIIPNLFGDILSDEAAQITGSIGQIPSMSVGESGPNLYEPIHGSAPDIAGQGIANPISMVNTVAMMLTESFDEKRIADKITAAVDYIIENHCVTPDMGGTMTTDEVTQKMVDYIKNYESADIK

SEQ ID NO: 43713 - protein, 263 aa, Brassica napus
DFVPDTSGVSLAESTGFLKAPGGAPANVACAISKLGGKSAFIGKFGDDEFGHMLVNILKKNGVNSEGVCFDTHARTALAFVTLKKNGEREFMFYRNPSADMLLKESELNKDLIKKAKIFHYGSISLISEPCRAAHMAAMKTAKDAGVLLSYDPNVRLPLWSSTEAAIEGIKSIWNEADIIKVSDDEVTFLTRGDAEKDDVVLSLMHDKLKLLIVTDGEKGCRYYTKKFKGRVPGYSVKTVDTTGAGDSFVGAFLVSLRKDGSI

SEQ ID NO: 43714 - protein, 295 aa, Oryza sativa
MASAAVAADGAADGKKMILLVSSDGVKFELSEAAASLSKTLGNMIEDDCATNGAIPLANVAADILAMVVEYCNRHAAAAANASGQEELIRKFDAEFVNIDRKKLFGLINAANFLNMPCLLELTCQRTADLIKDMMPEQVREVFGIENDFTPEEEAEVRNENAWAYEIPAQSAAARARPLPLTAVAVAREGRRRVRRRVAVLVRPFVAAEDRRSVIAAVDPKVPAASSLSPSPSVGLPPPFWSPVSSPCRPLRLGALRLRPSAAVRRRACAARAVQAAEPPPPSVTSLPTSSGPFV

SEQ ID NO: 43715 - protein, 391 aa, Pseudomonas viridiflava
MEQQCDVAVLGLGAMGAATLYQLAREGADVLGIDQYAPPHTQGSSHGDTRITRLSVGEGPQYLPLVRNSHRIWRELEALTGESLFEQCGVLVMTSSPAYDPQDPEDFTHKTIALAREYGVRHEVLSAEDIRERFPQFSPVLDTAIGYFEPDGGFVRPERCIAVQLQLAGKLGARIRLNETVTRLQAHGDQVRVTTDQGSIIANKVVVSAGMWSSHLLGEPFTDLLRVCRQQLFWFALEDTVAFAPVSPSFILTHGPGEVDINYGFPPLPGEGSMKIATEQYVHTSVACELDRSISAEDEQTMFQTQVSGKIAGIKADVVKSSVCAYTVTPDYHFIIDDHPHLKNVTVVSACSGHGFKHSAGLGMALAQRCLRGSSEVDLSAFSLKRFGKTA

SEQ ID NO: 43716 - protein, 391 aa, Pseudomonas viridiflava
MEQQCDVAVLGLGAMGAATLYQLAREGADVLGIDQYAPPHTQGSSHGDTRITRLSVGEGPQYLPLVRNSHRIWRELEAMTGEPLFEQCGVLVMTSSPAYDPQDPEDFTHKTIALAREYGVRHEVLSAEDIRERFPQFSPVLDTAIGYFEPDGGFVRPERCIAVQLQLAGKLGARIRLNETVTRLQAHGDQVRVTTDQGSIIANKVVVSAGMWSSHLLGEPFTDLLRVCRQQLFWFALEDTAAFAPVSPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGSSDVDLSAFSLKRFGKTA

SEQ ID NO: 43717 - protein, 391 aa, Pseudomonas viridiflava
MEQQCDVAVLGLGAMGAATLYQLAREGADVLGIDQYAPPHTLGSSHGDTRITRLSVGEGPQYLPLVRNSHRIWRELEALTGESLFEQCGVLVMTSSPAYDPNDPEDFTHKTIALAREYGVRHEVLSAADIRERFPQFSPVLDTAIGYFEPDGGFVRPERCIAVQLQLAGKLGARVRLNETVTRLQAHGDQVRITSDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFRTQVSGRIAGIKADVVKSSVCAYTVTPDYHFIIDDHPHLKNVTVVSACSGHGFKHSAGLGLALAQRCLRGTSDVDLSAFSLKRFGKTA

SEQ ID NO: 43718 - protein, 379 aa, Rhodopseudomonas palustris CGA009
MSTTKRCYYETLEVERNADDSTLKSAFRKLAMKWHPDRNPGDPQCEIKFKEINEAYEVLKDGDKRAAYDRYGHAAFEQGGFGGGAGFGAGFASSFSDIFEDLFGMAAQRGRGTGRERGADLRYNMEITLEDAFKGKTAQIEIPVSVTCEACSGTGAKAGTKPKTCSTCGGAGRVRQAQGFFTLERTCPSCQGRGQTIEDPCPSCTGSGRVTKERTLSVNIPQGVEDGTRIRLAGEGEAGLRGGPPGDLYIFLSLANHAIFQRDGADLHCRVPISMVTAALGGEFEVPTIDRGKTKVKVPSGTQTGRRFRIAGKGMPVLRSRQVGDMYVQVVVETPQNLTKKQQELLAEFEKLSSGETQPEAVGFFSKVKEFFGSRASAP

SEQ ID NO: 43719 - protein, 674 aa, Mycoplasma penetrans HF-2
MNKGTKTPAINKNDRFVNLTIDTLRVLSCEMIAEAKSGHPGIALGAAPILYTLFKNHLVADPTKSFLNRDRFVMSAGHGSALLYAVMHLSGYDISLNDLKNFRKINSKTAGHPENILIDGVDISTGPLGQGVGAAVGMAIAETKMNQYFKKYNLVNYYTYCLLGDGCFQEGVSFEALSIAAKYKLNKLIFLYDSNDVQLEGRVADSTVIDTKKYFESIGLNYIKVANGNDYNEINEAILLAKKSEEKPTIIEIKTKIGFGSVHEDSPKSHGAPLSEEEIDLLKNKLNYHNEKFEISKNAYFDFESFKKRGTKARESFEEKVKKLKAADPTKYKVLENILNKEISFDKKAFSDYQKTKDSTRNLSNYVLSKIAEINPLLTLLSPDISSSTKINFAKGGVYSTDNRLGMNLNLGVREFAMGTIINGICSTGLKAIGSTFLPFSDYCKAAIRLSSVSKNPGVFVFSHDSIAVGEDGPTHQAVEQLWGLRLIPNHYLIRPCNLDETIKAFEIALTNTESTFSIITSRQEFDLPNGAASKVSRGAYAIKSDRQAIVNILATGSEVALAFQVESILSSKYNIKANIISVPCVELFLKQIESYEKAVLGTTLDASRTVSIEFGSSLPWSRYAGIRIGVNKFGLSGTFESVCKKMKLTAEDIAEKINNSLPKLKKGETLVNN

SEQ ID NO: 43720 - protein, 475 aa, Physcomitrella patens
MAVPSSKLPLKAIPGDYGVPYFGAIKDRLDYFWLQGEEQFYRSRMAKYNSTVFRVNMPPGPPISEHPQVICLLDQKSFPILFDVSKVEKKDVFTGTYMPSVSFTSGYRVCSYLDPSEERHTKLKQWCFEVIAMNGRNFLPEFHKSIEESMVLWETSLAKGEKTSVSDEVKQFAFNFLMRAVCHHDPAAPGEYSLGRNGGPYATAWANPQLAPIAGQTGLPHVVEELVLHTVPLPSALVKKNYDALYNFIKNYATEALDRAEAMGIERNDATANLLFFLCFNAYGGFSIFFPLITILISSCGPELMHDLHDEVTKAVAATDGKVTLQSIENMPLVKSVVYEAFRFKPPVPYQYGKAKFDFTIENHENSFEVKKGEMLYGYQPIVMHDPKVFSDPDQFLPRRFMGPDGEKLIKYIFWSNGYETDEPTTANKQCAGKDLVVTMARAFVAEMFLRYKEYTLTMEGAGNATKVFFSDLKK

SEQ ID NO: 43721 - protein, 714 aa, Oryza sativa
MATATQAPTSPAAASGRGSVLPLLRGRPSTRVRLAVGRRPQTALRAQPPGAAEVVEQSVNTIRFLAVDSVEKAKSGHPGLPMGCAPLGHVLFDEFLRFNPKNPYWFDRDRFILSAGHGCMLQYALLHLAGYDSVTMDDLKAFRQWGSITPGHPENFETPGVEVTTGPLGQGFANAVGLALAEKHLAARFNKPDLKIVDHHTYVILGDGCQMEGVSNEASSLAGHWGLGKLIAFYDDNHISIDGSTGIAFTEDALARYEALGWHTIWVKNGNTGYDDIRAAIKEAKAVKDKPTLIKVTTTIGYGSPNKANTYSVHGSALGTKEVEATKNNLSWHHEPFHVPDEVKRHWSHHIDEGASLEAEWNKKIVEYEKKYRQEAAELKSIISGELPSGWDNSLPKYTPENPADATRNLSQQCLNALAKAIPGFLGGSADLATSNMTLLKMFGDFQKDTPEERNIRFGVREHAMGAISNGIALHSPGLIPYCATFFVFTDYMRAAIRLSALCGSRVIFVMTHDSIGLGEDGPTHQPVEQLFSLRAMPNILMLRPADGNETSGAYKIAVLNRQRPSVLALSRQKLQQLKGTSAEGVAKGGYIISDNSSGNKPDIILIGTGSELEIVEKAADELRKDGKTVRVVSLVCWELFEEQSEKYKESVFPSEVTSRISVEAGVTFGWEKYIGEKGKAIGVDRFGSSAPAGKIYKELGLTVENVIATAKSL

SEQ ID NO: 43722 - protein, 336 aa, Ostreococcus tauri
RMARDGVDGENDLVRLPSFRVLKIASCVLLLFFTVSATIFTEASKREDGTYAYDTFVIPCVVEAVKLVVSSALLARERVVHAHSRAPLGFTVRGFAAYSFPALCYFVSNNCMFYIIRYLGASTFQIMNNLKVLSTGVFMYVFLDRKLSWAQWKALIMLVIGCMVTQLNAKAVEGDDAENRSTLAGYALVLTSAVASGAGGVFSERLLKGKGADQQKANGVGASIHWQNMQLYVFGLLFGVISLRMDAKKSASSPGGNIFDGFNAYAYATVATLAICGLLVSFILKYLDNVAKCFCAALSMLCVALLDSAMKSETIPLSVVLGIVLTALALEQYNLS

SEQ ID NO: 43723 - protein, 504 aa, Rhodopseudomonas palustris CGA009
MQSRRPVMLVILDGWGWREDPADNAVLQAKTPTFDALWTNGPHAFLRTSGKSVGLPNGQMGNSEVGHLNIGAGRVVMQDLPRISDAIANGEIERAPGLVAFIDKLKASGGTCHLMGLVSPGGVHSLQDHACALAKILAKAGVKTVLHAFTDGRDTPPKSAVDDIVRLRAELPPNVPIATVSGRYYAMDRDNRWERVSKAYGVIADADGPRFADANAVIADGYAAGVNDEFIVPAVIGDYQGMRDGDGVLCFNFRADRVREILAALLDSAFAGFPRKQVKQIAAAAGMTQYSTALDALMGTIFPPQSLVNGLGQVVADAGLHQLRMAETEKYPHVTYFLNGGEEVPYPGEDRIMVPSPKVATYDLQPEMSAPELGDKAVAAIESGKYDLIVLNFANPDMVGHTGSLPAAIKAVETVDTQLGHIVAAIRKAGGALLVTADHGNCEMMRDPETGGPHTAHTTNPVPVLLVGDNGPLADGQLSDLAPTLLKLMELPQPAEMTGKSLIG

SEQ ID NO: 43724 - protein, 577 aa, Streptococcus gordonii
MTEMLKGIAASDGVAVAKAYLLVQPDLSFETVSVEDTNAEEARLDAALEASQNELSVIREKAVGSLGEEAAQVFDAHLMVLSDPEMVGQIKETIRTKKVNAEAGLKEVTDMFITIFEGMEDNPYMQERAADIRDVTKRVLANLLGKKLPNPASINEEVVVIAHDLTPSDTAQLDKNFVKAFVTNIGGRTSHSAIMARTLEIAAVLGTNNITELVKDGDIIAANGITGEVIINPTEDQISDFKAAGEAYAKQKAEWELLKDAETVTADGKHFELAANIGTPKDVEGVNANGAEAVGLYRTEFLYMDSQDFPTEDEQYEAYKAVLEGMNGKPVVVRTMDIGGDKELPYFDMPHEMNPFLGFRALRISISETGNAMFRTQIRALLRASVHGQLRIMFPMVALLTEFRKAKAVYEEEKAKLQAEGVAVADNIQVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSVLRTRSLMKKLDTKKMEQLAQRALTECATMEEVLKLEKEYLDFD

SEQ ID NO: 43725 - protein, 446 aa, Rhodopirellula baltica SH 1
MQPEHVAGANMPNAVGNHDPMMRQTVTVILAGGRGSRLEPLTRDRAKPAVPIGGAYRIIDFVLSNCLNSDMRRLLLLTQYKAQSLDRHINVAWRNYFCRELGEFIDVVPPQQRIDDNWYQGTADAVYQNIYAIEREAPEYVVILAGDHLYKMNYESMVNFHHRKGADVTVGALRVSREEARQFGVMQVDTDNRLVEFQEKPENPRPTLDDPDVCLASMGIYVFNTRFLFERLCDDATQPDSDHDFGKNIIPGAIEDSQVFAFPFTDENRKRDAYWRDVGTLEAYYEANMDLVGVDPQLNLYDRQWPIRSFQPQLPPPKFVFGSEGRSSRRGEALDSIVCQGAIISGGCVRRSVIGTGCRINSYAQVEDSILFDDVNVGRHSRIRRAIIDKGVQIPPETEIGYDLALDRARGLTVTDSGLVVIARGEMIASPVSTNGSHDPTSSLTS

SEQ ID NO: 43726 - protein, 562 aa, Methanosarcina mazei Go1
MTVSRGKGTERRPEALKKTFILGIEGTAWNLSAAIVTETEIIAEVTETYKPEKGGIHPREAAQHHAKYAAGVIKKLLAEAKQNGIEPSDLDGIAFSQGPGLGPCLRTVATAARMLGLSLGIPLIGVNHCIAHIEIGIWKTPAKDPVVLYVSGANSQVISYMEGRYRVFGETLDIGLGNALDKFARGAGLPHPGGPKIEAYAKEAKRYIPLPYVIKGMDLSFSGLSTAASEALRKASLEDVCYSYQETAFAMVVEVAERALAHTGKKEVLLAGGVGANTRLREMLNEMCEARGAKFYVPEKRFMGDNGTMIAYTGLLMYKSGNTISLEDSRVNPSFRTDDVKVTWIKEEEMKKVPEISPETFFRMPPGEILDNGAEAVVYLQEGPEGKRALVKERVPKAYRHKEIDERIRRERNRTEARLMSEARRAGVPTPIIYDVEEFKLKMQFIEGVPIKYLITPPLSEKVGELVGKLHSSGIVHGDLTTSNLLLAGERLYLIDFGLAYFDKSLEARGVDVHVLFQTFESTHRNYEALVKAFEKGYASTFIDSEDVLRRVEEIKKRARYA

SEQ ID NO: 43727 - protein, 545 aa, Oryza sativa
MEGTGEMREVGRETLHGGVVQSVSETDEYKEKTIDSEKDGQFRVQPRWRKFLAHVGPGALVAIGFLDPSNLETDMQAGADFKYELLWVILVGMVFALLIQTLAANLGVKTGRHLAELCREEYPHYVNIFLWIIAELAVISDDIPEVLGTAFAFNILLKIPVWAGVILTVFSTLLLLGVQRFGARKLEFIIAAFMFTMAACFFGELSYLRPSAGEVVKGMFVPSLQGKGAAANAIALFGAIITPYNLFLHSALVLSRKTPRSDKSIRAACRYFLIECSLAFIVAFLINVSVVVVAGSICNANNLSPADANTCGDLTLQSTPLLLRNVLGRSSSVVYAVALLASGQSTTISCTFAGQVIMQGFLDMKMKNWVRNLITRVIAIAPSLIVSIVSGPSGAGKLIILSSMILSFELPFALIPLLKFCNSSKKVGPLKESIYTVVIAWILSFALIVVNTYFLVWTYVDWLVHNNLPEYANGLISVVVFALMAAYLVAVVYLTFRKDTVATYVPVPERAQAQVEAGGTPVVDASAADEDQPAPYRKDLADASM

SEQ ID NO: 43728 - protein, 103 aa, Ostreococcus tauri
VMEEANEREENEFTTGPLSVLTASVKANTQVLINCRNNRKLLARVKAFDRHCNMVLENVKEIWTEVPKTGKGSAKAKPVNKDRFVSKMFLRGDSVILVLRNPK

SEQ ID NO: 43729 - protein, 542 aa, Synechocystis sp. PCC 6803
MTTQIPVPPVVSDQALPDRISDRLKGQIIVILDFGSQYSELIARRIRETEVYSEVLSYRTTAQQLREIKPKGIILSGGPNSVYDQGAPECDPEIFQLGVPVLGVCYGMQLMVKQLGGRVERAKRGEYGKASLHIDDPTDLLTNVENDSTMWMSHGDSCVDLPTGFEILAHTDNTPCAAIADHQKALFGVQFHPEVVHSVGGIALIRNFVYHICHCEPTWTTAAFIEESIREVRSQVGDRRVLLALSGGVDSSTLAFLLHRAIGDNLTCMFIDQGFMRKGEPERLVELFDHQFHIPVQYVNARDRFLKQLEGVTDPEEKRRLIGHEFIQVFEEESNRLGPFDYLAQGTLYPDVIESADSNVDPKTGERVAVKIKSHHNVGGLPKNLRFKLVEPLRKLFKDEVRKLGRSIGLPEEIVRRHPFPGPGLAIRIIGEVTSERLNILRDADFIVRDEISKRGIYHDYWQAFAVLLPIRSVGVMGDKRTYAHPVVLRFITSEDGMTADWARVPYDILEAISNRIVNEVKGVNRVVYDITSKPPGTIEWE

SEQ ID NO: 43730 - protein, 200 aa, Zea mays
  misc_feature (65)..(65): Xaa can be any naturally occurring amino acid
  misc_feature (97)..(97): Xaa can be any naturally occurring amino acid
  misc_feature (114)..(114): Xaa can be any naturally occurring amino acid
  misc_feature (133)..(133): Xaa can be any naturally occurring amino acid
  misc_feature (157)..(157): Xaa can be any naturally occurring amino acid
  misc_feature (178)..(178): Xaa can be any naturally occurring amino acid
  unsure (1)..(200): unsure at all Xaa locations
MGAFAKEEHQFLAELGLAQRNPGAFACGAWGGSGPTVTSTSPTNNQVIAEVVEASVHDYEEGMRXACFDAAKTWMAIPAPKRGEIVRQIGDALRAKXLHHLGRLVSLEMGKILXPEGIGEVQEIIDMCDYAVXGLSRQLNGSIIPSERPNHMMDGRXDPLGSCGGVITAFNFPCAVLXGWNACIALVCGNCVVWERCLQG

SEQ ID NO: 43731 - protein, 81 aa, Ehrlichia canis str. Jake
MTKVIIYTKDPCPYCTKAKALFNKKNILFKEIDVTNNSTLLEEMIQKSNGMRTLPQIFINDQHIGGCDDLYRLYESGKLEL

SEQ ID NO: 43732 - protein, 341 aa, Porphyromonas gingivalis W83
MLLGMSLEELTTVALRMGMPRFAGKQLAEWIYVRRATDFAEMTNISQANRQKLAEIYDLGRYPWSDVQCSVDGTKKYLFPVGEGRFVESVLIPEGDRATLCISSQVGCKMDCLFCMTGKQGWNGNLSAAEILNQIFSVDEAAELTNLVYMGMGEPLDNTDEVLRSIEALTEPWGMGWSPKRITVSTIGAKGLERFLAESRCHLAVSLHSPFPEERRKLMPGEKAFPIMQTLDRIRAYDFSGQRRVSFEYIVFDGLNDDMRHADELAAILRGIPCRINLIRFHKIPAVSLRSSDTARMEAFRKRMESHGFTCTIRASRGEDIFAACGMLSTSKAESSEEKSS

SEQ ID NO: 43733 - protein, 391 aa, Pseudomonas viridiflava
MEQQCDVAVLGLGAMGAATLYQLAREGADVLGIDQYAPPHTQGSSHGDTRITRLSVGEGPQYLPLVRNSHRIWRELEAMTGEPLFEQCGVLVMTSSPAYDPNDPEDFTHKTIALAREYGVKHEVLSAGAIRERFPQFSPVLDTAIGYFEPDGGFVRPERCIAVQLQLAGKLGARVRLNETVTRLQAYGDQVRITTDQGSIIANKVVVSAGMWSSQLLGEPFTDLLRVCRQQLFWFALEDTAAFAPVSPSFILTHGPGEVDINYGFPPLPGEGSMKIATEQYVHTSVACELDRSISAEDEQTMFQTQVSGKIAGIKADVVKSSVCAYTVTPDYHFIIDDHPHLKNVTVVSACSGHGFKHSAGLGMALAQRCLRGSSEVDLSAFSLKRFGKTA

SEQ ID NO: 43734 - protein, 391 aa, Pseudomonas viridiflava
MEQQCDVAVLGLGAMGAATLYQLAREGADVLGIDQYAPPHTLGSSHGDTRITRLSVGEGPQYLPLVRNSHRIWRELEALTGESLFEQCGVLVMTSSPAYDPNDPEDFTHKTIALAREYGVKHEVLSAGAIRERFPQFSPVLDTAIGYFEPDGGFVRPERCIAAQLQLAGKLGARVRLNETVTRLQAHGDQVRITSDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGTSEVDLSAFSLKRFGKTA

SEQ ID NO: 43735 - protein, 380 aa, Cryptococcus neoformans var. neoformans JEC21
MWRPSISRVLFRPSFRKNLRLLCCPYKKTSRWAQSHCPSPSPISPPQSAILQSVPHALRQKHPITLWLFQYITDSELGHGAPLSITHPLLPDCDHLKQPPSSPISSTGSGSSSDAEDVWTCTCTSYYESEKQTYLCSAECGDLCDCVAQFGNFYSSTNPQTLKLDALPDNWPLVECSPSCLCGLSCSNRVTQQGVRTPLTIRPTPPKGYGLFYTPSTPQFLPRGAFISLYAGEYILPSEIRSRWSPRSTTDLASDKEGYGEEGQGNYVLSLRLPDQTIHIDPRWKGNVGRFLNHSCGANCVVHYVKWGRGRGWPRAAIFTNRDIHPEEELTFDYANASGEPQRAIQLIQESKTKEDTKGRTRCLCGAEQCRGWIPFDETL

SEQ ID NO: 43736 - protein, 391 aa, Pseudomonas viridiflava
MEQQCDVAVLGLGAMGAATLYQLTREGADVLGIDQYAPPHTQGSSHGDTRITRLSVGEGPQYLPLVRNSHRIWRELEALTGESLFEQCGVLVMTSSPAYDPNDPEDFTHKTIALAREYGVKHEVLSAGAIRERFPQFSPVLDTAIGYFEPDGGFVRPERCTEVQLQLARKLGARIRMNETVTRLQAHGDQVRITTDQGSIIANKVVVSAGMWSSQLLGEPFTDLLRVCRQQLFWFALEDTAAFAPISPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGTSDVDLSAFSLKRFGKTA

SEQ ID NO: 43737 - protein, 271 aa, Zea mays
  misc_feature (219)..(219): Xaa can be any naturally occurring amino acid
  unsure (1)..(271): unsure at all Xaa locations
MPSHQPTAGMMAVDPDYVKQPSSMASTSEPNRNPKYDPKKPHITDTPITKSNWYKHVNWLNVTFIIGIPLAGCIAAFWTPLKWQTALWAVIYYFWTGLGITAGYHRLWAHKSYNASLPLSVFLALVGGGAVEGSIRWWSRDHRAHHRYTDTNKDPYSVRKGLLYSHLGWMVMKQNPKRIGRTDITDLNEDPVVVWQHKNYIRGVIFMGLIFPSAVAGLXWNDWKGGFIYAGILRIFFVQQATFCVNSLAHWLGDQPFDDRNSPRGHVITAL

SEQ ID NO: 43738 - protein, 391 aa, Pseudomonas viridiflava
MEQQCDVAVLGLGAMGAATLYQLAREGADVLGIDQYAPPHTLGSSHGDTRITRLSVGEGPQYLPLVCNSHRIWRELEALTGESLFEQCGVLVMTSSPAYDPNDPEDFTHKTIALAREYGVKHEVLSAGAIRERFPQFSPVLDTAIGYFEPDGGFVRPERCIAAQLQLAGKLGARIRLNETVTRLQAHGDQVRITSDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGTSDVDLSAFSLKRFGKTA

SEQ ID NO: 43739 - protein, 434 aa, Rickettsiella grylli
MTKITEINAYEILDSRGNPTITAEVILDSGLKADASVPSGASVGSKEAFELRDTQRVDRYHGKGVLGAIQNVLGPLRNHLIGKNIDKQSQLDNLMRKLDGTDNKSKLGANAILSVSLCLLKAAALASRQTLYAHIAELMGKTDKKYIMPVPQMNIINGGVHADNALAIQEFMILPLGAPTFSEALRWGVEIFHCLKAYLKKQGLNTNVGDEGGFAPNFQTHQEAIESILEATQQAGYQPGGDIYLGLDAASNEFYVNGKYCLENKTLDTEAWVRYLENLVKQYPIISLEDGMAESDEAGWIHLTQQLGRKIQLVGDDLFVTNSTLLKQGIHKKCANAILIKLNQIGTVSETLAVISLARHADYATIISHRSGETEDTSIADLAVGTGAGQIKTGALCRTDRTAKYNRLLRIEAELSIQNQVEYAGTQFFSRFLI

SEQ ID NO: 43740 - protein, 459 aa, Listeria monocytogenes str. 1/2a F6854
MKHIVIIGGGLSGLAAAYELQKTHPNYTWELVEKDEKLGGKFETVKRDGFLIEKGPDSFLARKPAGVGLVKDLGLEDKLIANATGRSYIYHQKALHPIPEGSVMGIPTDKEALLASTLVSEIGKARALQEPTMERNNQERDQALGDFFEARFGKELVKTIIEPLLSGIYAGDIYKMSLRATFPQFEQTVKKYGNLMDGLKESSMQTTGTKATIGAFRTLEGGLDALPKAIAAALPKENLHTAKQATEIVKKNNAYEISFADGDKMEADGVIIAATHDALIHLLAETTTEPFAGQPLTTLATVSLAYNEQDVPILPDGTGYLVARTAPYKTTACTWVQKKWPHMVPKNKMLLRGFVGKAGETWLEQASDEAIVSAVLRDYAEIMDLHAAPLFYEVSRMKSAMPQYLVNHQDRLKQLKKNIKTDYPGVYLAGMSYEGVGIPDCIAGAQTAAKELVDYLEEV

SEQ ID NO: 43741 - protein, 522 aa, Triticum aestivum
MSSMQFSSVLPLEGKACVSPVRREGSACERLKVGDSSSIRHDRASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 43742 - protein, 169 aa, Oryza sativa
MAKATILLFLVLAAATAAMAATSASTAPVGIRKSRFLMTQQGQGADPYYYYSCSKKSAAAVCLAAGSPGATCCGGRCVDTGASGEHCGGCNKACKHGRSCCGGRCVDLLSDRDNCGSCSNQCSNKCTYGFCDYAYSSATASFNNPLTSAATPLALSSTLSEKSCSHFKT

SEQ ID NO: 43743 - protein, 282 aa, Medicago truncatula
MSTEKERETQVYMAKLAEQAERYEEMVECMKTIAKLDVELTVEERNLLSVGYKNVIGARRASWRIMSSIEQKEEAKGNENNVKLIKSYCQKVEEELSKICSDILEIIDKHLIPSSTTGEATVFYYKMKGDYYRYLAEFKNDQDRKEAADQSLKAYEAASATASTDLPSTHPIRLGLALNFSVFYYEIMNSPERACHLAKQAFDEAIADLDTLSEESYKDSTLIMQLLRDNLTLWTSDLPEDGGEELKSEEVKPAEPEVWQQSRADIFLVPKPNGVRISMYLS

SEQ ID NO: 43744 - protein, 391 aa, Pseudomonas viridiflava
MEQQCDVAVLGLGAMGAATLYQLARKGADVLGIDQYAPPHTLGSSHGDTRITRLSVGEGPQYLPLVRNSHRIWRELEALTGESLFEQCGVLVMTSSPAYDPNDPEDFTHKTIALAREYGVRHEVLSAADIRERFPQFSPVLDTAIGYFEPDGGFVRPERCIAAQLQLAGKLGARIRLNETVTRLQAHGDQVRITSDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFRTQVSGRIAGIKADVVKSSVCAYTVTPDYHFIIDDHPHLKNVTVVSACSGHGFKHSAGLGLALAQRCLRGTSDVDLPAFSLKRFGKTA

SEQ ID NO: 43745 - protein, 429 aa, Photobacterium profundum SS9
MTRIIVVGGGAGGLELATKLGRTLGRKGRAQVTLVDRKASHLWKPLLHEVATGSMDAGVDALSYRAHAKNHHFDFQMGSLKEIDRENKVITLAELHDEHNELLMPERNLDYDILVMAIGSTSNDFNTPGVKDNCIFLDSPEQAHRFRTEMNNQFLKLHANKELKTVDIAIVGAGATGVELSAELHNAVAELRTYGFGDLDSSRLNVNLIEAGERILPALPPRISSAAHSELTKLGVNVRTMTMVTKADSTGLTTKDGEHIPAHIMVWAAGIKAPDFMKDIAGLETNRINQLVVKPTLQTTRDDDIYAIGDLASCVQEDGSFVPPRAQAAHQMASRCFSNIVAKITDREQKPYVYSDHGSLVSLSRFSTVGSLMGNLTKGSMMVEGRIARIVYISLYRMHLVALHGVFKTGLMMLVGRINRVLRPNLKLH

SEQ ID NO: 43746 - protein, 405 aa, Triticum aestivum
  misc_feature (404)..(404): Xaa can be any naturally occurring amino acid
  unsure (1)..(405): unsure at all Xaa locations
KTGCLLIKAVAVHLPPPGCGVDGVERPRAPPQPPAHHLFDETPLSSDPMAEASGDGSMEDRISALPDELLIHVLSHLRSREAVQTCVLARRWRYLWRSVTCIDVSFEEFEDRAAANDLEREEMFKMFVNHLLILRERVDLKEFHLEYSLVVGVSRLSAKSDEANLWIRHALQYKAQTVKIGNHSEPLQLLPSVFTSTYLKRLHITNAQLILGFFDRLRKGCPALEYLFLSTCDIEDLDIFSDTLKVLILSDAIGFSFSFEHDAQVSISAPSLISLSVKECPSGARLPILKNMSSLETASVLLSEGDITTCDADGIRQFLGGLSGVRSLDFYYGDRQLEVKNNHGWCPTFNNLTNLTLDRWCMHADLYAMIVFLQNSPNLKKLTLKLNEPRYHNEVVSAVIGELXG

SEQ ID NO: 43747 - protein, 525 aa, Alkalilimnicola ehrlichei MLHE-1
MTQDIHAHRILILDFGSQYTQLIARRVREAGVYCEIYAWDAPETAIRDFGAAGFILSGGPESMTVDNGPRVPEAVFQAGVPVLGICYGMQAMAGQLGGRVEASDHKEFGYARVRARGHSRLLRDIEDHASPEGWGLLDVWMSHGDRVTGLPPGFKLIASTESCPIAGIGDDERGYYGVQFHPEVTHTPQGARILSRFVHEICGCPADWTPGNIVDDLIERVRRQVGGDKVLLGLSGGVDSSVVAALLHRAIGDQLTCVFVDNGLLRKDEGDQVMATFARHMGVNVIRVDAEARFLEALKGVDDPERKRKIIGNMFIEVFDEQAARLTEVDWLAQGTIYPDVIESAGSATGKAHVIKSHHNVGGLPEDMTLKLVEPLRELFKDEVRRIGLELGLPADMVYRHPFPGPGLGVRILGEVRKEYADLLREADAIFIEELRAHDLYDQVSQAFAVFLPVKSVGVTGDGRRYEYVVALRAVETIDFMTARWAHLPYEFLDHVSRRIINEIPGISRVAYDISGKPPATIEWE

SEQ ID NO: 43748 - protein, 116 aa, Photobacterium profundum SS9
MAEETIFSKIIRKEIPADVLYQDDLVTAFRDINPRAPSHILIIPNKLIPTVNDVEAEDEVMMGRMFTVARKLAEKEGVAENGYRLIVNCNPHGGQEVYHIHMHLLGGRPLGPMLVG

SEQ ID NO: 43749 - protein, 891 aa, Oryza sativa (indica cultivar-group)
MASSQGLKKNYRCDRSLQQFYTGGPFAVGSSPGGGEGEVEGGEAEAEAFLACACGGEVRLVSAADASAIGEPIEGENEAVTALALSPDSRLLFTAGHSRLIRVWDLASRTCTRSWKGHDGPIRAMACHASGGLLATAGADKKVCVWDVDGGFCTHFFRGHAGVVTTVMFHKDPKRLLLFSGSEDATVRVWNLESKKCVAVLKEHFSAVTSLALSEDGQTLLSAGRDKIVNVWDVRKYNSKKTIPAFEMIEDVSFIGPGSNLLSCLGEPANIKRKTDGYFLTVGERGVVRIWCLESAQCIYEQQSSDVTVNTENEESRRGFTSAVMLSDDQGLLCATADQQFLFYCPTRTDGGDFQLNLYKRLVGYNDEILDLKFVGEDEQYLAVATNLEQVRVYDVASMSCSYVLSGHTEIVVCIDTCISSSGKTLVVTGSKDSTVRLWDMERRSCIGIGKGHLGAIGSVAFSKKSKNFFVSGSSDRTIKIWSWDDTLDDVGSEVPLKAKAVVAAHDKDINSLSVSPNDGLVCSGSEDRTACIWKLPNLVPSVVLKGHKRGIWSVEFSPVEQCVITSSGDRTVKIWAVADGSCLKTFEGHTSSVLRASFLSHGTQFVSCGSDGLVKLWTIKTNECIATFDKHDGKVWALAVGKKTEMLATGGTDAVLNLWHDCTMEDKQEDFCKKEEELLRGQELENAVSDYDYAKAIQLAFELRRPHRLLELFTQLCRESDLEDPIEKALIGLPKEGLRVLLEYIREWNTKPKLCHVAQFVLFRVLRSLPPTDILEIKGISELLEGLIPYSQRHFSRVDRLVRSTFLLDYTLTRMSVVDPDIDEGTTRDDANGSSVENCEIAQAKPDALVAEENLQKSVKKRKSSKSSKKGGKKVKIASTGGSKDVPIEA

SEQ ID NO: 43750 - protein, 165 aa, Glycine max
MAGNSPCASCKLLRRRCTKDCIFAPYFPSNDPQKFALVHKVFGASNVSKMLQELPAHQRGDAVSSLVYEAHARVRDPVYGCVGAISHLQNQVSELQMQLAVAQAEILCIQMQQEPLMPNPEMEDPDQKSYLLQNELPQYLNYASSSNVIYDSFSRESIFGHDMVS

SEQ ID NO: 43751 - protein, 588 aa, Debaryomyces hansenii CBS767
MTTEGLVVPALSTQQDDSTFEFDKVCSKTVVRSHLGLPNDATDDQVIKRIREYYNISEICNFLKQKVEGHELDMIPKYKHVTLQFPDSLICDSASIVHELQRELGLMPRTEDSSEVKCSADSCCKTGKVESPLSQKLWILADTSYSSCCIDEVAAGHVNSDLVIHFGDACLNVVESLPAAYVFGKPSLKLDSVITQFKEIYANRDLKILIMADAPHTQSLNQLYNILKPEYPNLAYADLYLNPSSNASIIGYDPCPSQSSILNVLNRTIIGLDNGDIDTDIDTILLEHDLFHIEVPAVPRLLQLTTRFQSVTTFEPKSGLASQGPYPKLMRRYRYMHMARSAGTVGLLVNTLSLANTKTLINKIGQKIKEAGKKHYVFVVGKPNVAKLANFENIDIWCVLGCDHQGIIIDENNEYYKPIVTPYELLLALNKDQNWSGKWVTDFNKVLEDMSLEDERNKQEINDGSDNNEEDSDDEAPEFNPVTGQYVSTSKPLRKLHHLQISSQEQHPELDNEGSQDLVKKFSSAVAIKDTVSTSAMHLQTRHWTGLGSDFQQNDSDEEANNEDGALVEDGRAGIARGYDYDRETKFQ

SEQ ID NO: 43752 - protein, 116 aa, Colwellia psychrerythraea 34H
MDTIERIKEQISENTILLYMKGSPKLPNCGFSSQASQALISCEEKFAYVDILQNPDIRAELPKYADWPTFPQLWVDGELVGGCDIIMEMFQQGELQTLVKAAASKNASAEDSSADA

SEQ ID NO: 43753 - protein, 480 aa, Zea mays
  misc_feature (293)..(293): Xaa can be any naturally occurring amino acid
  misc_feature (306)..(306): Xaa can be any naturally occurring amino acid
  misc_feature (357)..(357): Xaa can be any naturally occurring amino acid
  misc_feature (442)..(442): Xaa can be any naturally occurring amino acid
  misc_feature (451)..(451): Xaa can be any naturally occurring amino acid
  unsure (1)..(480): unsure at all Xaa locations
PFFPSSVFPNPTTRTKPTQREESLLACLGWTPPSPPPRPIGPAPPSCCCCCCCCCARAAAGPGRSAGGGGRARWSGASAAYTAAALVCAAAASVVALAHIYRHLLHYAEPIYQRFIVRIIFMVPVYAVMSFLSLILPDNAIYFNSIREIYDAWVIYNFLSLCLAWVGGPGAVVVSLSGRTLKPSWILMTCCYPAIPLDGRFIRRCKQGCLQFVILKPILVVITFILYAKGKYKDGNFSVNQSYLYITIIYTISYSMALNALASFLSACRDLLRPYNTGPKFIMIKSVVFLTYXWHGCPGIFLAAKXLRFIKNADKAADLQNFVLCVEMLIAAIGHLFAFPYKEYADPNARPSSGFEXSLLHALKFNDFYHDTVHQFAPTYNEYVLYNHNEGDNAETKFPSGSTATSGQGVELAGITVVASNSPVTSSVSCNQADQEETMTTXPIKDKVDPXGLYDLTELLDVDLSSYPDKVPAITDVRKQ

SEQ ID NO: 43754 - protein, 278 aa, Leuconostoc mesenteroides subsp. mesenteroides ATCC 8293
MKRFENILKRIGPLPLIMAGVALVLIIVSGLSYDGHVTSHSFWSAIVAVFTRAILGASSWFGNNYGMGIILFTIFIRFLILPLMVYQVQSMMKMQVVQPALKELQAKYPGKDTESRQLMMAEQQALYKDAGVNPFASMLPLIVQMPILIALYQSIWNSPVLRSGKFLWLQLGSNDPYFILPVLAALFTFASSWLSMQSNPDQNGMTKAMPYIFPVIIFFSALAVPSALSLYWVVGNAFQTVQTFFLQNPFKIRREREAAAQLEKEKQRKIRKAKRRKR

SEQ ID NO: 43755 - protein, 776 aa, Pseudomonas amyloderamosa
MKCPKILAALLGCAVLAGVPAMPAHAAINSMSLGASYDAQQANITFRVYSSQATRIVLYLYSAGYGVQESATYTLSPAGSGVWAVTVPVSSIKAAGITGAVYYGYRAWGPNWPYASNWGKGSQAGFVSDVDANGDRFNPNKLLLDPYAQEVSQDPLNPSNQNGNVFASGASYRTTDSGIYAPKGVVLVPSTQSTGTKPTRAQKDDVIYEVHVRGFTEQDTSIPAQYRGTYYGAGLKASYLASLGVTAVEFLPVQETQNDANDVVPNSDANQNYWGYMTENYFSPDRRYAYNKAAGGPTAEFQAMVQAFHNAGIKVYMDVVYNHTAEGGTWTSSDPTTATIYSWRGLDNATYYELTSGNQYFYDNTGIGANFNTYNTVAQNLIVDSLAYWANTMGVDGFRFDLASVLGNSCLNGAYTASAPNCPNGGYNFDAADSNVAINRILREFTVRPAAGGSGLDLFAEPWAIGGNSYQLGGFPQGWSEWNGLFRDSLRQAQNELGSMTIYVTQDANDFSGSSNLFQSSGRSPWNSINFIDVHDGMTLKDVYSCNGANNSQAWPYGPSDGGTSTNYSWDQGMSAGTGAAVDQRRAARTGMAFEMLSAGTPLMQGGDEYLRTLQCNNNAYNLDSSANWLTYSWTTDQSNFYTFAQRLIAFRKAHPALRPSSWYSGSQLTWYQPSGAVADSNYWNNTSNYAIAYAINGPSLGDSNSIYVAYNGWSSSVTFTLPAPPSGTQWYRVTDTCDWNDGASTFVAPGSETLIGGAGTTYGQCGQSLLLLISK

SEQ ID NO: 43756 - protein, 391 aa, Pseudomonas viridiflava
MEQQCEVAVLGLGAMGAATLYQLARQGADVLGIDRYAPPHTQGSSHGDTRITRLSVGEGPQYLPLVRHSQRIWRELEALTGESLFEQCGVLVMTSSPAYDPHDPEDFTHKTIALAREYGVKHEVLSAGAIRERFPQFSPILETAIGYFEPDGGFVRPERCIAVQLQLAEKLGARIRMNETVTRLQPQGDQVRITTDQGSILANKVVVSAGMWSSQLLGEPFTDLLRVCRQQLFWFALEDTAAFAPVSPSFILTHGPGEVDINYGFPPLPGEGSMKIATEQYLQASAACELDRSVSAEDERTMFHTQVSGKIAGLKAEVVKSSVCAYTVTPDYHFIIDDHPHLKNVTVVSACSGHGFKHSAGLGLALAQRCLRGTSDVDLSAFSLKRFSKKA

SEQ ID NO: 43757 - protein, 451 aa, Leuconostoc mesenteroides subsp. mesenteroides ATCC 8293
MKIGIIGATHAGVYAAKQIKSEHPEAEVTVFEKNTTVSFLSCGIALWIGDHVSDPEKMFYETPESMRNQGITMLMAHQVNQADLKSKTLTVTNLDTEEVTTQQFDKIVITTGSKPVIPNIPGIDSNRVYFCKSWDDATRIKSVAKDLKRVAVIGAGYIGAELAEQLSVTGKQVTLIDGADRVLAKNFGPAFTERIQKEYEKNNVDVVLNQFVSKFENTPNGIKITTPNGSYEADIAILGIGFLPNTDLFSGQLETLPNGAIIVNDYMQTSEDNVYAAGDASTVFFNPTQAIDYIPLATNAIRQGILVGKNIVEPTTRYLGTQATSAVELYEQAMVATGLNSATAKEKGLDVIETVIESDYRPDFMLSTTSVLSSLTWEKDTGRIVGGSFMSQHDVSQSANLVSIAIQKQMTIDELAMSDFFFQPNFSQPINYIPEVALAAVAEKQALTLAY

SEQ ID NO: 43758 - protein, 277 aa, Arabidopsis thaliana
MAETLKEDSIMIREVWDYNLVEEFALIREIVDKFSYIAMDTEFPGVVLKPVATFKYNNDLNYRTLKENVDLLKLIQVGLTFSDENGNLPTCGTDKFCIWQFNFREFNIGEDIYASESIELLRQCGIDFKKNIEKGIDVVRFGELMMSSGIVLNDAISWVTFHGGYDFGYLVKLLTCKELPLKQADFFKLLYVYFPTVYDIKHLMTFCNGLFGGLNRLAELMGVERVGICHQAGSDSLLTLGSFRKLKERYFPGSTEKYTGVLYGLGVEDGTTTTVAN

SEQ ID NO: 43759 - protein, 391 aa, Pseudomonas viridiflava
MEQQCDVAVLGLGAMGAATLYQLAREGADVLGIDQYAPPHTQGSSHGDTRITRLSVGEGPQYLPLVRNSHRIWRELEAMTGEPLFEQCGVLVMTSSPAYDPQDPEDFTHKTIALAREYGVRHEVLSAEDIRERFPQFSPVLETAIGYFEPDGGFVRPERCIAVQLQLAGKLGARIRLNETVTRLQAHGDQVRVTTDQGSIIANKVVVSAGMWSSHLLGEPFTDLLRVCRQQLFWFALEDTAAFAPVSPSFILTHGPGEVDINYGFPPLPGEGSMKIATEQYLHASQACELDRSVSAEDERTMFQTQVSGKIAGIKADVVKSSVCAYTVTPDYHFIIDDHPHLKNVTVVSACSGHGFKHSAGLGLALAQRCLRGSSDVDLSAFSLKRFGKTA

SEQ ID NO: 43760 - protein, 145 aa, Mycoplasma penetrans HF-2
MSAQKMTNEQILKYVQSKQIRKDIPEFRSGDTIIVHNKIIENNKSRIQKFEGVVIRRRGSGLSETIIVRKESSGIGVERIFQLHSPQIEKIEVIRLGKVRRAYLTYLRERSGKSARIKERRPAKAVEKTSKPASAKKPAAKANKK

SEQ ID NO: 43761 - protein, 120 aa, Campylobacter coli RM2228
MSNYPKAIGPYSAYREANGLLFISGQLPINPASGEIESSDIKEQTKQSLKNIGAILEENGISYDKVIKTTCFLADINDFVAFNEIYAEFFKAPYPARSAFAVKDLPKKAKVEIEIIAQKG

SEQ ID NO: 43762 - protein, 128 aa, Brassica napus
MTEYKEEQEMEIEALESILADDFKEIHSSESGLNTSNRCFQITVTPHDDDDLEESSIPPENYPDEVPLLDVKSIRGIHVSDLTILKEKLEQEAAENLGMAMMYTLVSSAKDWLSEHYGQDDGDDYAEE

SEQ ID NO: 43763 - protein, 175 aa, Brassica napus
  misc_feature (43)..(43): Xaa can be any naturally occurring amino acid
  unsure (1)..(175): unsure at all Xaa locations
MAYSMLSSAAVVTSPAQATMVAPFTGLKSSSAFPVTRKANNDXSGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 43764 - protein, 184 aa, Hyphomonas neptunium ATCC 15444
MNLIKELETAEIARVLGDKTIPQFSPGDTVAVNVKIKEGDRERVQRYEGVCIARSGGGINESFTVRKISFGEGVERVFPLVSPLIESIEVLRKGRVRRAKLYYLRDLRGKGARIAERTTGHGIEQQEVAVSKTERRRQKDAEKANRKEVAAQARADKAKADAAAAEAAAAEAAAAEAPAEGGDA

SEQ ID NO: 43765 - protein, 333 aa, Oryza sativa (indica cultivar-group)
MAETKIEGPTIAVKLFVDKERSRVLSAESDKDFVDVLFGFLTLPLGTVVRLLGRQSQVGCLDELYKSVEDLSADYFHTKACKAMLLKPHNTAAELCCLLKVKVDDTDQSAVYVCRDANCSANGDCGVTSVAGSVCKCGKVMEYIGEWPQDGGSTAAAGSDGGVFVKGCYKFIVTDDLHVGPASTSLMMSIFDKYGVRDPANLEQKILQLNAEKITCLLKRSLTSKQTLTGYYFDVPNPNDEANLYVLPESLYSEQDAEVDHKLNNMKIKVLQRKNNTSLLYAEVGEDFVDLLFGLLSIPLGSILKTYGKWSSNGCVDNIYMSIDGSAKGCMNP

SEQ ID NO: 43766 - protein, 430 aa, Oryza sativa (indica cultivar-group)
MSTSNNGGPTVAVKLYIDKEKKKVLFAESDKEFVDVLFSFLTLPLGTIVRLLGKQSQIGCLDELYKSVEALSEDYFQTKACKAMLLRPRNAAGSHCDRLKVKVDDTNERLIYVCPTSSCDARSFSSFWGVCNSCTVTTTLILREKPVDCRTVESNDDGVFVKSDLKFIIFDDLHVAPASTSTMFPLLGKFGLLEQRNIEEKVLELNSHKIINLLKRALVSKQSLTGLLCDHPVETDSVNLDHLREKLFPKQENTTDPKFNAVRITIVQTKDDSSVLYAEVGYDFVDLVFGLLSLPLGSTIKAYGQVTSGGSSGLDNLYRSINGSGIGCVKQECQSLLLSPMLAPFFGCGSSVLLQVQESPIKSWYCTGCYTCLRLYGSSSTLFCNGGHSKHGTVNEFNPKNRVGSSTSSDAYLKGGLGKFIVTNDLNIGP

SEQ ID NO: 43767 - protein, 737 aa, Oryza sativa (indica cultivar-group)
MEIEHLGARAAAAAGEDDQSPVEQVRLTVPTTDDPSLPVWTFRMWTIGLLSCAMLSYINQFFSYRSEPIVITQITVQVAALPIGHFLARVLPKRKFTVFGRECSLNPGPFNVKEHVLISIFANAGAAFGNGGAYAIDIINIIKAFYHRSISFPTSLLLVITTQVLGYGWAGLMRKYVVEPAHMWWPQSLVQVSLLRALHEKENLRMTRAKFFLIALICSAAWYVVPGYLFPTVGAVSWLCWAFPRSVTMQQIGSGMSGLGVGAFTLDWATVVSFLGSPLVYPFFAIVNVWVGFVLLVYVMLPIAYWVLNLYQASTFPFFSASLFDHTGEEYRISEIVNDRFELDTDAYARQGKIHLSLFFATSYGLGFATIAATLSHVTLFYGTEMYRRFRQAAREKPDVHTRLMRRYDDIPNWWFYGMLALAMVAALLLCTVFKDEVQLPWWALLCAVAVAFFFTLPISVITATTNTTPGLNIITEYVMGLIMPGKPIANVCFKVYGYISMNQAVSFLTDFKLGHYMKIPPRSMFLVQFIGTIVAGTVNMSVAWWLLSTVPHICDKKHLPEGSPWTCPGSRVFFDASVIWGLVGPRRIFGPLGYYGALNWFFLGGLAGPAVVWLLARALPRHAGWIRLIHLPVLLGATANMPPASTLNYTAWCSVGAVFNYLVFRRRKAWWQRYNYVLSAAMDAGVAIMGVLIYFCLSSRGITPDWWGNSDINIDHCDLSTCPTAKGVIVEGCPVF

SEQ ID NO: 43768 - protein, 859 aa, Arabidopsis thaliana
MTHTETLNLLDEIESFVSDQLQVVSYKWLSRNFSLSSNTAKRLLKDFVEKHGKGLEVVYIVSGLLKNGPSDYHARLASSTELPEVEKEFNGKYSVHIYSVQASIPMDPAAIWNTEFVQAEELFRQPSATDNCLKGNRFCGVSNSCVKRNIEGATENVTAPRTESVRTTGQSKSSSNFQKSTVPSNQGKNFQHSSSNVGHQAKSESIAAPAKNQSAKSSLDKEKAFHVPANKKNGQGEKSVTGTGGLLKNMWGRVPVKTEDDSPTVDVKNHITNHSEPQKPSHDADKKGGSDDETRDANFMRAPKDNRKRKVIFDFSDDEYEDVISLASPSSPKVNSRPDVELSSEDSGPEKPDADVSPEIKSEEPEASKEDRQNTASVDASTTLSTEKIQAIGSEAEVNPSKRRTTAVPSSPKRKKVLKSRIDDRGREVTEVVWEETETNAKKKEDTNTSKKLDDGKTANAVNRAVAQKKSPAIGNTAATNAGGKAGSKKGGNVKDPKQGNIMFECIGDHRRWLLEPFFYSENMGPTLTGLAKEASESILLPSESGFDGSRSPVCSSPDPNLNYRPVIGILSHPGDGASGRLTNDTSSTYIAASYVKFAEAGGARVIPLIYNEPEEVLFQKLELVNGVIFTGGWAKKYDYFEIVKKIFTKALERNDAGEHFPVYGICLGFELMSIIISQNRDILERFDAEDNASSLQFVDNVNNDGTLFQRFPPELLKKLSTDCLVMQKHKYGITPANFQANPALSSFFEILTTCIDENSKTYVSTVKAKRYPITGFQWHPEKNAFEWGSSAIPHSEDAIQVTQHAASYLVSEARKSLNRPESQKVLSNLIYNYKPTYCGYAGRGYDEVYIFTQPRSRF

SEQ ID NO: 43769 - protein, 591 aa, Arabidopsis thaliana
MKTISIFFVIILMSSSHAEDDVLCLKGFKSSLKDPSNQLNTWSFPNSSSSICKLTGVSCWNAKENRILSLQLQSMQLSGQIPESLKLCRSLQSLDLSFNDFSGLIPSQICSWLPYLVTLDLSGNKLSGSIPSQIVDCKFLNSLALNQNKLTGSIPSELTRLNRLQRLSLADNDLSGSIPSELSHYGEDGFRGNGGLCGKPLSNCGSFNGKNLTIIVTAGVIGAVGSLCVGFGMFWWFFIRDRRKMNNYGYGAGKCKDDSDWIGLLRSHKLVQVTLFQKPIVKIKLVDLIEATNGFDSGNIVVSSRSGVSYKADLPDGSTLEVKRLSSCCELSEKQFRSEINKLGQIRHPNLVPLLGFCVVEDEILLVYKHMANGTLYSQLQQWDIDWPTRVRVAVGAARGLAWLHHGCQPLYMHQYISSNVILLDEDFDARVIDYGLGKLVSSQDSKDSSFSNGKFGYVAPEYSSTMVASLSGDVYGFGIVLLEIVTGQKPVLINNGEEGFKESLVEWVSKHLSNGRSKDAIDRRIFGKGYDDEIMQVLRIACSCVVSRPKERPLMIQVYESLKNLGDQHGFFSEYSDEFPLIFNKQEHLK

SEQ ID NO: 43770 - protein, 162 aa, Magnetospirillum magnetotacticum MS-1
MSFLDRTARAFLLTELVQGLALTLRYMFKSKVTINYPYEKGPLSVRFRGEHALRRYPNGEERCIACKLCEAICPAQAITIEPEPRPDGSRRARRYDLDMTKCIYCGLCQEACPVDAIVEGPNFEYATETRAELMYNKSKLLANGDRWEAELAFRIAADAPYR

SEQ ID NO: 43771 - protein, 273 aa, Zea mays
  misc_feature (43)..(43): Xaa can be any naturally occurring amino acid
  misc_feature (56)..(56): Xaa can be any naturally occurring amino acid
  unsure (1)..(273): unsure at all Xaa locations
YYKYTGKRLRRLWRLSPKSESTPAAAAAPPPVAAPSVGAVPRXVTMTVLLAKAAAXLLHSTAAVSKNMGESLAVPAFRVGYPIITDKLDELYEKVKPKGVTMTVLLAKAAAMALAQHPVVNSTCRDGKSFTYNSNINIAVAVAIDGGLITPVLQDADKLDIYLLSQNWKDLVKKARAKQLQPNDYNSGTFTLSNLGMFGVDRFDAILPPGQGAIMAVGASKPTVVADKDGFFSVKSKMLVNVTADHRIVYGADLAAFLQTFAKIIEDPESLTL

SEQ ID NO: 43772 - protein, 441 aa, Zea mays
MASSTEDKMKALMKVLVDCTEDATKSLGGLVDHALDHMHDEEILARTLFAMKEKLELLQQDALEAKVQAFPEIAKYEWDDISVEPPSPSPPPTVTDPSVEEEEFYCPDVSDEWNPLGSGEVNPFPDSIPPSNTSTPLQGSNTIPSLPVNLDSDAEHSVHDINSPEKNAAPVQKPKKSKEQNFTGPEDLLLCTTWLQISSDPVVHTGQRREGLWARIEKRYNEQRGKFPCRVNRALSSRWDKIRADVSKFSGYYARVLREKQNGLTDDDKTSKAATLFAHEENKPFQYMHCWHQLKGEPKWESICSGQSFRRLNANPIGSTGKRPCGHDFSKSERHKPASSSSPEYLSRLQELTEKQIQRSIEKGEKKEKCSEEDREMEKKRLELEAQKVIIRQRELKLQELDSAEKRLQRLEATNEEDVDPEVWIMMKEQKKLQQFIFSFE

SEQ ID NO: 43773 - protein, 337 aa, Mycobacterium tuberculosis
MSKLAIIAGDGIGPEVTAEAVKVLDAVVPGVQKTSYDLGARRFHATGEVLPDSVVAELRNHDAILLGAIGDPSVPSGVLERGLLLRLRFELDHHINLRPARLYPGVASPLSGNPGIDFVVVREGTEGPYTGNGGAIRVGTPNEVATEVSVNTAFGVRRVVADAFERARRRRKHLTLVHKTNVLTFAGGLWLRTVDEVGECYPDVEVAYQHVDAATIHMITDPGRFDVIVTDNLFGDIITDLAAAVCGGIGLAASGNIDATRANPSMFEPVHGSAPDIAGQGIADPTAAIMSVALLLSHLGEHDAAARVDRAVEAHLATRGSERLATSDVGERIAAAL

SEQ ID NO: 43774 - protein, 243 aa, Polaromonas sp. JS666
MRLQGKTALVTAAGQGIGKATALAMAAEGAQVWATDVNEKLLADYAGVPNIKTAALNVLDKAAIQKLAAALPPLNVLFNCAGFVHAGSILQATDEDWDFAFNLNVRSQFWMIQAVLPKMLAHGGGSIINMASVCGFKGLPNRFVYGASKAAVTGLTKCVAADFVTQGVRCNAICPGTVDTPSLQDRINVFEDPAEARKNFVARQPMGRLAQAHEIAPLVVFLASDESAFVTGQSYAIDGGMTI

SEQ ID NO: 43775 - protein, 249 aa, Rickettsiella grylli
MFQGKTIIITGGSSGIGAATVALFSAQGAKIYILDKKKLKDRPSQSVYYLKCDVANTKEVQFAVESIIQKTHKVDYLFCNAGIHLFANLEESSLSAMHNVFATNVWGTVYCLQHLLPHMKRHQRGSIVLMASDQAFIAKEQCAIYGASKAAIAQLAKSTALDYARYGIRVNCVCPGSIDTPMYHAVLEQFKQKTGLSCQALKERIAEKLPLKRVGKPEEVAQLVGFLCSDAASFMTGALVSIDGGYTIQ

SEQ ID NO: 43776 - protein, 400 aa, Campylobacter coli RM2228
MSDIISIKDIDLSKKKVFIRCDFNVPQDDFLNITDDRRIRSAIPTIRYCLDNGCSVILASHLGRPKEISSKYSLEPVAKRLARLLDKEIVMAKDVIGEDAKSKAANLKASEILMLENLRFEKGETKNDENLAKELASMAEVYINDAFGVCHRAHASVEAITKFFDENHKGAGFLLQKEIEFAENLIKRPARPFVAVVGGSKVSGKLQALTNLLPKVDKLIIGGGMAFTFLKAQGFDIGNSLLEEELLEEANKILTKGKNLGVKIYLPVDVVAAPACSQESPMKFVPSQEIPSGWMGLDIGPASVRLFKEVISDAQTIWWNGPMGVFEIDKFSKGSIKMSHAISDGHATTVVGGGDTADVVARAGDADEMTFISTGGGASLELIEGKELPGVKVLRSGGVQ

SEQ ID NO: 43777 - protein, 284 aa, Cicer arietinum
SEEVRTIFITGLPEDVKEREIQNLLRWLPGFEASQLNFKAEKPMGFALFSSPHQAIAAKDILQDMLFDPDSKSVLHTEMAKKNLFVKRGIGADAVAFDQSKRLRTAGDYTHTGYVTPSPFHPPPPPVWGPHGYMAPPPPPPYDPYAGYPVAPVPMPAPVSIAAPSSYVPVQNTKDNPPCNTLFIGNLGENINEEEVRGLFSVQPGFKQMKILRQERHTVCFIEFEDVNSATNVHHNLQGAVIPSSGSVGMRIQYSKNPFGKRKDGNFPMAVPGANGAPVALTYQ

SEQ ID NO: 43778 - protein, 420 aa, Rhodopseudomonas palustris CGA009
MSQGVTAPFARHAMAYVLAGGRGSRLMELTDWRAKPAVYFGGKSRIIDFALSNALNSGIRRIAVATQYKAHSLIRHLQRGWNFFRPERNESFDILPASQRVSEEMWYRGTADAVFQNIDIIESYDPKFIVLLAGDHVYKMDYEKMLQQHVEQGADVTVGCLEVPRAEATAFGVMHTDTTDRIISFLEKPADPPAMPGKADKSLVSMGIYVFETKFLLDELRRDAADPNSSHDFGKDIIPYIVKHGKAVAHHFDKSCRRSSSEAVSYWRDVGTVDAYWAANIDLTDIVPELDLYDREWPIWTYGEITPPAKFVHDKEGRRGEAVSSLVSGGCIISGASLRHSLLFTGVRVHSFSHVENTVVLPYADIGRSCRLKNVVIDAEVKLPAGLVVGEDPEFDAKRFRRTENGICLITRAMIEKLDA

SEQ ID NO: 43779 - protein, 330 aa, Methanosarcina mazei Go1
MRLAVIEGDGIGREVIPAAVEVLDAFGLEFEKVPLEIGYARWERTGTAMSEEDMEIIKSCNAVLFGAVTTVPDPGYKSVLLTIRKELDLYANVRPVKPLSGVVGVSGRSDFDFIIVRENTEGLYSGIEEIGHDLSWTKRVITRKGSERISEYACELAKKRSGKLTIVHKSNVLKSDKLFLDVCRETASSYGVEYGDMLVDSMAYSLIMHPEKYDVVVTTNLFGDILSDMCAALVGSLGLVPSANIGKKYAFFEPVHGSAPDIAGKGISNPLAAILCVKMLLEWMGKPEARLIDAAIADLLQKKIITPDLGGRASTAEVGNAVAKYIMQNL

SEQ ID NO: 43780 - protein, 201 aa, Cicer arietinum
AILITLAVNDRIIMPLWKKMKGKPGFTNLQRIAIGLLLSTFGMAAASLCEVKRLSVAKSVKGNQATIPISVFLLIPQFFLVGSGEAFIYTGQLDFFITQSPKGMKTMSTGLFLTTLSLGFFISSFLVSVVKKVTGTRDGQGWLADNINKGRLDLFFALLTILSFINFVAFLVCAFWYKPKKAKPSMQMGAINNGSSVEEKC

SEQ ID NO: 43781 - protein, 142 aa, Cicer arietinum
AQLLGSIVASLLLVFATGLSVPAFSLSAGVGVGPALVLEIVLTFGLVYTVYATAVDPKKGNIGIIAPIAIGFIVGANILVGGAFTGASMNPAVSFGPAVVSWSWSNHWIYWAGPLIGGGLAGLIYEVVFISHTHEQLPTTDY

SEQ ID NO: 43782 - protein, 430 aa, Methanosarcina acetivorans C2A
MAETKSMGLWASASIGVGAMVGAGIFSIFGTAAQISGNAVYVSFIIAGMIALLNTYSYAKMGVRYPSAGGPVEFMLKGFGDGILSGGLNLLLWVGYVFGLALYAKGFSYYAITFLPAGSAPVWTSFFATAIILAFTAINFRGAKTVGKSELFIVSIKVGILLLFAAAGMFYVTPGNLSISAWPAPKNLFFGAGMVFLAYQGFGLITNAAEDMKNPEKNLPRALYLSVVLVIIIYVSVSLAVIGNLSVPEIQNAQDYALAAAAKPFLGDIGFKIMAFAALFSTSSAINASLYGGANVSYILAKDGELPEIFERKVWHRSPEGLFITSSLVILCANFLQLEGIGMLASTCLLMVYVAVNISHLRLLKETGAKSYIIWASLLSSLTFFCVLLYYEFMHSKTTLGLLGFTVFCCFAAEWTYRKYSGRLIKERTG

SEQ ID NO: 43783 - protein, 797 aa, Magnaporthe grisea 70-15
MGDRDRDYEEGSPDPESLYTKEYCIAHAVLLLQWATRTREKPMLQLRIPVWWQKLTVRSHCARVDKRTGHAVAIKIIDIESAEDEVEDIIQEIAILSELQSPYVTKYYGSYAKGAELWIVMEFCSGGSCADLMKPGLIGEEYIAIVVRELLLGLDYLHADKKLHRDVKAANVLLAANGQVKLADFGVSGQLSATMTKKNTFVGTPFWMAPEVIKQSGYDHKADIWSLGITALELANGEPPYADIHPMKVLFLIPKNPPPRLEGNFTKAFKDFIELCLQRDPKDRPSARELLRHPFVRHAKKTSYLTELIERHSRWSSTHKSENDEELDSQSDDEQQRQQQAANRAAVNEDMWDFGTVRLVGERGHVVHRPGLLNPLDEAATNARATRSHETEFEQNRQRYRSESPTKRLSQQQLDNDTVKSRQVSPQRRPVPSSPGKTTVQKIEREPETPRAVLKPAPISFDSAPSPDYDRELQKQLQREMDGMNIGDMIDPGHKDRTGLIPKTGPASSQAQKPIAHLGPIKLPEIPPFRGKHAGSSQPAAQPQTRQYQPPQPRQMQQQELPPHPPYRARDDTPEPPQHQQLPTPRPLQTQALQYQQQQQQQPGTPQHQDFPSPAPAPPNGEMDALNDVIFPALEEALKRRQIRLQQQIQAMPPGAASQFAGGAPAPTPRQQRAEAAHEKIRKLVYRVAHMCKEIDHYDKSEPVHMDTGKDAGGTFLEGFLEEIMLRVEPFDEGDTTRRSRVIGHPTKMLCEKREKKLPKGGRKVTKSSGDITRSIKHAQVVPFTMSNLTFAVLWAV

SEQ ID NO: 43784 - protein, 893 aa, Colwellia psychrerythraea 34H
MSDLPNIDIDSAETQEWLESMESVLENEGPERAHQLLETLIERARRGGTHLPFDATTAYVNTIPPGQEPNMPADQTIESRIRAAIRWNALVLVLRASKKDLELGGHIGSFASSSTLYDVGFNHFFKAATPENGGDFIFAQGHISPGIYSRAFMEGRLTEDQMNNFRQECDGKGLSSYPHPHLMKDFWQFPTVSMGLGPLQAIYTARFLKYLTDRGIKDCSGQRVYCYLGDGETDEPESLGAIGLASREGLDNLCFVVNCNLQRLDGPVRGNGKIIQELEGTFRGAGWEVVKVIWGSYWDSLIARDTSGKLLQLMNETVDGEYQNCKAKGGKYTRENFFNKYPETAAMVANMSDDDIWRLNRGGHDPVKVYAAYEKAMNTKGRPTVILAKTVKGFGLGASGEALNIAHNVKKMDVEAIKHYRDRFNIPVKDEDIADLPFYKFPEDSEEFKYMKARREALGGSLPARRVQAEEQLEIPALKIFDPILKGSGERQVSSTMTFVRVLNSLLKDKKIGKRIVPIIPDEARTFGMEGLFRQVGIYASEGQKYVPQDADQVAYYREDKKGQVLQEGINELGAMASWVASGTSYSTCNATTIPFYIYYSMFGFQRVGDLAWAAGDSQARGFLLGATAGRTTLNGEGLQHQDGHSHVQAGLIPNCVTYDPTYGYEIAVIVREGLRRMYEENENVFFYLTLMNENYQHPAIPDNKTVEDEIIKGIYQLEQAAPAKGKATANVQLLGSGTILEKVREAAQILANDYNVSSDVYSVTSFNQLGRDGQDVTRWNMLHPESEQRVPYIAKIITKEAGPAIAATDYIKNYSDQVRAYLDTEYRCLGTDGFGRSDSRANLRTHFEVSAAYVVVAALFELANRGEIKRSVVTEAIKRFDIDTEKLNPLYA

SEQ ID NO: 43785 - protein, 292 aa, Triticum aestivum
  misc_feature (9)..(9): Xaa can be any naturally occurring amino acid
  unsure (1)..(292): unsure at all Xaa locations
SSVSSSTKXRLLKQESTSQSPSTQPAAMDMGLEVSSSSPSSSSASSSPEHAAGRASLAKRPAGRTKFRETRHPVYRGVRRRGNAERWVCEVRVPGKRGARLWLGTYATAEIAARANDAAMLALGGRSAACLNFADSAWLLAVPPALADLSDVRRAAVEAVADSQRREAANGSLTVTATVTEEASCGAPEESSSESDSVGSSETSEPSADGEFEVPVAVDTDMFRLDLFPELDLCSYYASLAEALLLDPPAPVTTTYAYWDNGDGGADVALWSYCRALELLASTVDNSPRKKK

SEQ ID NO: 43786 - protein, 1075 aa, marine gamma proteobacterium HTCC2143
MPKRTDIKSILILGAGPIVIGQACEFDYSGAQACKALREEGIRVILVNSNPATIMTDPAMADATYIEPVEWQTVARIIEVEKPDALLPTMGGQTALNCALDLDRHGVLEKHGVEMIGASKEAIDKAEDRDLFDKAMKRIGLECPRSAIAHSMEEAFQVQSQLGFPCIIRPSFTMGGSGGGIAYNKEEFAEICERGLDLSPTSELLIDESLIGWKEYEMEVVRDKNDNCIIVCSIENFDPMGVHTGDSITVAPAQTLTDKEYQIMRNASLAVLREIGVETGGSNVQFGQCPDTGRFVIIEMNPRVSRSSALASKATGFPIARIAAKLAIGYTLDELQNDITGGATPASFEPSIDYVVTKIPRFTFEKFAEADSHLHTQMKSVGEVMAIGRTFQESIQKALRGLEVGSSGFEHQIDTDRSDARDILISELTNPGPERIWYVADALRSGMSIDEVYDFSKIDRWYLAQIEDIVLSENALKTQYLADLDANSIFRLKRKGFSDKRLAVLLNEEERAVREHRHVLGIHPVYKRVDTCAAEFATSTAYMYSTYEEECEANVSNKEKILILGGGPNRIGQGIEFDYCCVHAALAMREDGYETIMVNCNPETVSTDYDTSDRLYFEPVTLEDVLEIVHKEKPKGVIVQFGGQTPLKLARELEAAGVPIIGTTPDAIDRAEDRERFQHMIQKLGLKQPPNTTVRSTDEAIAAAASIGYPLVVRPSYVLGGRAMEIVYDEDELLRYMKEAVQASNESPVLLDHFLNAAVEMDVDAVSDGKDVVIGAIMQHIEQAGIHSGDSACSLPPYSLSAAQQDKMREQVKIMAIELGVCGLMNVQLAEQDGEIFIIEVNPRASRTVPFVSKCIGVSLAKIAARCMAGTSLKEQGFTTERIPPYYSVKEAVFPFNKFPAVDPILGPEMKSTGEVMGLGDTFAEAYAKAQLGAGEKLPTSGKAFVSVRDADKTGVVAVARKLLDLGFELVATRGTYKVITDAGMSAVMVNKVKEGRPHTVDLLKNDEIALIVNTTEGRRSIADSSAIRRTALAKKVFCTTTLAGADAVCEAIKEGKNKTREVRRLQDVHKRIVT

SEQ ID NO: 43787 - protein, 516 aa, Oryza sativa (indica cultivar-group)
MVIARGLLRSNASSSSSQAINLLKYVTSTGSLQGHTQNLCDASTRHFSSVPSPQSNSTEENGFKGHGMLAPFTAGWQSTDVHPLVIERSEGSYVYDIDGKKYLDSLAGLWCTALGGSEPRLAKAATEQLHKLPFYHSFWNRTTKPSLDLAKELLSMFTAREMGKVFFTNSGSEANDSQVKLVWYYNNALGRPDKKKFIARSKSYHGSTLISASLSGLPALHQKFDLPAPFVLHTDCPHYWRFHLPGETEEEFATRLANNLEELILKEGPETIAAFIAEPVMGAGGVIPPPKTYFEKVQAIVKKYDILFIADEVITAFGRLGTMFGSDMYNIKPDLVSMAKALSSAYVPIGAIMVSPEISDVIHSQSNKLGSFAHGFTYSGHPVACAVAIEALKIYQERNIPDHVKQISPRFQEGVKAFAGSPIVGEIRGVGLILGTEFADNKSPNDPFPAEWGVGAIFGAECQKRGMLVRVAGDNIMMSPPLIMTPDEVEELVSIYGDALKATEERVAELKSKKNN

SEQ ID NO: 43788 - protein, 511 aa, Mycoplasma penetrans HF-2
MDKILILDFGGQYTQLIARRIRDLNVYSEIVDYDISIEEIIKKNPKGIILSGGYDSVYGDRSIKPNKGIWDLNIPILGICYGFQVMMQENGGQVENDKDSEEYGSTDIRLTTNELFENIELDNNCWMSHSDSVIFLPKGFKVIASTNKCLVASACNREKKFYGVQFHPEVTQTTFGNQLLQNFVYSICDVAGDWEPKNIKLEKIEEIKSIVKDDYVLCAISGGVDSLVAAVLTAQAIGDKLYCVFVDHGLLRKNESQEVCALLKKLIGKNIFLVDQKQLFLSKLKGVVDPEQKRKIIGKTFIEVFEKVANKINVPFKYLLQGTIYPDIVESGSKFSKTIKSHHNVGGLPERLQFELLEPLKYLFKDEVRKLGLSLDIPYQNVYRQPFPGPGLAVRVLGEITEDKLEIVREADFLFRSYIDQLYKNSEHKPWQYFTVLTNSKSVGVVGDNRSYGYTLALRAVDSMDAMSAKWYKIPLEHLEKISSIICNKVKNISRVVYDITNKPPGTIEWE

SEQ ID NO: 43789 - protein, 456 aa, Campylobacter coli RM2228
MSQCPFFPKPYKNKASTLLTFLLKRRSWLDGLYERSYKMQTGYVKMPNFDLYVINDTKEVKRMMVDEVKEFPKSAFLHELLSPLLGESIFTTNGEVWKKQRELLRPSFEMTRISKVFNLMSEAVSDMMKRFEKYPNASIIEVDEAMTFITADVIFRTIMSSKLDEEQGKKILDAFVTFQEQSVHTAMRRMFRFPKWLSYVLGDRKRAKAGDVIRQALSDIIKPRYDAVSSGKAENFEDILGSLLLVVDAQTNQRFSFEEILDQVAMLFLAGHETTASSLTWTLYLLSLYPDEQEKAYKEIIQVLQGENIQISHLKQFRYLTHIFKESLRLYPPVGFFAREAKKDTKVRDKMIKKGSGVVIAPWLIHRHEGFWTNPHEFKPSRFEGEYKKDAYLPFGVGERICIGQGFAMQEAILILANILKKYKLELEEGFVPDVVGRLTIRSANGMRIKFSKREP

SEQ ID NO: 43790 - protein, 403 aa, Hyphomonas neptunium ATCC 15444
MAADIRLSDAIARVKPSATIAVTTKANEMKRQGLDVIGLGAGEPDFDTPENIKEAAIRAMREGKTKYTPSDGIPELKEAIVAKFARENGLTYKPSQVNVSPGGKAVLFNAFMATLNAGDEVVIPAPYWVSYPEMVLLCGATPVAVPCGADTAYKLSPEKLEAAITPKTKWLILNSPSNPTGAAYTGAELKALADVLLRHPQVWILTDDMYEHLVYDGFEYKTIAQVEPALYDRTLTMNGVSKAYAMTGWRIGYAAGPEKLIGAMRKVMDQSTSNPCSISQWASVEALNGPQDFLPVFRAAYAKRRNLMVDGLNQAAGIVCPKPEGAFYVYPSCAGLIGKKTAGGAVIDSDKTFAAELLEQEKVAIVFGEAFGLPETFRISYATSDAALTEALVRIQRFCASLS

SEQ ID NO: 43791 - protein, 625 aa, Arabidopsis thaliana
  misc_feature (598)..(598): Xaa can be any naturally occurring amino acid
  unsure (1)..(625): unsure at all Xaa locations
MDFFTSSKAKKDSKKSSGLFGKKTVSKSTPGSPAHPPGARSPPPSYLSNKRAETEYDFPMSNEQRPYWKQPASERVPNSHPRPPVYGYGTPDHRRDHGRERMEAMSYEPETNAPSSPYHPAGNRTPERPRKSTEYRREHQDRMYEADTRSNASPFHPFRSPSPSPFHTPDRRRDHYDMYEPEANTMLQNSAPGSPFHPAGSRSPPPYRTPDRRSNYDKEQFEDLYEQDGDVTPRNSSPPSPFHPAAYKTVGTQKLDTGFFLGISKSNSLSSESLRLTIEYVLVMLQSDQRSNHGKEQIEDFYEQDDDVTPRNSSPPSPLHPAASHSPPPPQPYRTPDHRRSHQDNEDFEAMYELDGDLIHQKSAPPSPVHGPYYSSSDDDNHSTYLYPEIRSPLRSRIVSENSTIVAAETYEQDKQFEPPELPDESQSFTMQEITKMRGLKNYESGKEESQSMISEAYVSVANYRVRQSVSETLQAIIDKHGDIAASSKLQAMATRSYYLESLAAVVMELKKTVLRDLTKTRVAEIAAVVKDMESVKINVSWLKTAVTELAEAVEYFGQYDTAKVEKEVCERDLTAKKGEMEEMTAELVKREKEIKEXREKVTVVAGRLGQLEMKGSKLNKNLDL

SEQ ID NO: 43792 - protein, 409 aa, Oryza sativa
  misc_feature (333)..(333): Xaa can be any naturally occurring amino acid
  unsure (1)..(409): unsure at all Xaa locations
MASMAARSSRKRRSPPPRGLGDLHDDVLERVLARLPPATFFRLRAVCRRWSAAAASPTFLRACARVPSRDPWFLMLSGARPRPPLAFDAAGRSWIPCRAAPGGSDGGADAAVPVASSGGLVLYRAPGTGELLVANPLTGASRALPSPPGAHGGAPRLHAIAMYGSPYRVALFADELPDLSMSVFDSSRGSWEGPVALSRRPDAAALLPDDAPSQGGADDTVYFLSKSGDVVATNMQRSASKQYSSVVVAASSDGGDAVAYFLSHSGTVVACDTARRTFAELPRILPVYFEYSIDVVACDGAAYAVVLAEYLDTASLRVWGFAGGAWRQVAAMXPPAMSHAFHGKKADINCVGHGGRLMVCVSSGEANGCFMCDVGSNQWEELPKCVNGDGEVNDFLAAFSFEPRLEISV

SEQ ID NO: 43793 - protein, 269 aa, Bradyrhizobium japonicum USDA 110
MMSAKDAIMGSGARGGASPMPTIPFFKHATLREIIITRLCCAADAVVVLCCAIYLVGCYHAAGLRWPWLIVALLIGYFLADFFSGLVHWAVDTWLDEGGLGRGIAMTREHHTHPSHVLLYEFLDQASLGAAPSAVVVGISAAITALFPVSALTYALMIVWFVIATCMLFGMSFHNLAHWRVRPPLLRMAQRLHLVCSPEHHLRHHRDHTVRYCVINGWANYPCDSLRLWSRLERLVTATTGRTPRADDAEWQRKLNDTGIFVETPRPAG

SEQ ID NO: 43794 - protein, 326 aa, Arabidopsis thaliana
MEEERDHNASESSLPSLSKQLESSTLGGSAVDVPVVDLSVSDEDFLVREVVKASEEWGVFQVVNHGIPTELMRQLQMVGTQFFELPDAEKETVAKEEDFEGYKKNYLGGINNWDEHLFHRLSPPSIINYKYWPKNPPQYREVTEEYTKHMKRLTEKILGWLSEGLGLQRETFTQSIGGDTAEYVLRVNFYPPTQDTELVIGAAAHSDMGAIALLIPNEVPGLQAFKDEQWLDLDYIDSAVVVIIGDQLMVWMTNGRLKNVLHRAKSDKDKLRISWPVFVAPRADMSVGPLPEFTGDENPPKFETLIYNDYIDQKIRGWALEDLPVY

SEQ ID NO: 43795 - protein, 242 aa, Bradyrhizobium japonicum USDA 110
MSRIDASCIWESTEMIEAKDNATGRALLFDIDGTLANTDPLHLKAFNEVLGPRGHVFDHARFSRELQGFANVSIGERFLPDEAPERRASILDEKEEVFRALVAGQIEPLPGLMALLDRADAAGVPMVAVTNAPRLNAELLLSGLGITDRFKALVIGDELPHGKPHPLPYQEGLRFVGARPETSVAFEDSRTGVQSATAAGIPTIGIRTSLSHADLVAAGAVASAGAFDDPALLAPLAAAMAW

SEQ ID NO: 43796 - protein, 487 aa, Colwellia psychrerythraea 34H
MSLVRYRNFVDGAYMANDSGETFDVINPATGKVIYQVEVADGKIKQEAITSAQSGFATWSAMSAIQRSRILLKAVALLRERNDELAEIEVLDTGKPWQEASVVDVESGADSIEFFAGLAPGIEGNQQQVDGDFYYTRREALGICAGIGAWNYPLQIACWKAAPALACGNSMIFKPSEETPLGALKLAEIFTEAGIPDGVFNVVQGAGEVGSWLSHHPDIAKVSFTGEVGTGKKVMAGAATTLKDVTMELGGKSPLIIFDDADIDNAVSAAMLGNFYTQGEVCTNGTRVFVQESAYPKFIEKLLQRTRQNIIVGDPMDPETNFGALISKKHFDLVSDYIKVGIKEGATLLHGGTSLQPDNAPNGYFIAPTIFTDCTDGMTICREEIFGPVMSVLIFIDEDEVVARANATDYGLAAAVFTQDINCAHRVIHKMEAGICWINSFGASPAQMPVGGYKQSGIGRENGLVTLNHYTQIKSVYVGLQPLDSPF

SEQ ID NO: 43797 - protein, 498 aa, Streptomyces fungicidicus
MTSPLFRTKKVEQSIRDTEEPEHALKKSLSALDLTVFGVGVIIGTGIFVLTGTVAKDNAGPATALAFVVAGVVCALAALCYAEFASTVPVAGSAYTFSYASLGELPAWIIGWDLVLEFALGTAVVAVGWSGYIQSLLSNAGWEMPAALGSREGADVFGFDILAAALVLVLTGILVLGMKLSARVTSVVVAIKVTVVLVVIVAGAFFITADNYDPFIPKSEPVPAGDSLASPLIQLMFGWAPANFGVMGIFTAASVVFFAFIGFDIVATAAEETKNPQRDMPRGILGSLLICTVLYVLVSLVVTGMQHYSELSVDAPLADAFKATGHPWFAGFISFGAAVGLTTVCMILLLGQTRVFFAMSRDGLLPRFFSRVHPRFRTPYRPTILLGVAIAILAGFTPLNELAALVNIGTLFAFVIVAISVIILRRTRPDLPRAFRTPWVPVLPIVSVAASLWLMLNLPAETWVRFGIWMAVGVVVYFLYSRKHSRLAEERGGERTSS

SEQ ID NO: 43798 - protein, 551 aa, Oryza sativa (japonica cultivar-group)
MAVSLLPAVLVLLAIVAPLLYLVLLPAVKYTTRNGAARWEDDGGDGRRRRRLPPSPRGLPLLGHLHLLGALPHRALRSLAAAHGPVLLLRLGRVPVVVVSSAAAAEEVMRSRDMEFASRPRMAMAELLLYGGRDVAFAPYGEYWRQARRICVVHLLSARRVLSFRRVREEEAAALVGRVRAAAADVVVDLSDLLIAYSNTVLTRIAFGDESARGGGGGGDRGRELRKVFDDFARLLGTEPMGELLPWFWWVDALRGIDGKVQRTFEALDGILERVIDDHRRRREGGRRMDDDGGGDHRDFVDVLLDVNETDKDAGIQLGTVEIKAIIMLICFLLHGHEQDMFVGGSDTTTTMMAWTMAELINHPRAMRKAQNEIWAVVGNTSHVTKDHVDKLPYLKAVFKETLRLHPPLPLLIPREPPADTQILGYTIPAHTRVVINAWAIGRDAAAWGQQPDEFSPEKFLNSTIDYKGQDFELLPFGAGRRGCPGIVFGVSAMEIALASLLYHFDWEAAATDHRRRGSQAWALPVDMSEVNGIAVHLKYGLHVVAKPRMP

SEQ ID NO: 43799 - protein, 587 aa, Porphyromonas gingivalis W83
MKEFKVTTGPLPGSEKIYVEGERFPFLRVPMRRIRMSDTILENGEREKNEDVVVYDTSGPYTDTSYEVNLHRGVPKIREQWIEDRGDTVRLEGLSSEYGRIRQSDASLEKLRYEHVCTRPRAAKDGCATQLYYARQGIVTPEMEFVAIRENQLIDQVRTRYRAEEGEPLGAVIPRKITPEFVRDEIAAGRAILPANINHPESEPMIIGRNFLVKINANIGNSPISSTIEEEVEKAVWAIRWGADTVMDLSTGDHIHETREWIIRNSPVPIGTVPLYQTLEKVQGDVTKLNWEIFRDTLIEQAEQGVDYFTIHAGLRWHHVPLTLRRLTGIVSRGGSIIANWCTTHKRESFIYEHFEEICQILARYDVAISLGDGLRPGCIHDANDAAQIAELKTLGELTEIAWKYNVQTIIEGPGHVPMHKIRENMEIQLEACHGAPFYTLGPLVSDVASGYDHITSAIGAAQIGWFGTAMLCYVTQKEHLGLPNREDVREGVVTYRLAAHAADLAKGHPTAYWRDYMMSKARFEFRWKDQFHLSLDPEKAIQFHDATLPDEGHKEAHFCSMCGEHFCSMRANKNFRKLLNEEAVSK

SEQ ID NO: 43800 - protein, 389 aa, Synechocystis sp. PCC 6803
MRLTQRVSQVVPSITLEITAKAKAMRTEGIDVLSFTAGEPDFTTPPHIVEAAKLALDEGKTRYGPAAGEPALRQAIAKKLREKNNLPYEAANILVTNGGKHSLFNLMLAMIEQGDEVIIPAPYWLSYPEMVRLAEGTPVIVNTTAATDYKITPEQLRQAITSKSKLFVLNSPSNPTGAVYTPAEIRALAAVILEYEDLYVVSDEIYERILYDGTEHLSIGAVNDEIFQRTIISNGFAKSYSMTGWRVGYLAGELPLIQACSTIQGHSTSNVCTFAQYGAIAALENPQTCVETMVKAFTERRQVIVEGINQIAGLSCPNPKGAFYVFVDIAKTGLNSLEFSARLLESHQVAVIPGAAFGADDCVRFSYATDMDTIKQGLAELERFVSTLA

SEQ ID NO: 43801 - protein, 391 aa, Colwellia psychrerythraea 34H
MSIIKMADLTLANQRVLIREDLNVPVTDGKITSDARLRAALPTLKLALEAGAKVMVMSHLGRPTEGQPEEKFSLKPVTDYLSAALNYPVRLVTDYLDGVDVAAGELVVFENIRFNLGEKKNDDTLAKKLAALCDVFVMDAFGTAHRAQASTHGVAKFAATACAGPLLSGELEALGKALDNPARPLVAIVGGSKVSTKLTVLDSLAGIVDQLVVGGGIANTFIAADGHNVGKSLYEADLVEEATRLTKQAKANNGDIPVPSDVVVATEFSASATATLKPVNEVTADEMIFDIGPETAKALTEIIANAGTIVWNGPVGVFEFDQFGEGTKVIAQAIADSSAFSIAGGGDTLAAVDKYEIADKISYISTGGGAFLEFLEGKKLPAVEILEQRAK

SEQ ID NO: 43802 - protein, 631 aa, Methanosarcina acetivorans C2A
MTNERVMQLIREAYEKNLTTLDLSENQLTQLPSEITELKNLTTLNLSGNQLTQLPSEIGELKSLTSFDLSVNQLTQLPPEIGELKNLTILNVYRNQLIQLLPEITELKNLTTLDLSLNKLTQLPPEIGELNNLKTLYSSSNQLTQLPLEITKLKNLTELYLSSNLMIRLPLEITELKNLTTLNVYRNQLIQLPSKITELKNLKKLDLSRNQLAQLPPEIAELKNLTTLDLSRNQLAQLPPEIAELKNLTTLDLFENPLISLPPEIVSQGVKAIFTYLKQSKTTENNEAKLIVVGDGKVGKTCLAYRLINDEFLEDVQITEGINISKWEIPAPYSENRKIKLNIWDFGGQEIYHSTHQFFLTNRSVYLLVWNARITKDYTNIYYWLHTLEAFGEDSPIILVMSKMNESDDDLNLKDLKSKFLQIAGYVKIDSKDGKGISNLKEIICETVWNLPLMRVKWVDSWYEVRNELEGIGDNLILYDEFCEICRSRGLDAENIDILDGYLHDLGIILHFKDRIGLKNIVILKPEWATGAFYKILSAKSVLHNEGVLLQNELDRIWDKETYPSAVHSQLMELMNKFELAYELPDKKRYLIPELLPKNEPDYDWDDEENLYFYYSYDSFLPSGIITRTHA

SEQ ID NO: 43803 - protein, 462 aa, Wolinella succinogenes DSM 1740
MQPLFLEVSTLDSAAVELFGMSHELLMENAARSLAELIRARFRAGSVVRIVSGSGNNGADGIALARMLWGDYRVRLWLPLGCASDLAKLQLRRAQALGIEGVEKLGQGDVLVDALFGSGLSRDLGLDSLEVIREMNEARGYKIACDIPSGIDSKGNPRPIAFKADLTCAMGAIREALLSDSTKEFVGELVVGNLGISQRLYEQNQPPSAYLLGREDVRLPWRVREDSHKGSYGHLAVVAGEREGAAVLAALAGLHFGAGLVSLVGEVKNPPYELMQGVSVPKGASALACGMGLGERECPKDAWELPSVLDADILGREEILSLLEKNPSLVLTPHPKEFANLLGVLGIAQVSTLEVQKDRMGWARIFGERYPRAVLLLKGANPIILQGERLYINPLGGAMLAKGGSGDVLGGIIASLLAQGRSPLESAIEGSLAHTLAASRVEKANYALTPLDLIQALGKLSL

SEQ ID NO: 43804 - protein, 887 aa, Fulvimarina pelagi HTCC2506
MPQRIFPFQKGRAERPADPLESLGLKGADLSLLASLNLPVPPGFTISTYAWREAKGGRDDLPMGLRADLRDQVEALEEVTGRRFDGDRRPLLLAVRSSAKTAMPGLAESVLDVGLNGRTVEILAEELDDATFAFRSYRRLIESYAQLVFDTDPTDFEEIADEEAGEKGWTGEPASIDDWRSLIARLNAFLADELDVVMPQTPFEQLVEIVNAVFKSWRSAPAQAYRALHGIPENSGLAVTIHSMIFNERNAQSGRGRALSRDMATGRPQLTGEFQLGSGHVLRNGEHRTIDLAGALADGGSDYPADIADLDDHVRAVEAYLGDLAEVEFMIGDGELFLLQSRVGRRSASEAVRLAVEFVRDGLIDEAEALTRIDATSLDQLLHPSIQRDESFVVMARGMPASPGAATGEIVFSSDRAQAVAAEGRKVILVRHETFPEDIHGMHVSEGVLTIRGGTTSHAAVVARGIGKPCVTGAGTLRLNAATGELHAGNKVLRQGDAITIDGASGEVIEGAVTLVRPSLDGDFATLMEFADRARQMKVRTNAETPAEARAARDFGAEGIGLTRTEHMFFEGDRVRAMREMILASDENGRRAALEKLLPIQRADFVELFEIMAGLPVTIRLLDPPLHEFLPQAENDIDEAAEFLGVNVSSLRERIAALQEFNPMLGHRGCRLAISYPEIAEVQSRAIFEAAVEAGAKTGAAVTPEIMVPLVSLRRELDFVKERIDAVAAQVIEETGTKLTYRVGTMIELPRAIVRADTIAEAADFFSFGTNDLTQTVFGISRDDAGTFLSTYVREGIVERDPFQTVDVEGVGELIQIAVEKARRTKPDIELGVCGEQGGDPASIAFFAEAGLDYVSCSPFRVPIARLAAAQAAIREGRITRGGRSRR

SEQ ID NO: 43805 - protein, 352 aa, Bacillus sp. MB24
MKEILDSIVIGGGQSGLASGYHLQKKGLQFLILEASEQTAGSWPCYYDSLKLFSPARFSSLPGMKFPAHPNDYPTRNEVIDYLQNYVKKFQLPVMTNQRVVSVEREDEIFKVQTVSGKTFLTRTIINATGSFHSPFNPIIKDQEKFKGNIIHSAMYRSPNHYINQRVVVVGRRNSAVQIALELADVSRVSLAVRKPVQLMKQKVWGKDLHFWLKVLGMDTFPFWRFGKTAPSSGGVIDLGDYKERLARGNPDQKPMFTSFYADGVVWPDGKKEPIDTVIFATGYHPNLSYFNAIGALDSEGNPLQIGGVSTKVQGVYYVGLEGQRSFSSATLRGVGSDAKFVVRKLISYLKI

SEQ ID NO: 43806 - protein, 372 aa, Hordeum vulgare subsp. vulgare
MGNCAGVQGNAEINPTFSAPNTSGNNSKSSSSNATDTSTFGKSSSSSVPPTPRSEKEILQSSNLRKFTFSELKSCTRNFRTDSLLGEGGFGSVFKGWIDERTFTPVKPGTGMIVAVKKLKLDSFQGHKEWLAEVNYLGQLSHPNLVKLIGYCLEDEQRLLVYEFMPRGSLEHHLFRRAPHFQPLSWNLRMKVALEAARGLAFLHSDEAKVIYRDFKTSNVLLDSEYNAKLSDFGLAKDGPSGDKSHVSTRVMGTQGYAAPEYLATGHLTTKSDVYTYGVVLLELLTGQRALDKNRPPGQHNLVEWARPYINSKRRVIHVLDPRLGSQYSLPAAQKAAALAMQCLSMDARCRPDMDQVVTVLQKLPEVKKTYK

SEQ ID NO: 43807 - protein, 378 aa, marine gamma proteobacterium HTCC2143
MSKRDYYEILGVARDSAGKDIKKAYRRVAMKFHPDRNPDDKDSEEKFKEASEAYEVLSDSQKRAAYDQYGHDAVNGNAGAGGFGGGNGNFGDIFGDVFGDIFGGGGGGGGRSRGPARGSDLRYNLDVDLEAAVKGTEVKIRIPTLVSCEPCSGSGAKKGSAPVTCTTCGGIGQVRMQQGFFSVQQACPNCRGKGKMISDPCNSCHGQGLKEETKTLSVKVPPGVDTGDRIRLSGEGEAGPDGGPSGDLFVQINVRSHSIFERDGKNLYCEVPISITDASLGGELEVPTLDGRVKLKIPEETQTGKLFRLRGKGVAPVRGGSTGDLLCRVVLETPVNLTKSQKDLLQQLQESFEKEGNQSPKKSSWFAGVKSFFDDMKV

SEQ ID NO: 43808 - protein, 174 aa, Triticum aestivum
MPAYHSSFNSESERQICGLALVPLKTKAKGPAPVERDPAKEDIIDEALNFFKANVLFRNFEVQGPGDRVLIYLTLYITACLQKLQNTDKNAAEKVLFQLAIENFAIPGDRNFALGGFVTNPANRGEADSVRQYLTQLRQECGLRLIERVFAQDPSNPSKWWLCFSKRKFLNKTL

SEQ ID NO: 43809 - protein, 281 aa, Xanthomonas oryzae pv. oryzae KACC10331
MGHACASTAQQRPFSCVLKRGTHVTTHRWRLDGQTALITGASAGIGLAIARELLGFGADLLMVARDADALAQARDELAEEFPQRELHGLAADVSDDEERRAILDWVEDHADGLHLLINNAGGNVSRAAIDYTEDEWRGIFETNVFSAFELSRYAHPLLTQHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAASYITGECIAVDGGFLRYGF

SEQ ID NO: 43810 - protein, 424 aa, Rhodopseudomonas palustris CGA009
MATGGLCPALHARRGLAGHQPERDAMTPSAASALVEKTPLETYVPPAKPSLIGLSRAQLCDRLGDVGVAPPQRKMRAQQLWHWMYVRGARDFSEMTNVSKEMRAMLAEHFTVDRPEVVAEQISADGTRKWLLRLPSGGDGQKAHEVECVYIPETDRGTLCVSSQVGCTLNCAFCHTGTQRLVRNLTAGEIVGQVMVARDRLGDWIDRETPNGNRLITNIVMMGMGEPLYNFDAVRDALLIVSDNEGIGISRRRITLSTSGVVPNIKRTGDEIGVMLAISLHAVRDELRDELVPLNRKYPLKELLQACRDYPGASNARRITFEYVMLKGVNDSLDDARKLVQLLKGIPAKINLIPFNPWPGSNYECSDWDQIEKFSEYVFNAGYSSPVRTPRGRDILAACGQLKSETEKLSVRERNALRAMAMTD

SEQ ID NO: 43811 - protein, 1161 aa, Bartonella quintana str. Toulouse
MPKRTDIRSILIIGAGPIVIGQACEFDYSGTQACKALKEEGYRIILVNSNPATIMTDPDLADATYIEPITPEIVAQIIAHERPDALLPTMGGQTALNTALSLKRMGILDRYHVEMIGANADAIDKAEDRALFRQAMAKIGLETPRSMLANATELKEENRQLHAKKRHELQAKLSGDALDRALEKLERDWRHTEANRKQHYIAHATAKAVQALDIVGLPAIIRPSFTLGGTGGGIAYNRSEFYEIIERGLEASPTTEVLIEESVLGWKEYEMEVVRDKNDNCIIVCSIENIDPMGVHTGDSITIAPALTLTDKEYQCMRNASIAVLREIGVETGGSNVQFAINPENGRLIVIEMNPRVSRSSALASKATGFPIAKVAAKLAVGYTLDELKNDITGGTTPASFEPSIDYIVTKIPRFAFEKFPGSSPVLTTAMKSVGEVMAIGRTFQESLQKALRGLETGLTGLDEIVIPEHAEGDEKNSMRSAIAKPSPDRLRYIAQAIRIGLPLNEIHQISKIDPWFLEQIASIIAMEQRIRTHGLPQDAGNLRILKAMGFSNTRLANLTGQEPDDIAALYKSLNVKPVFKRIDTCAAEFSSPTAYMYSTYEVPFASVEHSEAQVSKRKKIAILGGGPNRIGQGIEFDYCCCHAAFALRDAGFEAIMINCNPETVSTDYDTSDRLYFESLTAEDVIAILETEQQKGELVGVIVQFGGQTPLKLAKTLEKHNIPILGTSPDAIDLAEDRDRFQKLLFKLNLTQPKNGIAHSVEQTHLIAHELGFPLVVRPSYVLGGRAMQIIRDERSLQNYLLENIPELVPEDIKARYPNDKMSQLNTLLDKNPLLFDTYLTEAIEVDVDCLCDGKETLVVGIMEHIEEAGIHSGDSACSLPVRTLSHKLVIELERQTKALAQALHVRGLMNVQYAVKDDTIYVLEVNPRASRTVPFVAKAIGRPIAKMATRIMTGETLHNAIQTYGGLPSSQHKQRIAVKEAVFPFARFPGVDTLLGPEMRSTGEVMGLDYEFALAFAKAQLGAGVELPKEGTLFVSVRDEDKKHVLNPVKRLAKLGFSVLATSGTQKFLSEHNVKAQKINKVLEGHPHIEDAIRNRQIQLIFNTTSTASAISDSKSLRHAALMQKVPYYTTMAGAKSVVEAIEALKKKCLKVRSLQSYFT

SEQ ID NO: 43812 - protein, 656 aa, Polaromonas sp. JS666
MCGLAGYFSGQWPADGEQASARLKAMTDAIAHRGPDSDGYWLDAATCMALGHRRLAILELSAAGAQPMHAASGRYVIAYNGEIYNHLDLRADLQKSGQSPAWRGHSDTETLLAGFDAWGIQGAVERTVGMFAFAVWDRQERMLTLGRDRLGEKPLYYGWQGSGSSAVFLFGSELKALRAHPAFGAQINRDALCLYMRHNNVGGSHSIYQGIHKLPPGTLLTVSRQTPEPVIRPYWSGAEVARCGVAQPFGGTSGEAVDALEALLKDAVRQQMMADVPLGAFLSGGVDSSAVVALMQTQSLRPVKTFSIGFHEAAYNEAEHAKAVAQHLGTEHTELYVTPEQAMAVIPRLPTLYDEPFADSSQIPTFLVSQLARQHVTVSLSGDAGDELFGGYNRYQLTASLWRKLSAAPLPLRRAAAWGLTRFSPQSLNSLAALMPASARWAHMGDKLHKGAGVMAGRTVEDLYLGMVSDWHDPAAVVIGGREPATLLRGRRPDLPGLTDVERMMALDMLSYLPDDILTKVDRAAMGVSLETRVPFLDHRVVEFAWRLPLHYKLRQEGGRYTTKWALRQVLYRHVPQALIDRPKMGFGVPIDRWLRGPLRDWAEDLLSETRLKREGYFKPAPIRQKWAEHLGGQRNWAPHLWTALMFQAWLQANHA

SEQ ID NO: 43813 - protein, 400 aa, Bartonella quintana str. Toulouse
MAFIADKLSRIKPSATIAVSQKARNLKALGRNVITLGAGEPDFDTPNNIKNAAIEAIRRGETKYTPVSGIPELRQAISAKFKRENNLTYQPEQIIVGTGGKQILFNALMATLNKDDEVIIPSPYWVSYPEMVTLNGGIPIFVETKAEFSYKLQPQELEAAITHKTKWFIFNSPSNPSGAAYTHNELKKLTDVLVKYPHVYILTDDIYEHLIYGGFTFVTPAQVEPNLYNRTLTMNGVSKAYAMTGWRIGYAGGPPELIKAIDTIQGQQTSGTSSISQWAAVEALNGPQDFIAQNKSIFQARRDLVVSILNQAPGINCPTPEGAFYVYPSCAELIGKKTPEGNVINDDEDFVTALLEAESVAVVHGSAFGLGPAFRISYATSEKLLEEACLRIQRFCNNLL

SEQ ID NO: 43814 - protein, 878 aa, Phaeosphaeria nodorum
MAPRASSPALSENEFDIFDALAGGDEAAQPMRVTADLGIDLEFGSDDGSDDEAFIAAKQAAANRKNANAPGKSGKKGGGFQAMGLNVALLKAIAQKGFKIPTPIQRKAVPLILQGDDVVGMARTGSGKTAAFVIPMIERLKTHSAKVGARGVIMSPSRELALQTLKVVKEFGRGTDLRTILLVGGDSLEEQFNSMTTNPDIIIATPGRFLHLKVEMGLDLSSVQYIVFDEADRLFEMGFAAQLAEILYALPTSRQTLLFSATLPKSLVEFARAGLQEPKLIRLDAESKISPDLKSAYFTIKSGDRDGALIHLLENVIKMPVGQTEVWKQAKEEADNLSKGKKRKRGSGNPKDAPVEESTIIFAATKHRVEYLSTLLKAAGYPVSYVYGNLDQTARQEQVKDFRAGLTRILVVTDVAARGYRHATHKPRHQLRLPFSTKNLCSSSGEDGPRWAEGLGIQPVQTCRSAISHRLTNVPWQTPSGCLAPYQLEPSVELVNKQLTDDEDLVNLLNVAEKGERQYQRTRNQASNQSVHRAKDLASDSKFAETHMLFNDEMHDALRAKEDMLERIQGFRPAETVFEIGKRGTNSEAAEIMRKRRVAVERQKTKQAFNKANDESSGLTRPTADALPDDELDSEDDQQAAVGDYESESDELEVTVSQPESKKSGKDVWRSDEFFMSYLPKENFAEEKAYGVQGGDAGNSNFVSAARSAEMSLVNDEIQGFADASKPRMRWDKKSKKYVSRANDEDGSKGAKMIRGESGQKIAASFRSGRFDDWRKANKVKMQRVGEMEAPNRSTQFNSGGPRYKHKAEKAPKQADRYRDDYHVQKQRVQEAKEKRIGHFKDGGAKNELKDVDTVRKERRVQEKRKEKNARPSKKRKF

SEQ ID NO: 43815 - protein, 548 aa, Raphanus sativus
MKLLHGLALVFLLAAASCKAYEEITCEENEPFTCNNTARLSSKNFPKDFIFGVASSAYQIEGGRGRGVNIWDGFSHRYPEKAGSDLKNGDTSCESYTRWQKDVDVMGEINATGYRFSFAWSRIIPKGKVSRGVNQGGLDYYHNLIDALLEKNITPFVTLFHWDLPQTLQDEYEGFLDRQIIQDFKDYADLCFREFGGKVKHWITINQLYTVPTRGYAIGTDAPGRCSPMVDTKHRCYGGNSSTEPYIVAHNQLLAHATVVDLYRTKYKFQRGKIGPVMITRWFLPFDESDPASIEAAERMNQFFHGWYMEPLTKGRYPDIMRQIVGSRLPNFTEEEAALVARSYDFLGLNYYVTQYAQPKPNTYPSPKHTAQDDAGVKLSYKNSRGEFIGPLFVEDKDNGNSYYYPKGIYYVMDYFKTKYGNPLIYVTENGFSTPDSENREQAIADYRRIDYLCSHLCFLRKVINEKGINVRGYFAWALGDNYEFCKGFTVRFGLSYVNWADLNDRNLKESGKWYQRFISGTVKNPAKQDFLRSSLSSQSQKKRLADA

SEQ ID NO: 43816 - protein, 230 aa, Haemophilus somnus 2336
MKKIEQLFANNFSWANRMKEENAEYFKALAENQTPSYLWIGCSDSRVPAENLTNLKPGELFVHRNVANQVIHTDLNCLSVVQYAVDVLNIEHIIICGHTNCGGIKAAMVDQDLGLINNWLLHIRDIWFKHGHLLGKLSPEKRADMLTRINVAEQVYNLGSSSIVKSAWKSGKKLSLHGWIYDVNDGFLIDQGVTATSRETLEISYRDTIAKLFKLNEDELLLKPHQVKSE

SEQ ID NO: 43817 - protein, 546 aa, Raphanus sativus
MKLLGLALVLLLAAASCKAGEEITCEENEPFTCSNTAKLSSKSFGKDFIFGVASSAYQIEGGRGRGVNIWDGFSHRYPEKSGSDLKNGDTTCESYTRWQKDVDVMGEINATGYRFSFAWSRIIPKGKVSRGVNQGGLEYYHKLIDALLEKNITPFVTLFHWDLPQTLQDEYEGFLDRQIIQDFKDYADLCFKEFGGKVKHWITINQLYTVPTRGYAIGTDAPGRCSPMVDTKHRCYGGNSSTEPYIVAHNQLLAHAAAVDLYRTKYKFQKGKIGPVMITRWFLPYDDSDPASIEAAERMNQFFHGWYMEPLTKGRYPDIMRQIVGSRLPNFTEEEAALVAGSYDFLGLNYYVAQYTQPKPNPYPSETHTAMMDAGVKLTYENSRGELIGPLFVEDKDNGNSYYYPKGIYYVMEYFKTKYGNPLIYVTENGFSTPGSEKREQAIADYKRIDYLCSHLCFLRKVIKEKGVNVRGYFAWALGDNYEFCKGFTVRFGLSYVNWDDLDDRNLKESGQWYQRFINGTVKNPAKQDFLRSSLSSQSQKRLADA

SEQ ID NO: 43818 - protein, 637 aa, Solanum lycopersicum
MPTLVNYSGDDEFYSGGSFCSADLGLMLSLGHADVYCPPRKRARISGPFVVEDRSKDPSLEVLPDECLFEILRRLPGGRERGAAACVSKRWLTVLSSVKNSEICRSKSYNNLNDAIMISKDEDLEVECDGYLTRCVEGKKATDIRLAAIAVGTSTRGGLGKLSIRGSNSVRGITNVGLSAVAHGCPSLRVLSLWNVPSIGDEGLLEVARECHSLEKLDLSHCRSISNKGLVAIAENCPSLTSLTIESCPNIGNEGLQAVGKYCTKLQSLTIKDCPLVGDQGVASLLSSGASMLTKVKLHGLNITDFSLAVIGHYGKLITSLNLCSLRNVSQKGFWVMGNAQGLQSLVSLTITLCQGATDVGLEAVGKGCPNLKYMCIRKCCFVSDGGLVAFAKEAGSLESLILEECNRITQVGILNAVSNCRKLKSLSLVKCMGIKDLALQTSMLSPCESLRSLSIRSCPGFGSSSLAMVGKLCPKLHQLDLSGLCGITDAGLLPLLENCEGLVKVNLSDCLNLTDQVVLSLAMRHGETLELLNLDGCRKVTDASLVAIADYCPLLIDLDVSKSAITDSGVAALSRGVQVNLQVLSLSGCSMVSNKSVLSLKKLGENLLGLNLQHCSVSCSSVELLVEALWRCDILS

SEQ ID NO: 43819 - protein, 664 aa, Zea mays
  misc_feature (37)..(37): Xaa can be any naturally occurring amino acid
  misc_feature (445)..(445): Xaa can be any naturally occurring amino acid
  unsure (1)..(664): unsure at all Xaa locations
MLFHSLSSQLGCPIAQHVSTMPRNLECPVQTQMAVYXSALDRTLSSEYPTKSKSETKVGGWKRVFVQTDVGCVLAIQLNCGDNAHTVKRKLQLALFFPTVESVLKDDLSTIRNDSPLLLTKTFMHRSSSTPCLSPSGKDLQQQKDRGCPIELLVCPSRCSRTRQLVKDVARAIKKGVDPVPIKSGLGGAYYFRNSKGENAAIVKPNDEEPFAPNNPKGFIGKSLGQPGLKRSVRIGETCFREVAAYLLDYDNSANVPPTLLVKISHPVFHMNEDINFANKNIADGSIQAVSKTASFQEFIPHDFDASDHGTSSFPVSAVHRIGILDIRIFNTDRHAGNLLIKKVGPGADNFGEQTELIPIDHGLCLPECLEDPYFEWIHWPQSSVPFSVEELEYIAKLDPIKDAEMLRAELPMIREACLRVLVLSTVFLKEAAAFGLCLSEIGDXSKRQFTAKEEEPSQLELLCMETRKWVEERELFLPDEAGVEDGDDDFTQFPLDSDAFEPPAFCKFGSVKTSSRNPLSKLAECDEEDGDLSEEEGEHGDVLTSGALPQKVPPISKLSSSMKGLGFIGKSKPYRTGGVPKGKVTGRTNYSGKASEHQSGSRSANELLPPSASFVKLSDMSRKEWSAFLEKFQELLPSALRTRKHSAGVGQRPMPRLGTSCQF

SEQ ID NO: 43820 - protein, 263 aa, Synechocystis sp. PCC 6803
MMGKIEKFALTQNTSVFLVVLPDTQLNYPMAKIPTIDRRQLIQYGGAFLGTSLMATILGNQMAGNPAAQAQSANQTPQQLLTELMEGNGRFAAQKRVKANQDLYRLAEVAQGQNPFAAILSCADSRVPPEIIFDQGLGDLFICRIAGNVATPQEVGSLEFGTLVLGAKVLMVLGHQGCGAVKAAMDGGDLPGQIGSVIKKIDIGSVTDDSSNAASVVMATKANVEHQMAVLIQSPVLSQLIAEERLLIMGAYYNLESGIVTLL

SEQ ID NO: 43821 - protein, 457 aa, Glycine max
  misc_feature (409)..(409): Xaa can be any naturally occurring amino acid
  misc_feature (432)..(433): Xaa can be any naturally occurring amino acid
  misc_feature (438)..(438): Xaa can be any naturally occurring amino acid
  unsure (1)..(457): unsure at all Xaa locations
MEMEKEKESLTLGKRREPDLPVTVTETTSMPKKARSSERTCVHEVAVPSGYVSSKDEDLHGTLSNPLHNGPMAKSYPFTLDPFQQVSIACLERNESVLVSAHTSAGKTAVAEYAIAMSFRDKQRVIYTSPLKALSNQKYRELSQEFTDVGLIASDVTPAPNATCLVMTTEILRGMLYRGSEVLKEVAWVIFDEIHYMKDRERGVVWEESIIFLPPAIKMVFLSATMSNATEFAEWICNIHKQPCHVVYTDFRPTPLQHYVFPMGGSGLYLVVDENEQFREDNFLKLQDTFTKQNLGDGKRGGKGAGRGGKGGNASGGSDIYKIVKMIMERKFQPVIIFSFSRRECEQHAMSMSKLDFNSQEEKDTVEHVFQNAVLCLNEEDRNLPAFELMLPLLQRGIAVHHSGLLPVXIKELVELLFQEGLGKALFATETXXICNGXLNMPAKTVIFTLLLRNGDG

SEQ ID NO: 43822 - protein, 248 aa, Lactobacillus sakei subsp. sakei 23K
MTIQNKVVVITGASSGIGKETATLLAAKGAKLVLAARRESMLAPLAAALTAKYNTEIIYQKTDVTQLAEVKALIDSAITKFGRIDVLFNNAGLMPVSMLRDGKVDEWEAMIDINLKGALYGIKYALPIMEQQKSGHIITTDSVAGHFTGEGSSVYSATKYAMRAVMEGLRVEEVGKGIKSTLISPGHAQTELAAKISDPKLREAVLKSEAETGLSANDVANAVVYAIETPANVGINEVILRSIDQRDY

SEQ ID NO: 43823 - protein, 149 aa, Medicago truncatula
MSTPARKRLMRDFKRLQHDPPAGISGAPQDNNIMLWNAVIFGPDDTPWDGGTFKLSLQFSEDYPNKPPTVRFVSRMFHPNNGSICLDILQNQWSPIYDVAAILTSIQSLLCDPNPNSPANSEAARMFSENKREYNRRVREVVEQSWTAD

SEQ ID NO: 43824 - protein, 483 aa, Ceratodon purpureus
MALVTDFLNFLGTTWSKYSVYTHSYAGNYGPTLKHAKKVSAQGKTAGQTLRQRSVQDKKPGTYSLADVASHDRPGDCWMIVKEKVYDISRFADDHPGGTVISTYFGRDGTDVFATFHPPAAWKQLNDYYIGDLAREEPLDELLKDYRDMRAEFVREGLFKSSKAWFLLQTLINAALFAASIATICYDKSYWAIVLSASLMGLFVQQCGWLAHDFLHQQVFENRTANSFFGYLFGNCVLGFSVSWWRTKHNIHHTAPNECDEQYTPLDEDIDTLPIIAWSKEILATVESKRILRVLQYQHYMILPLLFMARYSWTFGSLLFTFNPDLSTTKGLIEKGTVAFHYAWFSWAAFHILPGVAKPLAWMVATELVAGLLLGFVFTLSHNGKEVYNESKDFVRAQVITTRNTKRGWFNDWFTGGLDTQIEHHLFPTMPRHNYPKIAPQVEALCKKHGLEYDNVSVVGASVAVVKALKEIADEASIRLHAH

SEQ ID NO: 43825 - protein, 359 aa, Prunus armeniaca
ETTFPRLAEPLGYVPKEDILYAIKAIVVTQRENGRRDDRKYSRMKYLISSWGIEKFRSVVEQYYGKKFEQFRELPEWEFKSHLGWNKQGDGSYYCGLHVDNGRIGGVMKKALREVIEKYNLSIRLTPNQNIILCDIRTAWKRPITTILAKAGLLHPRFVDPLNLTAMACPAFPLCPLAITEAERGIPDILKRVRSVFEKVGLKYNESVVIRVTGCANGCARPYMAELGLVGDGPNSYQIWLGGTPNQTSIARSFMNKVKIQDLEKVLEPLFYYWRRKRQSKESFGGYTNRMGFEKLHELVDKWEGPKVAPARYNLKLFADKETYEAVDELAKQQDKTAHQLAMEVIRNFVGSQRNGKSE

SEQ ID NO: 43826 - protein, 520 aa, Ceratodon purpureus
MVSQGGGLSQGSIEENIDVEHLATMPLVSDFLNVLGTTLGQWSLSTTFAFKRLTTKKHSSDISVEAQKESVARGPVENISQSVAQPIRRRWVQDKKPVTYSLKDVASHDMPQDCWIIIKEKVYDVSTFAEQHPGGTVINTYFGRDATDVFSTFHASTSWKILQNFYIGNLVREEPTLELLKEYRELRALFLREQLFKSSKSYYLFKTLINVSIVATSIAIISLYKSYRAVLLSASLMGLFIQQCGWLSHDFLHHQVFETRWLNDVVGYVVGNVVLGFSVSWWKTKHNLHHAAPNECDQKYTPIDEDIDTLPIIAWSKDLLATVESKTMLRVLQYQHLFFLVLLTFARASWLFWSAAFTLRPELTLGEKLLERGTMALHYIWFNSVAFYLLPGWKPVVWMVVSELMSGFLLGYVFVLSHNGMEVYNTSKDFVNAQIASTRDIKAGVFNDWFTGGLNRQIEHHLFPTMPRHNLNKISPHVETLCKKHGLVYEDVSMASGTYRVLKTLKDVADAASHQQLAAS

SEQ ID NO: 43827 - protein, 194 aa, Thermoanaerobacter tengcongensis MB4
MKIKTAEFVGSAFNESQYPKDKIPQIAIVGKSNVGKSTLINTVLGRKNLAKVSSTPGKTRGINFYLVNRAFYIVDLPGYGYAKVSKEMKKQWAYNIETFLNTSKNLKHALLLIDIRREPTEDDFMMVNWFSFKNLPFSVVLTKADKVNKSEANKAIENICRSFNISSDRVIVFSAVEKTGISEILRIFEEVIEK

SEQ ID NO: 43828 - protein, 130 aa, Methanosarcina acetivorans C2A
MVLLDPLANALSTIKNAEAIGKSSCVVRPASKNIGNVLKVMQDLGYIGDFEFIDDGKAGIYSVTLVGRINKCGAIKPRYSVGTASFERWEKQFLPAKNFGALIVTTSSGVMSQYEARDKKIGGQLLAYVY

SEQ ID NO: 43829 - protein, 280 aa, Prunus armeniaca
EKSAKRKRKNQYRGIRQRPWGKWAAEIRDPRKGVRVWLGTFNTAEEAARAYDSEARRIRGKKAKVNFPDETPRSSAKRSVKANPQKMQPKTNMNAIQPNLNQNINFVNDPNQDYYNAMGFLDEKPPTNNFGFMSTFPANDVALKSSTPSDAVPLYFGSDQGSNSFDCSDFGWGEQGSKTPEISSVLSSVMEESDDSLFLEDASPTKKLRSNPEDLVPVQDNAGKTLTDELSAFEMKYFQTPYLDGSWDASVDAFLSGDATQDGGNSVDLWCFDDLVGGGF

SEQ ID NO: 43830 - protein, 607 aa, Rhodopseudomonas palustris CGA009
MTLRNIAIIAHVDHGKTTLVDKLLQQSGTYRDNQRQVERAMDSNDLERERGITILAKCTSVVWGDTHINIVDTPGHADFGGEVERILSMVDGVIVLVDAAEGPMPQTKFVVGKALKLGLKPIVAINKVDRSDARVTEVVNEVFDLFAALDATDEQLDFPILYGSGKNGWMSDKPDGDPSEGMKPLFELVLKHVHPPVVEEGPFRLLGTILEANPYLGRIITGRIASGSVKPNQAVKVLSRDGKLVEQGRISKILAFRGLERVPLDIAEAGDIVAIAGLTKGTVADTFCDPAVDTPIQAQAIDPPTVSMSFIVNNSPLAGTEGDKVTSRLIRDRLLREAEGNVALRVVESADKDAMEVSGRGELQLAILIENMRREGFELSVSRPRVVLTRDENGQLLEPVEEVVIDVDEEFSGVVVQKMSERKAEMIEMRPSGGNRLRLVFYAPTRGLIGYQGELMTDTKGTAIMNRLFHNYLPYRGEIQGRRNGVLISNDQGEAVAYAMFKLEDRGPMMIEPGWKVYKGMIVGEHTRDNDLEINVLKGKQLTNIRTTSKDEAVRLTPPIRMTLEKALAYIEDDELVEITPKSIRLRKRLLDPNERKRAEKSKQAVA

SEQ ID NO: 43831 - protein, 93 aa, Glycine max
RTSSQVVTTVNRAGAGLVVQLTGLKSMVGFPTRKTNIAFTSIVGTGGGVHCLQGWPPIGKKKLGTFSYLPDLDDAQLAKEVDSLLRKGWIPCL

SEQ ID NO: 43832 - protein, 584 aa, Medicago truncatula
MGKSPGKWIKTVLFGKKASKSNIPRGREKLVNQKEGVVASKVSETGLALEPTSNTIAVHEEDLELENKEAENVLPGNQEIDTVGPVDQDAPLDPEKMKLEEAATKAQAAFRGYLARRAFRALKGIIRLQALIRGHLVRRQAVATLCCMYGIVKLQALVRGQIIRKSDVGFEIHEKCNLLKLQDAKPVKPIAISGKIMKLSANTFTRKLIASSTTIMALRLQYVCGDPNSVLSWSERWSACRFWKPIPQPKKIRDTKSQKKQGNISTGDAQMTKSKRTHRKLPTANFDVAPAQANPEVEKPKRNTRKFPSQPSDPLLENPQIELEKVKRNLRKVHNPVVEAAVLSEVESEIPKPHLEKEIVASSAGVSQQGVINSNEMVKKEATLTSEPEMGITPSPRDLVTKEVFDTPSSYQVNVESKPLTDITSKDKNISDDEVKNEPKDLEETVCKDENSHLTNGDLNHKEDQTGSENQKPTRKASIGAKQERAENGLINSPTVPSYMAATESAKAKLRAQGSPKVVQDGSEKNNSARRQSLPSPTNSKISSHSPRTQRPVHSGGKGGHKSDKAASSSRDGNGKVVQAEWKR

SEQ ID NO: 43833 - protein, 478 aa, Solibacter usitatus Ellin6076
MLHYDNFINGKFTPSTGTERITCLNPSTGEPICTVPESTAADMDAAIAAAATAQKAWGKRPAIQRAQALRAIAAKIREQVEPLARLITEEQGKTLGLARVEVAFTADYMDYMAEWARRIEGEILESDRPGETILLFRQPIGVIGGILPWNFPFFLIARKAAPALVTGNTIVIKPSEETPHNAVKFCELLAQTDLPPGVINIVHGRGAGAGKTLCASPKIGMISFTGSVETGSAIMAAAAPNITKLNLELGGKAPAIVMADADLDLAVNAVTSSRVINSGQVCNCAERIYVQSKVAAEFTDKLAAAMKSSVCGNPLGEAEVAYGPLINQAGYKKVDALVRGAVAAGATLVTGGNRLPLEGGYYYEPTVLSGCTQGMEIVRREIFGPVVPIVQFDDLDQAIDFANDSDYGLTSSIYTRDLNTALRACQEIHFGETYINRENFEAMQGFHAGWRKSGVGGADGKHGLYEFTQTHVVYMQRA

SEQ ID NO: 43834 - protein, 123 aa, Medicago truncatula
MASKVAMLLCLNILFFTVVSSTYVPCPPPPHKDHSHKHPTCPRDTIKFGVCADVLGLINVELGKPPKTPCCSLIDDLANLEAAVCLCTALKANVLGINLNLPINLSLVLNYCGKGVPKGFVCA

SEQ ID NO: 43835 - protein, 420 aa, Solibacter usitatus Ellin6076
MLATATTPMNAYDVALENFDLAANALGLDDSIRAMIKYPERILSVSVPVRMDTGKIVRFEGYRVQHSTMRGPAKGGIRFHPNVTMDEVKALATWMTWKCAVVNIPYGGGKGGVTCNPKELSMGELERMTRRYASSILPIIGPEKDIPAPDVYTTPQIMAWIMDTYSMNKGYPVHGVVTGKPLSIGGSLGRNEATARGVFYTTMSSCEHLGIQLAGSRVVVQGFGNAGAIAADLFHGAGAKVLAVSDTSGCIFNKNGLHIPAVVAYKARTGRLEGFPEATRITPAELLALECEILVPAALENAITEENAHTIHAKIISEAANGPVTPEADRILGSKGIFLIPDILCNAGGVTVSYFEWVQDENHLFWDEQDVNAKLEKIMKRSFADVLKIHLDKKVDMRLAANMLGVSRVAEACKVRGLYP

SEQ ID NO: 43836 - protein, 284 aa, Sorghum bicolor
MSGAAEEALLREYVIGEEVGRGRFGTVRRCYAASTGEPFALKTTPKAALRELEADPLDLALAEQEPKVHLLASAASRHVVALHAAFEDADAVHLVLDLCAGGDLFALVSARGPLPEPEAAGLVAQLADALAGCHRRGVAHRDVKPDNLLFDASGALRLGDFGSADWFGDGRPLTGLVGTPYYVAPEVVAGREYTEKVDVWSAGVVLYMMLSGTVPFSGATAGDVFQAVLRGNLRFPPRAFPAVSPEAKDLMRRMLCKDVWRRLSAEQVLSHPWIVTRGGSVAVA

SEQ ID NO: 43837 - protein, 1299 aa, Oryza sativa (japonica cultivar-group)
MELRWDPWQGNSSVTAYLTSSYRMPCFLYTLLSVSPFSVDLLVVGDCVNEHVVEAAGVWTDPEEEEERTARMSLAGSALEAALQAVGRGLDAAGDHRLLYCKGTGRLLMLDESRARDLTINGGVLRGVPPDVVVEEGHGILERIRQVPGPPTDEPVVCSFPKVRGVAPESRFGGIFNGSRRRAFREPPLPLGSFNSLFSFTGSWKNDEAATKSLAIDGYSVPLFKVKITSGELFLHESVKRAIPHSWDPSALASFIENYGTHIITSVTVGGKDEVYIKQHSSSQLSELEFRNYVKEIGSERFSDGDSKLNATPINYSEKDMTVIFRRRGGCDLVQNFNDWIKTVQSAPDVIGMTFLPIVSLVGDMPGKKHLARAIELYLKYKPQIEELQYFLDFQVQLVWAPVPPGIAGQHRKEPVCPSLQFSLMGPKLFVSTEQISVGRRPVTGLKLCLEGAKQNRLAIHLQHLGSLPKIFVPHWDSHITIGPPKWQGPEEQDSRWFEPIKWRNFAHVSTAPIEYTETSITDLSGVYIVTGAQLGVWDFGAKSVLHLKLLFSRVPGCTIRRSVWDHSPSSSLVHRTDEASSSSSDNAKLVKIVDMTETLKGPQDAPGHWLMFGKVEAQQLLWSIDLQICSAIYSVDREMHHYLFGKLPKIRQSSEDPFTKQDALYGQANAPSICHSIHLEFLAKMENEEMSKVTQANGIDSREHKGQSIAVEANSKGETREVVEGKVDWRGRPAIRGSHGGVANSFFILVNFGLENLASLSLAVNLIIYFMTVMHIGLTDGSNLLTNYMGTSYMVAVLISVFADTFIGRYKTVIISSVIELVGLLILTLQAHSNKLKPPYCVFPFDPKCETVSGDGRTHLYVGLYLVAIGSAGIKAALPAHCADQFDEKHPTEKLQMSSFFNWLLLSLCTGGAISVTVFVWIQSYKGWDKGFGAATGVMGLALLVFIAGLPGYRISVVQGSTALLEILQVYVAAIRNRNMKLPENPDELYEISKSKAPPDTDFMAHRDKPFRFLDKAAIVQAPTDEAPSPWRQCRVTQVEHAKTVLAMVPIFCSAIIMSTCLAQLQTFSIQQGVTMDRTIGTFKMPPASLPIIPLIVLVFAVPIYERGFVPFARRITGHPNGIPHLQRVGVGLVLSIVSMAIAAVVEVRRKRVAARHGMLDANPILGKQLPISCFWLAPQFTVFGVADMFTFIGLLEFFYSQAPPALKSMSSSFLWCPMSLGYFLSTIIVKAVNAATRGATASGGWLAGNNINRNHLDLFFWLLAVLSFLNFLNYLFWASWYKYKPQQSAHVPAEHKV

SEQ ID NO: 43838 - protein, 434 aa, Hyphomonas neptunium ATCC 15444
MENKVKDAGTAKLEVGGKTVSLPVYSGTHGPNVIDIRKLYAEVDHFTLDPGFTSTGSCESQITFIDGDEGILLHRGYPIEQLAEKSSYLELCYLLLNGELPTKDEYEAFGKDVRQHTLLHTQQDRFFDGFRRDSHPMAMLTGAVGAMAAFYPGAMGNEDPEERRRDSIRLVAKMPTIAARCMKYNLGQKFVDPQNRLSYSENFLNMCFSVSAEDYEVNPVLARAMDRFFMLHADHEQNASTSTVRLVASSGAHPFAAIAAGVASLWGPSHGGANEAALRQLREIGDISNVPDFVKKVKDKSSGVRLMGFGHRVYKNYDPRAKVMQKTAHEVLDALDLRDHPLLKVAMELERIALQDEYFVAKKLYPNVDFYSGIILEAMGFPTKMFTVLFAVARTVGWVAQMNEMLEDPSQKIGRPRQIYTGAAMRDYTAMTSR

SEQ ID NO: 43839 - protein, 694 aa, Clostridium thermocellum ATCC 27405
MIQITTQTIQIVAILISLLSLGVAAWLYSWVKSQPSSNARIAEIGGYIRQGANTFLRREYLILARFTAIAAVLILIFLPHPIWSGNITQNIWMAVSYIFGTVLSALAGKIGIQIATIANIKSAEAAQKGVKPAFMTGFRGGAVMGMAVVGTSLLGVTLVLLIVGDASAVLGFSFGASSLALFAKAGGGIFTKTADISADLVGKVELGLEEDDPRNPAVIADNVGDNVGDVAGMGADLFDSNVASMAAALVMATALGGPDSKNVAMVFAYAAIGLLSSVIGVATARIGKNGDPGKALNSSTYVTTAIFAVLTALSTYIFNFEWRIWGATAIGLIVGTIIGLTSDYFTNDAKPPVRAVANASKSGPAFTILSGFSYGLLSALPSLIGIAVTALISYYICEPLGSGYGMFGISMSALGMLSIVGMIISNDAYGPIVDNARGLAEMGGFGEKVIAIADELDSAGNTVKAVTKGFSISAAGLTVISLLGAFMSEVNTAASELGVQGIANFDIMNPTVFFGLIVGVAIPAVFSAMLMLGVDKNAQRMVAEIHRQWDTIPGLKEGKENAKPDYDKCIDIATTGSLKELIPAGLVAIFSTILVGFIGGASAIGGFLTGNITSGLLLALLMSNAGGLWDNSKKYVEAGNCGGKGSTAHKAAVVGDTVGDPFKDTAGPSINTQITVVSLVSSLLASLFLMYSIF

SEQ ID NO: 43840 - protein, 280 aa, Campylobacter coli RM2228
MLHTKGRCIVSGMGKSGHIGAKIAATLASTGTPSFFIHPGEALHGDLGMLTPDDVLIAISNSGETEEILKIIPAIKKRKIPLIAMCGKKNSTLVKQGDIFLNISVKEEACPLQLAPMSSTTATLVMGDALAAALMKARNFRPDDFALFHPGGSLGRKLLTRVSDLMVSKNLPIVHPDTEFNDLVDVMTSGKLGLCLVVENEKLVGIITDGDLRRALKANDKPRFDFKAKEIMSINPKVVDADAMASEAEEIMLKYKIKEIVVSKEDKVVGIIQLYAIGNV

SEQ ID NO: 43841 - protein, 414 aa, Glycine max
  misc_feature (239)..(239): Xaa can be any naturally occurring amino acid
  unsure (1)..(414): unsure at all Xaa locations
MENSEKVVAVIMVGGPTKGTRFRPLSFNIPKPLFPLAGQPMVHHPISACKKIPNLAQIFLLGFYEEREFALYVSSISNELKLPVRYLKEDKPHGSAGGLYYFRDIIMEDCPSHIFLLNCDVCCSFPLPSMLDAHKRYGGMGTMLVIKVSAESANQFGELVSDPTTNELLHYTEKPETFVSDLINCGVYVFTPDIFTAIHDVYINQQGTPNLRRVSNFETFQSATRTIPVDFVRLDQDIXSPLAGKKQLYTYETTDFWEQIKTPGMSLKCSELYLAQFRYTSLDLLASGDGKKKATIVGDVYIHPSAKVHPSAKLGPNVSISANVRVGAGVRLSSCIILDDVEIKENAFVTNSIIGWKSSLGRWSHVQADGNYDSKLGTTILGEAVTVEDEVVVFNCIVLPNKTLNVRVQEEIIL

SEQ ID NO: 43842 - protein, 618 aa, Yarrowia lipolytica CLIB122
MSELENGVKSLNLNNDTPAAPRSKYVPPHRAKAAATGNGTSNSAPSNDRREAGRNLYSQYSNSFQNNSRGSYGGGYGGGRGGRGGRSWGNDGGYRGGFRDPSQGSFVDGKHVPGPRNERTEVEIFGVANDERFQSTGINFDNYDEIPVEATGNDVPEPINAFTSPPLEEHLLTNIKLARYNKPTPVQKYSVPIVAAGRDLMACAQTGSGKTGGFLFPVLSQSFFHGPSPTPQPTGPRHMHKKAYPTALVLAPTRELVSQIYDEAKKFAYRSWVRPCVVYGGADIGEQMRNIERGCDLLVAAPGRLVDLIDRGKVSLENIKYLVLDEADRMLDMGFEPQIRAIVQGSGMPDVNERQTLMFSATFPRNIQMLARDFLKDYIFLSVGRVGSTSENITQKVEYVEDGDKISALLDILSAAGKGLTLVFVETKRGADYLCDVLQSEDFPATSIHGDRSQRDRERALEMFRDGTTPILVATAVAARGLDIPNVTHVVNYDLPTDIDDYVHRIGRTGRAGNTGIATAFFNRGNKGIVRELIDILKEAHQDVPQFLESTAREASYGGRGGGRGRGGFGGGRSRATQDFRKQGGGFGSNDRFGGSSGGSSYGGGSSYGNQGGNNNWW

SEQ ID NO: 43843 - protein, 339 aa, Colwellia psychrerythraea 34H
MNIEKESTLVSLIADIGGTNIRLAQATAKLGTNTRDIAINDIETYQCKEFSSLADVVAHYIDVKELNNLAINACFAIACPVDNDLISMTNLPWQFSQNELKQSLNLHSLRFINDYTAIAMAIPLLSEQQKIKIGGGESIAGKPISVCGPGTGLGVANLVPLSLSGNEQWHCISGEGGHIDFAPVNEIEQQVMNFIQGIKKRVSYEQLLSGYGLEQIYQALLFINHGKEITTVEDKLTAKDITANALNATCTVCEQTLTLFCDVLGSFAGNLALIMNSQGGVYIAGGIVPRFVDYLKLSDFRARFETKGRLSSITEQAPTYVITEEQPGLLGAAAFVLQS

SEQ ID NO: 43844 - protein, 341 aa, Azoarcus sp. BH72
MTRVVGHPYHPGFSTSTAVLSVQQLFAPIAADMQAVDALIRKALYSDVVLIRQVAEYIINSGGKRLRPALVLFSAGAVGYRGTQHHRLAAVVEFIHTSTLLHDDVVDESELRRGNKTANALFGNAASVLVGDFLYTRAFQMMVEVDSMRVMQILADATNIIAEGEVLQLLNCHNADVEVEDYLRVIRYKTAKLFEAASRLGAVLGGADPALEESMAAFGMHLGTAFQLIDDVLDYSADEADTGKHLGDDLAEGKPTLPLIHVMQHGSAEQAALVRGAIENGGRDDFAAVLAAIQQTGALEVTRRHAREEADRAIAALQGLPPSNFKESLLQLSDFAVERNH

SEQ ID NO: 43845 - protein, 278 aa, Glycine max
FGSRNHGVPEGVIEKIMKVTREFFGLPESEKLKSYSTDPFKASRLSTSFNVNSEKVSSWRDFLRLHCHPIEDYIKEWPSNPPSLSREDVAEYCRKMRGVSLKLVEAISESLGLERDYINRVVGGKKGQEQQHLAMNYYPACPEPELTYGLPGHTDPTVITILLQDEVPGLQVLKDGKWVAVNPIPNTFVVNVGDQIQVISNDKYKSVLHRAVVNCNKDRISIPTFYFPSNDAIIGPAPQLIHHHHHPPQYNNFTYNEYYQNFWNRGLSKETCLDIFKA

SEQ ID NO: 43846 - protein, 322 aa, Medicago truncatula
MGEEAKQEQPKVEEKQEEKKEEKAEGGKEEEKKEESKEEKPEEEKKEEPKPPEPCVLFVDLHCVGCAKKIQRSIMKMRGVEGVVIDMAKNEVTIKGIVEPQAICNTITKKTKRRANVISPLPPAEGEPVPEVVNSQVSGPETVELNVNMHCEACAEQLKRKILQMRGVQTAVTEFSTGKVTVTGTMDANKLVDYVYRRTKKQAKIVPKPEPEPEKKEEESKEGEKPAAEEEAKPEENKKEEEKPTEEPKKEEGGENKEEKGGEESKEETKKEESGATAMVNIDEEGMKRMMYYYQYPPLYVIERTPPPQLFSDENPNACIIS

SEQ ID NO: 43847 - protein, 363 aa, Coccidioides immitis RS
MAKFNIVVFAGDYCGPEVTAEAIKVLKVVEKKTDIEFNFQEHLLGGASIDATGTALTDEALQAAKNADGVILGAVGGPKWGTGAVRPEQGILRLRKEMGTFGNLRPCNFAAPSLVDISPLKADVCRGVDFNIVRELTGGIYFGERKEDNGDGTALDTEPYSRAEIERVTRLAGHLALQHSPPLPVWSLDKANVLATSRLWRKVVTEIMEKEFPQVKFGHHLIDSAAMLMVKDPRKLNGIIVTSNLFGDIISDEASVIPGSLGLLPSASLSGIPDGKSRVNGIYEPIHGSAPDIAGKGIVNPVAAILSMAMMLQYSLNRPVEAKAIEDAVSKVIEAGIRTGDIGGKATTSEVGDAVAAELEKSL

SEQ ID NO: 43848 - protein, 1039 aa, Sorghum bicolor
FRLLAFSENAADLLDLSPHHSVPSLDSAAPPPVSLGADARLLFSPSSAVLLERAFAAREISLLNPLWIHSRVSSKPFYAILHRIDVGVVIDLEPARTEDPALSIAGAVQSQKLAVRAISRLQALPGGDIKLLCDTVVEHVRELTGYDRVMVYRFHEDEHGEVVAESRRDNLEPYLGLHYPATDIPQASRFLFRQNRVRMIADCHATPVRVIQDPGMSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQVQLGELELRGINELSSVAREMVRLIETATVPIFAVDTDGCINGWNAKIAELTGLSVEEAMGKSLVNDLIFKESEEIVEKLLSRALRGEEDKNVEIKLKTFGSEQSNGAIFVIVNACSSRDYTQNIVGVCFVGQDVTGQKVVMDKFINIQGDYKAIVHNPNPLIPPIFASDENTSCSEWNTAMEKLTGWSRGEVVGKFLIGEVFGSFCRLKGPDALTKFMVVIHNAIGGQDYEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETCSACEEQMSKIVKDATLQSIEDGSLVLEKSEFSFGDVMNAVVSQAMLLLRERDLQLIRDIPDEIKDASAYGDQFRIQQVLADFLLSMVRSAPSENGWVEIQVRPNVKQNSDGTDTELFIFRFTYPGEGLPADIVQDMFSNSQWSTQEGVGLSTCRKILKLMGGEVQYIRESERSFFLIVLELPQPRPAADREIS

SEQ ID NO: 43849 - protein, 384 aa, Triticum aestivum
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPTELGDQSIQDKLIEMTDGGCDYTFDCTGNVGVMRAALEACHKGWGESIVIGVAAAGQEISTRPFQLVTGRVWRGCAFGGVKGCSQLNDLVADYKKGDLKVDEFITHRKTLGEINNAFDTMKQGDCIRAVVDMQKLEPKI

SEQ ID NO: 43850 - protein, 271 aa, Polaromonas sp. JS666
MFTVNHASAMPRLTYARAGAQILQAHLKLGTGIFYHSPIAPTGSMPARGGVPVLFPQFANRGPLPKHGLVRTALWALAEESRSEQAHGVAFELAIAPGQFADWPHAAHLVLKAEASQDSLRLSLQVTNTGNDTFTWTGGLHPYFAVDDVQACSVVGLAGLPVQDHYDANLTTEPSSPRNWGDEPFERLYGACPPLTLFTGSRWLKLTASGFEQWMVWNPGRAGGDALPDLPAGDWRRFVCVEPVCVTRPAELVPGAVFSGTLAISVHAKNN

SEQ ID NO: 43851 - protein, 305 aa, Gibberella zeae PH-1
MSNNNWQEEAMRRLRQMQQARGGGGGGPQMPRAAGGALAGGLLLAGGALFLSNSLFNVDGGQRAIKYQRLTGVSKEIYNEGTHINIPWFETPIVYDVRAKPRNVASLTGTKDLQMVNITCRVLSRPQIDALPQIYRTLGTDYDERVLPSIVNEVLKSVVAQFNASQLITQRENVARLVRENLARRAARFNILLDDVSLTHLAFSPEFTAAVEAKQVAQQEAQRAAFVVDKARQEKQAMVVKAQGEARSAELIGEAIKKNKAYLELKKIENARLIAAQLQEAGSKNRLMLDSEGLGLNVFDKNDKS

SEQ ID NO: 43852 - protein, 399 aa, Hyphomonas neptunium ATCC 15444
MADAPGGDKKGWKPATQAVRGGLMRSQHGEISEALYLTSGYAYDSAEQAMRRMAGEEEGFVYSRYGSPTNEMLQQRLALIEGAEACRVTGSGMGAISSAILAPLKAGDRVVAATALFGSCRWIIANQMPKFGIEAVFVDGADLDAWKREIDKGCQLVLIESPANPLLDGVDIEAVARLAKAAGALLVVDNVFATPVLQRPLEMGADVIAYSATKHMDGQGRVLLGAILTDAKRMSDVYDPWLRHMGPAASPFNAWVVLKGLETMQLRVEAQSRTAARLADVLADHPAVNAVRYPHRKDHPHYEVHKRQMKSGGTLLALSLKGGQDAAFRFLNGLQLVDICNNLGDTKSLACHPSTTTHRALSDEDQAAMGLDRSWVRLSVGLEDADDLEADLLASLNSL

SEQ ID NO: 43853 - protein, 385 aa, Zea mays
MTLLSLVEAWWACLSLVHCVGTPPKGTTAWAPPPKPSDDSSRAKQREMGGQMKISAMWEEGGNKAPASTAKVVQYEASDVGVDDALGIWKIDDVDNSFHTQPFRINCGYHLRVVDVNMQVEVGSVSERYSSWNWNYRLQSTKRGFFVQWSTSWPAQAGLLRLRRRRQPPSPVPKLIFLESTLVQTLGPKRRVRVATLDEALQIPQELAAFVTCYGQSLHVLVGYIGWNYGSVIEDILTGFKMHCHGWRSIYCISKEELTEISFTVYHICRLHFVLKFFRDVKHVREQGAIDDRDTFLHAVRDLLCFHSTQRVGGNFMHEQALLYRPFGDYNPLHSDPDIAQLAGYASSECYSIIVFIVIFDIEEVFGVDVGLRSLSVSSFQPLLS

SEQ ID NO: 43854 - protein, 203 aa, Escherichia coli
MLTEQQRRELDWEKTDGLMPVIVQHAVSGEVLMLGYMNPEALDKTLESGKVTFFSRTKQRLWTKGETSGNFLNVVSIAPDCDNDTLLVLANPIGPTCHKGTSSCFGDTAHQWLFLYQLEQLLAERKSADPETSYTAKLYASGTKRIAQKVGEEGVETALAATVHDRFELTNEASDLMYHLLVLLQDQGLDLTPVIENLRKRHQ

SEQ ID NO: 43855 - protein, 395 aa, Nitrosospira multiformis
MSVIRVTDLDLKGKRVFIRADLNVPVKDGKVTSDARISASMGTIDYCLKQGGKVMVTSHLGRPEEGVWSEENSLKPVADNISERLGKPARLIKDWVDGNFDVAEGELVILENCRFNKGEKKNADETAQKYAKLCDVFVMDAFGTAHRAEASTYGIAKYAPVACAGILLTEELDALTKALLNPARPMVAIVGGSKVSTKLTVLESLSEKVDQLVVGGGIANTFLKAAGQNVGKSLCEDDLVPIAKMLMEKMAKRNATIPIAVDVVVGKKFDASEPAVLKNADAVTDDDMIFDIGPKSARELSDIIMKAGTVVWNGPVGVFEFDQFREGTKTIAMAIADTDAFTLAGGGDTIAAIQKYDIYDRVSYISTAGGAFLEFLEGKKLPAVEILEQRAAGSR

SEQ ID NO: 43856 - protein, 419 aa, Desulfitobacterium hafniense DCB-2
MHYVIIGNSAAGVFAAEALRGLDSSGKITMISEENNRPYSRCLTSYYIGEEIDQDRIYIRDANFYAATGIDFIPQKVEQVNDTEKSITLQSGEIVGYDKLLIATGASPYSLPVEGLDLEGVCELRTLEDARRIMDFAPHVKEAVVMGAGLVGLKGAHALHELGIKVSIIVNSRIMSRSVDPHTGQIITELLEQDGYEVIYNTKLSKILGQDKVEGVCLSSGKEIPCQLVLMAAGVSPNVDLVKNTGIEVNKGIIVDKHMQTTVSHIYAAGDVAEAYHAVWDEKRVISIWPVATAQGTVAGSNMAGVERIYEGSVGSNSAVFCGVGVVSAGIPYLPTGEGQELSTYDKATKRYRKFIVKDDILVGMIMVGDIDGAGILTAMIKQKTKVSLDTLNYWLNHPVRFQGYCTAEAKGGIVCGIC

SEQ ID NO: 43857 - protein, 273 aa, Pasteurella multocida subsp. multocida str. Pm70
MYHAIQPIILQQICPELRLVKYNAIPAISLQHDIGSAVIALQGAQLLSWQPKGSAHDVLWLSEIEPFQLRKAIRGGIPLCYPWFGPVKTPSHGTARIRLWHLIDYVISTDKVRLVFGLFTEDHLIEAKVSMDFAQDCQVRLTHYGQEDAQVALHSYFHVGDIEQIEIQGLPTHCVSNLTKQHENVPSPRQIQQNVDCTYHITNAKTSIVDPVLQREISLEHQQASEVVLWNPWHKETSGMSEFGYQTMVCVETARITQQLKQGEEIAVRITLK

SEQ ID NO: 43858 - protein, 379 aa, Pseudomonas aeruginosa PAO1
MTTTTAGKVNLLGLTQPQLEQFFESIGEKRFRAGQVMKWIHHFGVDDFDAMTNVGKALREKLKASAEIRGPEIVSQDISADGTRKWVVRVASGSCVETVYIPQGGRGTLCVSSQAGCALDCSFCSTGKQGFNSDLTAAEVIGQVWIANKSFGTVPAKIDRAITNVVMMGMGEPLLNFDNVVAAMNIMMDDLGYGISKRKVTLSTSGVVPMIDKLGEVIDVSLALSLHAPNDELRNKLVPINKKYPLGMLLDACRRYISRLGEKRVLTVEYTLLKDVNDQPEHAEQMIALLKDTPCKINLIPFNPFPHSGYERPSNNAIRRFQDMLHKGGFNVTVRTTRGDDIDAACGQLVGQVMDRTRRSERYIAVRQLAESESAANRN

SEQ ID NO: 43859 - protein, 143 aa, Pseudomonas aeruginosa PAO1
MALQRTLSIIKPDAVSKNVIGEILTRFEKAGLRVVAAKMVQLSEREAGGFYAEHKERPFFKDLVSFMTSGPVVVQVLEGEDAIAKNRELMGATDPKKADAGTIRADFAVSIDENAVHGSDSEASAAREIAYFFAATEVCERIR

SEQ ID NO: 43860 - protein, 358 aa, Medicago truncatula
MSNFKSKYHDELIANAAYIGTPGKGILAADESTGTIGKRLSSISVENVESNRRALRELLFTAPGVLQYLSGVILFEETLYQSTAAGKPFVDVLNEAGVLPGIKVDKGTVELAGTDGETTTQGLDGLGARCAKYYEAGARFAKWRAVLKIGPNEPSEHSIHENAYGLARYAVICQENGLVPIVEPEILVDGPHDIQKCAAVTEKVLAACYKALNDHHVLLEGTLLKPNMVTPGSDAPKVAPEVVAEHTVRALQRTVPAAVPAVVFLSGGQSEEEASVNLNAINQVNGKKPWTLSFSFGRALQQSTLKAWSGKEENVKAAQEALLTRAKANSEATLGTYKGNSKLGAGASESLHVKDYKY

SEQ ID NO: 43861 - protein, 252 aa, Medicago truncatula
MQNNNTNNGGGGMDELLAVLGYKVRSSSDMADVAEKLEQEGINHLSSDTVDELIANAAYIGTPGKGILAADESTGTIGKRLASIGVENVESNRRALRELLFTAPGVLQYLSGVILSEETLYQSTTAGKPFVDVLNEAGVLPGIKVDKGTVELAGTDGETTTQGLDGLGARCAKYYEAGARFAKWRAVLKIGPNEPSEHSIHENAYGLARYAVICQENGLVPIVEPEILVDGPHDIQKCAAVTEKVLAACYKA

SEQ ID NO: 43862 - protein, 342 aa, Chlamydophila pneumoniae CWL029
MDSSAPYNIASQGTEKSTVERILDLYGPASCIKFLKQMVLIREFEARGEEAYLEGLVGGFYHSYAGQEAVATAAIANTGLDPWVFSSYRCHALAILLNIPLQEIAAELLGKETGCALGRGGSMHMCGPNFPGGFGIVGGQIPLAAGAAFTIKYQEQKNRVSLCFIGDGAVAQGVFHETLNFVSLHQLPLMLIIENNGWSMGTSLNRAVAKQPIAESQGSSYDIRAVTVNGFDLFNSLLGFREAYRYMVDTESPVLVECLCSRFRGHSISDPNLYRSKEEMQCLFKKDPIVLAKDWLIRLEVLTEEEFQNIRQECKTAVLEAFSNAKLSSDPSVTTLEEGVYA

SEQ ID NO: 43863 - protein, 131 aa, Medicago truncatula
MVTPGSDAPKVAPEVVAEHTVRALQRTVPAAVPAVVFLSGEQSEEEASVNLNAINQVNGKKPWTLSFSFGMALQQSTLKAWSGKEENVKAAQEALLTRAKANSEATLGTYKGNSKLGAGASESLHVKDYKY

SEQ ID NO: 43864 - protein, 150 aa, Brassica napus
MSLNTILTWSLVFFLFLTVSDQKPTAYDAVKSYNLPPGILPKGVVDYELNRKTGDFKVYFNGTCDFSIQSYQLKYKSTISGVISAGQVKNLKGVSVKVLFFWVNIVEVSLDGGDLDFSVGIASASFPAVDFEESPQCGCGFDCNGLLFSS

SEQ ID NO: 43865 - protein, 328 aa, Chlamydophila pneumoniae CWL029
MPKHKTLEIREALREAIDEEMSRDPNVCILGEEVGDYNGAYKVTKGLLDKWGPKRVIDAPISEAAFSGIGIGAALSGLRPIIEFMSWNFSFVALDQIISHAAKMHFMTGGKFSVPIVFRGPNGAAAQVSCQHSHCVESLYANIPGLIIIAPSNPYDAKGLLKSAIRNNNPVLFLENELEYNLKGEVPTEEYLVPIGKAHRVQEGNDLTIITYSRMVSITKEACSLAKKRWGLSIEIIDLRTIKPLDISTILSSVRKTSRCIVIEEGHYFAGISSEIIALITEHVFDSLDAPPLRVCQKETPMPYSKILEQATLPNVNRILDTIEKVMR

SEQ ID NO: 43866 - protein, 210 aa, Arabidopsis thaliana
MAANDSSNAIDIDGNLDSDSNLNTDGDEATDNDSSKALVTIPAPAVCLFRFAGDAAGGAVMGSIFGYGSGLFKKKGFKGSFADAGQSAKTFAVLSGVHSLVVCLLKQIRGKDDAINVGVAGCCTGLALSFPGAPQALLQSCLTFGAFSFILEGLNKRQTALAHSVSLRHQTGLFQDHHRALPLSLALPIPEEIKGAFSSFCKSLAKPRKF

SEQ ID NO: 43867 - protein, 420 aa, Triticum aestivum
MAVEYRCCGGPFFEHIAIIVVLVLFAGLMSGLTLGLMSLSLVDLEVLAKSGTDKDRKYAAKILPVVKNQHLLLCTLLICNAAAMEALPIFLDSLVTAWGAVLISVTLILLFGEIIPQSICSRYGLAIGASVAPLVRVLVWICFPVAYPIAKLLDHVLGHGKAALFRRAELKTLVTLHGNEAGKGGELTHDETTIIAGALELSEKKAKDAMTPLCDTFVIDINAKLDRKLMQEVIEKGHSRVPVYYEKDTNIIGLILVKNLLSINPDDEIPIKSVTIRKIPRVSEDMPLYDILNEFQKGHSHMAVVIRQNIPNYPAKQPSIDGGSLEVAIAIDDKQGEKVAKSLTPLWRWKSYPNTQNSNTGSRRGKWSKDQSDVLQVHEEPLPTLSEDEEAVGIITMEDVIEELLQEEIYDETDVHVEEQ

SEQ ID NO: 43868 - protein, 429 aa, Chlamydophila pneumoniae CWL029
MISLLKMPKLSPTMEVGTIVKWHKKSNDQVSFGDVIVEISTDKAILEHTANEDGWIREILRHEGEKIVIGTPIAVLSTEANEPFNLEELLPKTEPSNLEASPKGSSEEVSPATTPQAASATFTAVTFKPEPPLSSPLVFKHVGTTNNLSPLARQLAKEKNIDVSSIQGSGPGGRIVKKDLEKAPPKSIAGFGYPESPEVPPGSYHEENLSPIREVIAARLQAAKISIPHFYVRQQVYASPLLNLLKELQAQGIKLSINDCIVRACALALKEFPSINSGFNSVDNKIVRFDTIDISIAVAIPDGIITPIIRCADRKNLGMISAEIKSLALKARNQSLQDTEYKGGSFCVSNLGMTGITEFTAIVNPPQAAILAVGSVTEQALVLDGEITIGSTCNLTLSVDHRVIDGYPAAMFMKRLQKILEAPAVLLLN

SEQ ID NO: 43869 - protein, 304 aa, Burkholderia sp. 383
MNYQTILERIHTELAPWIGQGRVADYIPELAKVPADKFGMAVVTLDGNVCTVGDAYERFSIQSISKLFACTLAFQLLGDELWERVGREPSGNAFNSLVQLESERGKPRNPFINAGALVVTDVLCRRFVKAETALVEFVRRLIGANDIDYDSRVAQSELQHAERNRAMAHFMASFGNMQMPPDTVIDAYCRQCAITMNCVELARAALFLANGGVAPVTGERIVDSSSAKRLSALMLTCGTYDAAGDFVYRVGLPAKSGVGGGIVAVLPGEMAVCVWAPGLDANGNSLAGTLALEWLTTYSGRSIF

SEQ ID NO: 43870 - protein, 671 aa, Polaromonas sp. JS666
MHYFVTGATGFIGKRLVKKLLERKGSTVHFLIRQESAGKLAALRAYWGVSAGRAVAVHGDLTRKKLGVSSEDIKKLKGQVSHFYHLAAVYDLGADEESQIAVNIDGTRNTVEFAKAIDAGHFHHVSSIAAAGLYEGVFREDMFEEAENYEHPYFMTKHESEKIVRAECKVPWTVFRPAMVVGDSTTGEMDKIDGPYYFFKLIQRMRQLLPPWMPAVGLEGGRINIVPVDFVVDALDHISHLPKDRGDIAKKCFHLVDPVGYRVGDVLDIFSRAAHAPKMNLFVNAALLGFIPRGVKKSLMALAPVRRVRAAVMADLGLPEDMLTFVNYPTRFDCRGAATALKGSGIECPNLKDYAWRLWDYWERHLDPDLHIDRTLKGTVGGKVVLITGGSSGIGLAAAHKFAEAGAITVICGRDQDKLDEACKEAKAKGYNFVAYPADIADMADCDRFLKELIANHGGVDFLINNAGRSIRRAIEASYDRFHDFERTMQLNYFGCLRVTMGLLPGMAARRKGHVVNISSIGVLTNAPRFSAYVASKAALDAWTRCASSEYADLGIGFTTISMPLVRTPMIAPTNLYNNVPTLSPEEAADMIAQACIFKPVRIATRLGIAGQVLHALVPRIAQIAMNTSFRMFPDSSAAKGEKGGKGEKSARPQLSAEAVAMQQMMQGIHF

SEQ ID NO: 43871 - protein, 78 aa, Brassica napus
KIVVLDMYTQWCGPCKVIAPKYKALSEKYEDVVFLKLDCKPENRVCLLPPLKKLFLQPSVLLLLLITLELCFLIVWWQ

SEQ ID NO: 43872 - protein, 164 aa, Glycine max
TKVLLMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGREGFMCLLCLLECSGGHLRLLLLLTL

SEQ ID NO: 43873 - protein, 411 aa, Pseudomonas syringae pv. phaseolicola 1448A
MRALTYHGANSVKVDTVPDPEIQEADDIILKVTATAICGSDLHLYRGKIPTVEHGDIFGHEFMGIVEETGPAVTAVQKGDRVVIPFVIACGSCFFCNIDLFAACETTNTGRGAIINKKSIPPGAALFGFSHLYGGIPGGQAEYVRVPKANVGPFKVPGTLADEKVLFLSDILPTAWQAVTNAGIGQGSSVAIYGAGPVGLMSAACARMLGAEKIFMVDHHPYRLAYAQKTYGVIPINFDDDDDPADTIIRQTAGMRGVDGVVDAVGFEAKGSTTETILATLKLEGSSGKALRQCIAAVRRGGVVSVPGVYAGFIHGFMFGDAFDKGLTFKMGQTHVHRFMLELLEHIEAGRLEPEAIITHRMSLEDAAKGYKLFDKKEEDCRKVILTPGNNTIVVPDATTEELVAGGVPAM

SEQ ID NO: 43874 - protein, 613 aa, Glycine max
MASISGICSSSPTLNHSTPKRRRTPLLPSSSFPSKPSPPRSLARETPAPQQQQQQLSAVTKPLHAGLEKKPRALWRRYVEWLYQHKELGLYLDVSRVGFSDDFVREMEPRFHAALRAMEDLEKGAIANPDEGRMVGHYWLRDSARAPTSFLKSQIDNTLVAICTFADDVVTGKIKPPSSPEGRFTQILSVGIGGSALGPQFVAEALAPDNPPLKIRFIDNTDPAGIDHQIAQLGPELASTLVIVISKSGGTPETRNGLLEVQKAFREAGLSFPKQGVAITQENSLLDNTARIEGWLARFPMFDWVGGRTSEMSAVGLLPAALQSIDIREMLAGAALMDEANRSTVIRNNPAALLALCWYWATDGVGSKDMVILPYKDSLLLFSRYLQQLVMESLGKEFDLNGNRVNQGISVYGNKGSTDQHAYIQQLREGVHNFFVTFIEVLRDRPPGHDWELEPGVTCGDYLFGMLQGTRSALYANNRESITVTVQEVTPRSVGALVALYERAVGIYASLVNINAYHQPGVEAGKKAAGEVLALQKRVLAVLNEASCKEPVEPLTLEEVADRCHAPEDIEMIYKIIAHMAANDRALIAEGNCGSPRSIKVFLGECNLDELYA

SEQ ID NO: 43875 - protein, 793 aa, Escherichia coli
MVAIVIVSHSLRLAQGVEELALQMSGGDVPLAIAAGIDDPQNPIGTDAIAIMSAIESVWSPDGVLVLMDMGSALLSTEMALELLSEEQRSAIYLLAAPVVEGAMSAVTSAAAGLSVTEIIAEVDLALCAKQQQLTPSSTAGEVIPVISPVNHCDEWQTFCWTIRNPHGIHARPAASILKVSAQYSANIIVIKGDKRASTRSLNELAMLGVRCGDEIIFQAEGTDASDALKAIETLAKNHFGEAHLLASSEIPLTETPVVSAPVDGAISGLSVQNGIAIGPVKWFTCERPEITQRTVDSPQEELSRIESAIDIVVCELADKAAGPEGDIFAAHKMMLEDPEINRQLQQRLAKGKQAEFAWLEVMQALAEQYCQAETLYLREREADIRDLTRQVLNQLCGVSEQHFITTAPCILLANDLLPSQITSLNKAHILGICLHNGGTTSHTAILARAMGIPAIVKAAITPQNVRDNDTVILDGETGRLWLQPDEVTRLDLLQRAEAWRQQRDRQLADAMLPAVTQGGRKISVLANIGDLQDIEAALSHGAEGVGLLRTEFLFHESATLPDEEEQFRVYCSVAQAFGDKPVTIRTLDIGGDKPLPSYPLPAEDNPFLGLRGIRLCLAHPQIFIPQLRALLRAGKEYPTLQIMLPMVSTLEEVNAVKTLIQTQAKLLGLTAENLPALGIMIEVPAAVMIAEKLASEVDFFSIGTNDLTQYIMAADRGNSTVAKLVDYRNDAVINAIAMVCQAGRNNEIPVSMCGEMAGDTQQTARLLTMGIDKLSASPSRLPALKAAIRASH

SEQ ID NO: 43876 - protein, 149 aa, Magnaporthe grisea
MADSLTEEQVSEFKKAFSLFDKDGDGQITTKELGTVMRSLGQNPSESELQDMINEVDADNNGTIDFPEFLTMMARKMKDTDSEEEIREAFKVFDRDNNGFISAAELRHVMTSIGEKLTDDEVDEMIREADQDGDGRIDYNEFVQLMMQK

SEQ ID NO: 43877 - protein, 967 aa, Yarrowia lipolytica CLIB122
MSRQKKSREIRFGDYILGSTLGEGEFGKVKIGWRKDGKQPEQVAIKLIKRETVPPNSNREAKVHREINALKILTHPNIVRLEEVIQNDRYIGIVLEYASGGELFDHILTHKYLKEASACRLFAQLVSGVHYLHSKGIVHRDLKLENLLLDKHKNIIITDFGFANTFSRGSDGHVFDLMATSCGSPCYAAPELVVSDQKYTGRKVDVWSCGVILYAMLSGYLPYDDDPANPDSDNITQLYKYITTTALTFPEYVPPLPRDLLRRILVPDPRKRISLNDVRYHSWLAPHSRFLAITPKEWEDAVGKVAVPVKTHMPRSHSVQLSSGAPVFDSRLTKPSGVNIPNFSYNNRHSVGGTYSKPIQRQGESTIGATVSSNTPAGPRPISAGPCAATAAAASASKSHAAANPPTHASTPSVASLNIPEDTNNNSTSNSRQAPRSATYTGISQLTSPPGASPTSPKFDFDLPKPSIGTITEQPTPPSSPKVKEKGKEADDLGPRDLPAVPDTAPEATPPASAADTIPSAPATAPSAPVLEHQSFGASFGTSFSSSFAASDPSSPLVSSTRLPPGRKPRPTSYQPTPTQSSMQPPDSFPYMHMVNKNASVPGSANSVTPTSSQQSAQPVPLSLVTPSTAGSTFFRRPSSDDSQISFDERRKSGSFLVPQSSLPKVKYSDSMVQGELSSPQFRNSPSQVALSNWSNRNSVASMESGDEGVIGEVESVAEKKETDKEVVDTVAQSDTTLMPPPALPTSAQVPGKSTTPRAVSAESKTTSTSRTSMEKPLPVVPAASAAPAAVIPTAPSGAINPGAPNFSRPRPVSMQAPKAQTRSHRRGVASISYGADKLFGKIIGDNLDNDKDPRESKESVKDAKGGSSSAASGAGAPTAESTSKKRFSFFSNYSKESVESHEAHSTPSTSSRKILEPPALDRSHSMNQRQNRQVSASQVSTAESTHSSTARKVMDFFRRRSRVSAS

SEQ ID NO: 43878 - protein, 774 aa, Kluyveromyces lactis NRRL Y-1140
MDGVMLDKVELNQHEVGAARERSRSMASLSKFIPKSIWKPQQQQQQQQPSETSEGNTKASNSHPVMLHASLHEAPAIVLQEAKPVSRESIEQEGAPAEKAASGNSSKLSMRLKKVFGKKEPSQPPVDSELSPPASSEAAANHDANDTTNTLNRNRTNSDTDPEPKRNLYSDGSQIQGTPLTSPSKSISSYNSGTHKPNNLVTGNQASKLSPNFDIPEASSNGNGFVPSYNSMTNISTASLNLIDENEETQNFEGSLHQSGEIIHPAITTPLKSGSESPFLSSQSMKPFPASDEAENSHRRSESNGVSVKPQLRRTASQPTDVHVQVNGKTASTKEEFSPRRGTVGADASFIQPPKRSERLRNKSFSNKFQDILVGPQSFEKIRLLGQGDVGRVYLVREKQTNRLYALKIFSKPEMIKRKKIKRILTEQEILATSNHPFIVTLYHSFQTEDYLYLCMEYCMGGEFFRALQTRKTKCISEDDARFYSSEVTAALEYLHLMGFIYRDLKPENILLHQSGHIMLSDFDLSVQAKDTKNPQVKGNASHSLVDTKICSDGFRTNSFVGTEEYIAPEVIRGNGHTAAVDWWTLGILIYEMLFGFTPFKGDNTNQTFSNILKNEVVIPNNNETSRACKDLIRKLLIKNENKRLGSKLGASDIKKHPFFKNDQWSLLRNQEPPLIPVLAKNGCDFAKLSSNPKGSKDKKDSAEQQEKLMFEEKVELDDQVSDNDPFHDFNSMSLMKQDNDSLIYGDSTSYGKISYTPNQNRSRSNSHRSFFKR

SEQ ID NO: 43879 - protein, 203 aa, Escherichia coli
MLTEQQRRELDWEKTDGLMPVIVQHAVSGEVLMLGYMNPEALDKTLESGKVTFFSRTKQRLWTKGETPGNFLNVVSIAPDCDNDTLLVLANPIGPTCHKGTSSCFGDTAHQWLFLYQLEQLLAERKSADPETSYTAKLYASGTKRIAQKVGEEGVETALAATVHDRFELTNEASDLMYHLLVLLQDQGLDLTPVIENLRKRHQ

SEQ ID NO: 43880 - protein, 1647 aa, Ustilago maydis 521
MSQPGARRAYHHGSQRGGSTINQKAALASAYQELGKELSSSKLKIVGNYTLQRPIGEGTFGKVRLGLHRLTNTRVAIKQIPKAHSASLTREIHHHRRLHHPNVMQLYEVIATEQYIWMVSELCAGGELYDYLVENQVLAEPEARRIFGQLCLAVAYVHSKGIVHRDLKLENILLDERCNVKLGDFGFTREFERNRLMDTFCGTTGYASPEMLAGKKYTGEQVDIWSLGVILYALLCGALPFDDDDEAVMKQKILQGDFEIPDCLSEEAHDLVVSILQHDPAKRPSIQSILAHPWFTKMMVNSPMSTLEEDQIATDYFASKPSASTSQSKQHDRFPPTLHKALAELDTATELDTADATSAAPPTNPADAFDFEDHDSSNSCHRHHLSASSEQSYHSARSDSESSGRRSTNTDLTDPTTADSLSGTDEVEGLDQAIVQLNASSRPSALANATAAASHPDKNAIGLHRNERLGSNGSDASLSGVPRPSTKTNTASLPTHHELPPVPDGTGQDDHLSIYQSVPLTKRGSQSSSRGHHRTPSRTKRRSLSSGGLSDHHPPMLGRKPVDYVSQLADLQPATFSTSIEQNLLHQLSALGLDVGQMVHSVVTDACDASGATWWMLLRKSKDRHSEQPDITSPIVQVIPAPGDHPAPINASAFSKAGQTVTPSSPAQFSPPPVPVKDPARRSEDKFRTQERPTTLEASSSENAGLAEQSIRRLQTVVSHEELDVSAAPALHTSTSELMMATKPATDRQSSVPASGPMPLAGLPASTVSLPNDRSLTSTPDSVSSRPKSQHRHTTAVASPAKLQHVALTTLEGSPTSEGSKARGNSQNDRPRSNSLSVRQFAQSVLGTKDRGSATSSPVRPPPEQVVVAGEALPLERAKSPTLFGRRNTVSNVKDSMVGRLSGPSTPKKTPVDMLDKPRKSTGKKSCETDLDRVKALERSADSASSSPSRSTTGQAVGVVSNAKVDSSVPSASQDSFSTMSVTPQGSEKSGHRGKAGSFFMSTVRTWLGGNEKPTRKSKTGKQASASHRGLGIDDGPMAAKSPTNSLSTSGSVSTLTYGTPSRSASVRRRSAHYQQTSATRRGGPRSPHLGTSSRRSSNGSSYQAHLELPPNSFQQSMNRPANMRRMSAGSITPTATLHGDYLNDVGGVSGASRHSRPSSSHSLAHSGAASRPGLHGKAGSTGSTSSAYRPGQASSVYSTGSGRRHPRPSQDGGTTVRRHRTYASSSGSPSRRNSFRHDSRPSSIKSRASSPGRAMSGLGELWAADAEADGDGGGTGARRSTRSTPRHSLEMRKTGEAFDSAAPHHQHHQHVVAQSIFVAHKSRSPYRPPSANPNLHGSLVRGSSQLSGRSNVSANSEDAGYVAPNSTLGLPATGTGAWRHSWGRPPPCWAGPVDPPPTSSYSKRSGAAGVEDDGRPKLRDVFANRDDDDWTDEEEEQTYSGGLGQMGTLSSAMSSSVGRVGSGIGASSSPYATRNLAALGSSGYSTQRAVNLDTANAPEIGLREAPFSSRYAGVRNMFQTATAGTPAFGSRSHHSVSLSLGNEFAPRLLSTTIHSPTVSAASLGGGLGCIGESADAHSVTVSSKPKPESSGTQTQAQQQQSSASASASASASQQQQSGGGSSGSGSRITASFHKPVQIIEEEEEDE

SEQ ID NO: 43881 - protein, 130 aa, Coccidioides immitis RS
MVKTSVLNDALNAINNAEKAGKRQVMIRPSSKVIVKFLSVMQKHGYIGEFEEVDDHRSGKIVIQLNGRLNKTGVISPRYNIQLRELEKWVVKLLPSRQFGYIVLTTSAGIMDHEEARRKHVAGKIIGFFY

SEQ ID NO: 43882 - protein, 127 aa, Triticum aestivum
IFVMTQFNSASLNRHIHRTYLGGGINFTDGSVEVLAATQMPGETAGWFRGTADAVRKFIWVLEDYYKNKSIEHILILSGDQLYRMDYMELVQKHVDDNADITLSCAPVGESRASEYGLVKFDSSGRV

SEQ ID NO: 43883 - protein, 127 aa, Triticum aestivum
IFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRV

SEQ ID NO: 43884 - protein, 127 aa, Triticum aestivum
IFVMTQFNSASLNRHTHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRV

SEQ ID NO: 43885 - protein, 764 aa, Wolinella succinogenes DSM 1740
MSHYTLPPSVAEDFASFKESHADFMAGKLDALTFKTIRVPFGIYEQRESDTYMVRVKLAGGILTPAQLHSLALLAEHYAKPHLHVTTRGGVQLHYAKLQDLPQIIQALHEMGLTGRGGGGNTVRNITADPYAGIAPDEAFDVTPCALSLTTKMLETKDSYSLPRKFKIAFSGSSEDRGGATYIDVGFIAKIHEGVRGFRLFVAGGMGAKSRLGSAFIDFLPQEEIFLFSQAIKQVFDQHGNRKNKHAARLRFLIEELGEGQFRELVFKEVQALRDQGGWEIKLEEAFEAIPLESDEIPPLNQEQKLWWNRFVIPQKQKGYYSAKVPLKLGDLESEHAKSLAQALQGFKYGKESIRFGSDQNLYLRNLQADELLSLYPLIQELSGQSSRARILGDMVACTGAATCQLGITRPRGAVVAIEKELQKANIDLDALQGFRIHLSGCPNSCGKHAIADLGFFGKVNREGGHPYPAYNVLVGAIIQEDSTRFAKKIAEVSAYALPLFVTEVLKLWLHAKPHYANFAAWVDQEGEAQIIHLASSYAKIPSFEEDKNPYFDYGSEEIFSLKGRGVGECSAGMYDLIEADKKALKEALEGGDEEENLAKIRLLASRMLLITKGEEARDERSVLQAFRRLFVEGGLIDSSFAPLLEGRPRIELKALGEAVIALYGTMDNSLKFAKEQPKEAPLAPTSSSSSAHRFKDYQGVACPMNFVKTKMDLAQMQSGEILEILLDEGAPIENVPKSVANEGHLILGQTKEGKGWRVRIQKR

SEQ ID NO: 43886 - protein, 1467 aa, Ustilago maydis 521
MSDPTSFSGISTPAGPAAMYTPDNRSSANGDHSVSIDDNSGAKDSHVDVDRAKAEFHQLQTSLSRQSETTRQNSQEAQDIEAGQKGGDNDDDDDFDLVQYLRSVQSENAQAGIKSKHIGVSWSDLEVIGNDSMSLNIRTFPDAITGLFLGPLFSIMSRLNKNRGRKLLQNFNGVAKPGEMVLVVGRPGSGCSTFLKTIANQRGGYIGVNGDVKYGGIPSQEFARKYQGEAVYNEEDDVHFPTLTVKQTLEFALSLKSPGKRLPHQTVKSLNEEVLNTFLKMLGIPHTANTLVGSAVVRGVSGGERKRVSIAECMASRAAVVSWDNSTRGLDASTALDYAKCMRVFTDILGLTTFITLYQPGEGIWEQFDKVMVIDEGRCVYYGPRIKARQYFLDLGFKDYPRQTSADFCSGCTDPNLDRFAEGQDENTVPSTSERLEEVYHNSSIYQDMLRQKQEYDAQIAADRSAEEEFRQAVLEDKHKGVRPKSIYTVSFARQVQALTVRQMQMILGNQFDIFVSFATTITIALIVGGIFLNLPETAAGGFTRGGVLFIGLLFNALTAFSELPTQMGGRPVLFKQMNYAFYRPAALSLAQLFSDIPLSLGRVILFSIILYFMAGLERSAGAFFTFFLFVYFGYLAMSALFRLFGTVCKSYDVAARLAAVIISALVVFAGYVIPRDAMYRWLFWISYLNPLYFAFSGLMMNEFKNLSLACVGTYIVPRNPPGSTQYPDNVGQNQVCTLPGARAGQQFVAGNDYLRASFGYDSGDLWLYFGVTVIFFVGLVGITMVAIEIFQHGKHSSALTIVKKPNKEEQKLNQRLKERASMKEKDSSKQLDVESKPFTWEKLCYEVPVKGGKRQLLDNVYGYCRPGTLTALMGASGAGKTTLLDVLADRKSIGVISGERLIDGKKIGIEFQRGCGYAEQQDIHEGTATVREALRFSAYLRQPPSVPKEDKDAYVEDIIELLEMQDIADAMIGIPEFGLGIGDRKRVTIGVELAARPDLLLFLDEPTSGLDGQTAYNVVRFLKKLAASGQAILCTIHQPNALLFEQFDRLLLLERGGKTVYFGDVGPNAKHIVKYFADRGAECPGNVNMAEYMLDAIGAGSMKRVGDKPWSELYKESDLFQHNLAEIEKIKQESSSSTSQGSEQSHKTEYATPFVYQVKTVLHRALLSTWRQPDYQFTRLFQHAAIALISGLCFLNLDNSVASLQYRIFGIFMATVLPAIILAQIEPFFIMSRSVFIREDSSKMYSGVVFAIVQLIQEVPFGIVSTVVYFLLFYYPAGFQTGSDRAGYFFAMLLVTEMFAVTLGQAIAAISPSIYIASLFNPFMIVIMSLLCGVTIPYPNMPSFFRSWLYWVNPLTYLVSGLVTNEMHNLTVECTATELARFNPPSGQTCRAWAGAFVDAFGGYLQNPDATSDCQYCQYRNGDQFYAGLNIDFSERGRNIGLVIVYVAFNAIVTILASRFIKYANR

SEQ ID NO: 43887 - protein, 127 aa, Triticum aestivum
IFVMTQFNSASLNRHIHRTYLGGGINFTDGSVEVLAATQMPGEAAGWFRGTADAVRKFIWVLEDYYKNKSIEHILILSGDQLYRMDYMELVQRHVDDNADITLSCAPVGESRASEYGLVKFDSSGRV

SEQ ID NO: 43888 - protein, 795 aa, Mycobacterium smegmatis str. MC2 155
MARTDRISDPWGSRTPYAAGEPWPQRVDRYLTPGLTDDDVDRWVQSAAVLHSNGDGLDIAVKDGRIVGVRGRADDRVNHGRLDPKDLFGWQANHARDRLRTPLIRQDGVLVESDWDTAMDRIVARSRQLLDERGPNSIGFYTSGQLFLEEYYTQCVIAHGAIGTNHVDGNTRLCTATAAEALKESFGCDGQPGSYTDVDHADVIALYGHNVAETQTVLWMRMLDRLAGPNPPAIVCIDPRPTPVARHATVHLAPLPGTNVALMNGLLHEILDHDWMDHDYIEAHTVGFHELRKRVAEFPPERVADICGVDPDDVRRAGELIGTAERLLSTVLQGFYQSHQATAAAVQVNNIHLVRGMLGRPGCGLLQMNGQPTAENTRECGADGDLAGFRNWANDSHIEELATLWNLDVTAIPHYAPPTHAMQMFRYAEEGSLRMLWVSATNPAVSLPELGRIRRILSQDRLFLVVQDLFLTETAQLADVVLPAAAWAEKTGTFTNADRTVHISDKAVDPPGQARSDFDIFLDYARRMDFRDRDGRPLPAWNTPDEAFEAWKRCSAGRPCDYTGLSYEKLRGSGGIQWPCNAEHPDGVERLYAGGEFFAAPDYCEAYGKDLITGAPLEPTEYRAMNPFGKAIIKAAEYVPPHERPSAEYPCVLITGRTVYHFHTRTKTGRTPQLQAAAPEVWVELARADALRAGIVEGDLVEIRTVRGCVTAAARLTDLRRGVVFLPFHYGYWDTGDDGGKDGHHRAANELTLTDWDPVSKQPIFKTAAASVRRIGAGMAATPEPVAHAVADEHL

SEQ ID NO: 43889 - protein, 990 aa, Crocosphaera watsonii WH 8501
MVVQLDSTTYEQRTQEIAKELIAQTREKRSLWSKLGDQMRLDDKLLDFAMANPGLRVQLFHFIDTLPALQSNAEIAHHLQQYLGDESVELPSSLKGILNFTDYNSLPAKVAAETISKAVQTLAFKYISGETVPQVIKTVERLRKEKMGFTIDLLGEAVITESEAKAYLDSYLDLMEKLATESKKWSNVAQIDTAGDENLSKVQVSVKLTAFYSQFDPIDPQGSKEKVCTLIRILLRRAQELGVAIHFDMEQYVYKDLTLSILRELLLEEEFRNRSDIGVTLQAYLRDSKQDLHDLISWAKQRGTPITIRLVKGAYWDQETIKSEQNHWPQPVYNQKSATDVNYEEMTQLLLENHQYLYAAIGSHNVRSQARAIAIAETLKVPSRAFEMQVLYGMGDQLAKALVKTGHRVRVYAPYGNLLPGMAYLIRRLLENTANSSFLRQNLEERPIEDLIASPTLSGNTERIAQKESFVNVPDTDYSREVLRDKAEKALAKVKDSLGKTYLPLINGEYVQTDVIVESVNPSKSSEVVGQIGLISVSQAEQALNAAREAFKDWKKTPATERARIIRKAGDLMEERRHELSAWICVEVGKVLQQADAEVSEAIDFCRYYADEMERLDKGYNYDVAGETNRYHYQPRGIALVISPWNFPFAISTGMTVAALVTGNCTLLKPAETSTVIAAKIAEILVDAGIPKGVFQLVPGKGSKVGAYMVNHPDVHLIAFTGSREVGCRIYADAAILQPGQKHLKRVIAEMGGKNAIIVDESSDLDQAVAGAVFSAFGYSGQKCSAASRIIVLDPVYDAFLERFVEATKSLNVGATDQPSTQVGPVIDATAQKRILEYIEIAKQESTLALQMEAPDNGFYVGPTIFGDVLPNHTIAQEEIFGPVVAVMRVKSFAEALGVANGTDYALTGGLYSRSPEHIEQAQKEFEVGNLYINRTITGAIVSRQPFGGFKLSGVGSKAGGPDYLLQFLEPRHISENIQRQGFAPIEGNE

SEQ ID NO: 43890 - protein, 482 aa, Photobacterium profundum SS9
MNLNDPSLFKQKCYIAGQWVTAENGKVEPVTNPSTGEIIGYVPVMGQEETLHAIEVAQQAFLSWKKVSAKERSNTLRKWYELILENVDDLATIMTTEQGKPFAEAKGEVVYAANFIEWFAEEAKRTYGEVIPSHKTDARIVVSKEPIGVVGAITPWNFPAAMITRKCGPAFAAGCAVVLKPAPDTPFSAFALAELAERAGLPSGLFNVITGDAVAIGGELTKNKVVKKISFTGSTAVGKLLMAQSAPTVKKLSLELGGNAPFIVFEDADLDAAIDGVMVAKFRNAGQTCVCANRLYVHETVYDVFVEKLVQRVSTLIMADGFTDGATIGPLINRASAEKVQSHVTDALDKGATLAFGEKADPATNFFPPHVITHVTDEMRVATEETFGPLAAVFSFATEDEVIARANDTDSGLASYVYTRSLQRAWRMGESLEFGMVGINEGLISTEVAPFGGVKESGLGREGARQGICDYMETKYMLMGGL

SEQ ID NO: 43891 - protein, 223 aa, Glycine tabacina
  misc_feature (90)..(90): Xaa can be any naturally occurring amino acid
  unsure (1)..(223): unsure at all Xaa locations
PSPQEVVALYNQFNIRRMRIYGPSQEVLEALRGSNIQLLLDIPNDNLQNLASSQDNANKWVQDNIKNYANNVRFRYVSVGNEVKPEHSFXQFLVPALQNIQRAISNAGLGNQVKVSTAIETGALAESFPPSKGSFKSDYRGAYLDGVIRFLVNNNAPLLVNVYPYFAYIGNPRDISLDYALFRSPSVVVQDGSLGYRNLFDATVDAVYAALEKAGGGSLNIVV

SEQ ID NO: 43892 - protein, 228 aa, Gibberella zeae PH-1
MGREDQVEEREVLESIFPEEITDISETEFRVSVALDIPDEEDEEPPTMLLQVRYPEDYPEKPPHLDILAPPNAIPHEHFNVADDRDQLLASLDETIQENLGMAMIFAIVSTLKDNAEQLVQERKDVITRAHEEAAQAAEAEENKKFHGTRVTPETFIKWREGFIKEMEDKRQQEEDDRLAEMKKARVKEPARLTGRQLWERGLAGKGDDEEDDDMPVEGVEKLKVEAV

SEQ ID NO: 43893 - protein, 574 aa, Arabidopsis thaliana
MKTISIFFVIILMSSSHAEDDVLCLKGFKSSLKDPSNQLNTWSFPNSSSSICKLTGVSCWNAKENRILSLQLQSMQLSGQIPESLKLCRSLQSLDLSFNDFSDLSGNKLSGSIPSQIVDCKFLNSLALNQNKLTGSIPSELTRLNRLQRLSLADNDLSGSIPSELSHYGEDGFRGNGGLCGKPLSNCGSFNGKNLTIIVTAGVIGAVGSLCVGFGMFWWFFIRDRRKMNNYGYGAGKCKDDSDWIGLLRSHKLVQVTLFQKPIVKIKLVDLIEATNGFDSGNIVVSSRSGVSYKADLPDGSTLEVKRLSSCCELSEKQFRSEINKLGQIRHPNLVPLLGFCVVEDEILLVYKHMANGTLYSQLQQWDIDWPTRVRVAVGAARGLAWLHHGCQPLYMHQYISSNVILLDEDFDARVIDYGLGKLVSSQDSKDSSFSNGKFGYVAPEYSSTMVASLSGDVYGFGIVLLEIVTGQKPVLINNGEEGFKESLVEWVSKHLSNGRSKDAIDRRIFGKGYDDEIMQVLRIACSCVVSRPKERPLMIQVYESLKNLGDQHGFFSEYSDEFPLIFNKQEHLK

SEQ ID NO: 43894 - protein, 388 aa, Triticum aestivum
  misc_feature (93)..(93): Xaa can be any naturally occurring amino acid
  misc_feature (121)..(121): Xaa can be any naturally occurring amino acid
  unsure (1)..(388): unsure at all Xaa locations
MLLLLRQRILSHLLSAAPDPSTSPLLSLHRLLSAATPAISPNPSFAVEDYLVGTCGLTRAQALKASAKLSHLRSPSKPDAVLAFLAGLGLSGXDVAALVARDPLFLCAGVERTLDPVVAGXTGLGLSNAETARLISLAPDSFRRRSVVSKLEYYLPLFGSIDNLLRPLKHGSGFLCSDLERGVKPNVKLLAECGLGACDIAKLFIRVPRILCAKPGRVVTMIARAEDIGVPRGSGMFRQALHAVSYFSQHKITAKLDYLKKTLRWSDTEVGIAVSKAPVLLTRSHDVLQRMSEFLISEVGLEPAYIAHRPVMLTYSLEGRLRPRYCVVKFLKENGLLEHGRSYYTSLIRTEKVFTEKFICPHKEAAPHLAEDYAAACKGEVPARFRFT

SEQ ID NO: 43895 - protein, 354 aa, Azoarcus sp. BH72
MKICVLPGDGIGPEITAEAVRVLRALDLKIELEEALLGGSAVDATGTPYPEATQKLARAADAVLLGAVGGPKWDTLPREQRPERGLLGIRKDLSLFANLRPAILYPELANASTLKPEVVSGLDILIVRELTGDIYFGQPRGIETREVNGAQQRVGWNTMIYAEYEIRRILKVAFEAAQKRGKKLCSVDKMNVLETTQLWRDIADEMAKDFPDVELSHMLVDNAAMQLVRNPKQFDVMVTGNMFGDILSDEASMLTGSIGMLPSASLDANNKGLYEPSHGSAPDIAGKGVANPLATILSAAMMLRYTFNQEEAAVRIERAVKKVLAQGFRTGDIYEAGTKKVGTREMGDAVLAAL

SEQ ID NO: 43896 - protein, 361 aa, Desulfitobacterium hafniense DCB-2
MPYAGIEKGQLYLAGDIGGTKTLLGLYSLEGTELVLVRERNFPSKDWQDLTALIQGFLDEIALTPEDITGGCLSLAGPITQDKCFLTNLNRVIDCPDLRSSLPLRRPLLLVNDLEAMGQGLMDLRGEDLICLNPSAESPSSSLASSPALSLARPSLNRALIAPGTGLGQAMILADGRVCATEGAHGDYAPRTEQEVRLWRFLAQRYGHVSYERVLSGPGLADLYRFLYWEALSPSLPGPASDSIPAPDSSLTPAEITKKALDGICTLCTETLELFVKILGAEAGNLALRTLAYGGIYLGGGIPPKILPKLQEDGFMEAFLAKGRLRELLSQIPIYVILNERTPLLGAARLAVAAGYPFTCS

SEQ ID NO: 43897 - protein, 446 aa, Magnetococcus sp. MC-1
MATEIKVPTLGESVTEATVVQWLKQVGDAVAVDEPLVELETDKVTVEMPSPVAGVITEIYAGVDADVEVGAVLCVVDAQGSARVAVPAKPAAEPAPAPAVATAATPAPAVATPAPTVPVAPPSGGAALSPAVRKLLAEHGLDATQIPATGSGGRLTKGDVLAYLEQPKPAPTAAPTPAPTAAPTPAPTPTPAPAPMATPALAPAAQLPPAVEGPREERVKMSRLRQRIAQRLKEAQNTAAMLTTFNEVDMTAVMALRSQYKEVFEKRNHARLGFMSFFVKAAISALQEFPAVNAEIQGNEIVFKNYYDIGVAVGSPQGLVVPVLRGADAMSLAGIESTIAGMGKRARDGQLSMEEMSGGTFTITNGGIFGSLLSTPILNTPQSAILGMHKIQQRAMVMPDGSIQARPMMYLALSYDHRIVDGKEAVSFLVRIKDCIEDPARILLNA

SEQ ID NO: 43898 - protein, 468 aa, Magnetococcus sp. MC-1
MSDTFDLVVIGGGPGGYVAAIRAAQLGLKTACIDKRPTLGGTCLNVGCIPSKALLQSSHQLETAQHAMAAHGVEIKGVKANLTTMMQRKQEVVQGLTQGIAFLFKKNKVTHLMGSGTIVDSSHVQVTAADGSVQTLTTENILIASGSEVATLPGLEIDEKHIISSTGALALDKVPKKMVVIGAGVIGLELGSVWRRLGAEVTVVEFLDGILPGMDGEIRKTAQRTLSKQGMHFKLGTKVTAASVLKNGVKLTMEPVKGGEAEERQADVVLVAVGRRPYTQGLGLENIGVTLDERGFIPVDHDRQTTCAGVFAIGDVIGGAMLAHKAEEEGSAVAEALAGQVAHVNYDAIPAVVYTHPEIASVGQSEESLTAAGIPYKVGKFPFMANSRARAIGDAEGFVKILAHATSDAILGAHIIGPAAGDLIAEIVLAMECDISAEDIARTCHAHPGLGEAVKEAALAVDKRAIHA

SEQ ID NO: 43899 - protein, 1429 aa, Magnetococcus sp. MC-1
MPHRSPIQSRPQPPLQSDALRANLAQTAVAAVEIPPHQQPLLQVVEPHAGIYQPLEQLLKELNHPFRNWRLLLPEWRAFVLKNLYHYLQHPLASTTLPLLGAPFFQALDDASQSREHVAALGAMCAYIEKLAQAVTPQNNALLQPCIEDLLGALQQRPDAQFCLLAQTHHPLKRAIKRLLEIPETPITQLNWQGAAQVMQRHLRLTYAFWLQQEDPSPFTTPLHGALFTALSHPALYQQQKQLERLAERHPPHGATALAFVQGLLELPDAHDMVRLYGEAGNRLSQSLKQSGDAHTERANVARCLQFLFRILENEGLTLLHEKTLREVNQGLVRLLSIAHDHDQTEAFFIRTFESLNHNVLHYPRTALQCIEALGSKVIQLANPRLVELFLEQAVGFGFQHSCVAGVDAQWKTIANPAHLHNIRVWLALIGQQPKWCSTLLSALIINIKLTGTLIRDTDLFQKDISKLLNSEVEPVYNLVKQFARLLPVYYNDIGAEGALRDVSTQLDEIHHRQDPLIHFLRKQCHVESTNLIVPLTAAVIRYWQSGEPAHVAPYLSEPVRMSLLQQAPLLEGVQRVMAALFDQLALQQPEALLNLPLTTLSPIVQAVDGVEASEKQRVLLLIELYQLVEQKYNPGFAGVLPLLQRMAQLGVAEATPLLQALEQGTAPTLPLLLEAMEGLKRLILDPQQHAAQEEIFQKRHIAVGIPSVYGRYSEPKFDALALIFRLERQATALLDGLTANVPEAFVTRATITQVIEDLSLFQRALRLDGIKSRKLRNDLLVVRYFVETNPFTYHQFLDLFRSLSQVVKGIIYTHYTSHHRDNMARIIPTLPAAAMQSKYAALLQAGDTTGNLERVNESFMRDLIAETFSLQALDNYLGRVLKMLHRQLSMLDAQRAQQLLTYDPTKLFCPIHHPNMAILHPIHLGNKGYNLARLVVNGAPVPAGTILTTEFFRCHRLIHDHPPAWQDFMARLRAEMAALEQQTGLGFADPQRPLLVSVRSGALISMPGMMQTIHNVGINETIVAGLSQQSGNAFFAWDTYRRFIQSWCMAHDVERGVFSDIMRSFKQQYGVKKKGQFSAEQMRQLAFAYRDAARGLAITLPEEPWQQLLAAIELVLASWHGEKAHHYRAIMDLSDAWGTAVVIQKMIYGNLLQSMITEETDGAACPRVLSGTGVLFTAHPYRKLTQVMLWGDYTPGNQGEDIVGGLVSTWPISMEQCYSDHRDPQQALEHRFPLIYQGLLELAKTLIYTRDWNHQEIEFTFDGPTVEHLHILQTRNMITRESLHSVVSGFKLHGSLKEHLIGQGIGVHGGALCGRAAFNLEQIETLRQTYPSDPLILIRYDTVSDDIKEISQSQGLLTARGGQTSHAAIVAASLQKTCVVGCESMRVWELQGYCKLDGVTVKLGDAIAIDGHNGHVLRGWHEIERTLY

SEQ ID NO: 43900 - protein, 355 aa, Ustilago maydis 521
MSAPTTMKAVVIQGPEQVAVLERPIPKPGKGEVVVKVNLAALCGSDLHIYRGHQAVPRYDFVLGHEFVGEIHEAGEGIKNWKRGDKVVSPFTISCGDCFFCNRNQTGRCTQSRVFGSVPLDGAQAEYVLVPLADTTLYPIPDDVPEEIMLLTADIFPTGYFVANNAYTMLNEAERKDVTAVVIGCGPVGLCAITAACSFFKTVYAVDSVPERLAEAKKHGAIPLHLTDDDPVKTVKEATGGRGADVALEVVGAGPALDLAVSIVRNFGVISSCGIHTHTVTLQGPDLYNKNLRFQFGRCPVRAVFDPAVKLLSKHHDLFASFIQHTRPIEDAPEYYKLFNDRKVLKTVFKMNHAQ

SEQ ID NO: 43901 - protein, 824 aa, Arabidopsis thaliana
MDKTSQLPDELLVKVLSFLPTKDAVRTSLLSMRWKSLWMWLPKLEYDFRHYSVSEGQGLARFITLSLLGHKAPAIESLSLKLRYGAIGSIKPEDIYLWVSLAVHDSNVRELSLKLCTFAERPTKLPKSLYKCKSIVILKLKDEILVDVPRKVCLPSLKTLFLGRVTYSDEDSLHRLLSNCPVLEDLVVERDRIDNLGKLSVVVKSLQRLTLKMSCPCHLDGIMMNTPSLKYLKVTDERQESDSDNESDSDSPRYFYDFEDMPKLEEADFVLTFQNIKKDGISGLPDAMICHILSFLPTKVAASTTVLAKRWKPLLAFMPNLDFDESFRFDPRMTCEERRKGSESFMLVVDSVLALQAEANATLNKFYVKCEGVEQNSVLEWIPKVLKRGVLDIDLQIPSSRGFGSNSTFYPLPSEIFVSKTLVRLKIQFQDGANVNVEGDVSLPMLKTLHLDYVKMDTRMLQKLLSGCHTLEELLLMNLIWKESSEPEPCFVSVSVRTLKILKFSRFENFMKAKDFKPIVLLSFDIPNLVYLEYLDTIADKYEQVRFDSLVKASIGLCKTSKQIENDNNNVTKLFMGICNVTILYLTEDTLKVLGCCRETMPVFENLIHLTIRTGVHIGWKSLPHLLKNCPNLQTLVFEGMHHIYRKGRACGDVDEDGTCMCKNLDNMRVKKDIDACLSSSPVKVIKILNFGELCGFCEFCDVEEDVAGQIKQVKQFLETMPDLEKVILYYNTPEDEDVMKVFKKLKKLPRVASAKCEVSAHGFNAPVHQHSLYDLRDLRAETQLERFTKKYVPRGEELRCAHPCSTGHAKNQEPLDRYTVGES

SEQ ID NO: 43902 - protein, 139 aa, Gibberella zeae PH-1
MLTLFHRDPPSSCSAGPVGEDLFHWQATIMGPSDSPYSGGVFFLAIHFPTDYPFKPPKVNFTTRIYHPNINSNGSICLDILRDQWSPALTISKVLLSICSMLTDPNPDDPLVPEIAHVYKTDRPRYEATAREWTRKYAI

SEQ ID NO: 43903 - protein, 449 aa, Bordetella parapertussis 12822
MGPQLVSWKNKRNLSPEILPMSQAPAHSLPSYLDAEHLGPWGIYLQQVDRVTPYLGPLARWVETLKRPKRALIVDVPIEMDNGSIAHFEGYRVQHNTSRGPGKGGVRFHQDVTLSEVMALAAWMSIKNAAVNLPYGGAKGGVRVDPRTLSHSELERMTRRYTSEIGVIIGPSKDIPAPDVNTNAQTMAWMMDTYSMNEGATATGVVTGKPIALGGSLGRVEATGRGVFVVGCEAARDLNLDVSKARIVVQGFGNVGGTAARLFHEAGAKVIAVQDHTGTIHNDGGLDVHKLLAHVGNQGGVAGFTGAQQLADDDFWGLETDFLIPAALEGQINENNAARVRAKVVVEGANGPTTPEADDILRENGVYVVPDVLANAGGVTVSYFEWVQDFSSFFWSEEEINQRLERLMREAYSAVSQVAKEHKVTLRTAAFIVACTRILQARQVRGLYP

SEQ ID NO: 43904 - protein, 208 aa, Lotus japonicus
MSSSSGGYDLSFKILLIGDSGVGKSSLLVSFISSSVEDQSPTIGVDFKIKMLTVGGKRLKLTLWDTAGQERFRTLTSSYYRGAQGIILVYDVTKRETFTNLSEVWSKELELYSNNQDCVKMLVGNKVDRDAARAVSREEGLALAKELGCLLIECSAKTRENVEQCFEELALKIMEAPSLLEEGSTAVKRNILKQKQEPQASQHGGCCS

SEQ ID NO: 43905 - protein, 570 aa, Gibberella zeae PH-1
MQDWSEKPSERSRWTPLTRMLLSGEMTQEKQQELSSREKFDRWMINEGYRRFFVFVFMILHALIFSFACVHYAQKESLETSRQTFGFTFIIARSAALVLHVDVAIILFPVCRTLISLLRQTPLNGILQFDKNITFHIVTAWSIVFWSWVHTIAHWNNFAQVAIKYNLGIYGWLLANFVSGPGWTGYVMLIALMGMVLTSMEKPRRANFERFWYTHHMFIVFFFFWSIHGAFCMIQPDVAPFCTSIGSSAIGVFWQFWMYSGFCYLAERIAREVRGRHRTFISKVIQHPSNVCEIQMKKEHTKTRAGQYIFLCCPAVSLWQYHPFTLTSAPEEDYISIHMRCVGDFTKELAKSLGCDWSKKKDAGDASKVVGLTGREAEIDPAIRRVLPRVYVDGPFGSASEDVFKYEVSVLVGAGIGVTPFASILKSIWYRMNYPQKKTRLSKVYFFWICRDFDSFEWFRSLLLAVEAQDLDHRIEIHTYLTARIKADDATNIMINDANADKDTITGLRSPTNFGRPNWDMIFRGIRKIHSPAEAGVFYGGPKGLGSSLHTYCNKYTEPGFSFVWGKENF

SEQ ID NO: 43906 - protein, 382 aa, Desulfitobacterium hafniense DCB-2
MSNLRVLVISAAFGAGHIKAAEAVIEAIWAKRPNTEIYHADFGAFLNKAFHLVIKTAYIDMIKYTPKLWGEFYYRTSDIPSDSLFQRFLNGLGRQEFISYIHSVQPDLIVCTYPTIAGVLAQLKEKRILTVPLAAVVTDYAIHNQWVHQGVDLYLVGSQEVADGLAQRGINPGCLKVTGIPVSPKFEIKLDREELARKFGLDPGQPTILVMGGAYGVLDNATGICRLIMQNKLPVQLLIVCGRDKRLYSTLEPLVRKAENRVLLFEFVENVEELMTVSDLMITKAGGLTVSEALTKQLPMVIYKPIPGQEKANSEFLRRVGTGKIAATEGELLQILTHLLENPEEIKLMSHAAAKLPRRTAETAADYLLELFRQRNRVRKVG

SEQ ID NO: 43907 - protein, 445 aa, Kluyveromyces lactis NRRL Y-1140
MSKVLLLGSGFVAQPVVDVLSATDGISVTVACRTLNKAQALAKASGSNAISLDVSDPKQLDAALADHDLVISLIPYTYHPAVVQSAIRLKKNVVTSSYISDALRELEPAIKEAGITVMNEIGLDPGIDHLYAVKTIDEVHKVGGKIKSFVSYCGGLPAPEDSDNPLGYKFSWSSRGVLLALRNSAKYWKDGKIETVSSEDLMASAKPYFIYPGYSFVCYPNRDSTLFKELYHIPEADTVIRGTLRYQGFPEFVKALVDIGMLKDEPNELFASPQPWNKALAQYLGAASEKKEDLIKAIDSKTQWKSDDDRERILSGLAWLGLFSDKPFNARGNVLDTLCATLEELMQYEEGERDLVVLQHKFGIEWADGTTETRTSTLVDYGKVGGYSSMAATVGYPVAIATKFVLDGTIKGPGLVAPYSPAINDPIMKELKEKYGIYLKEKTIA

SEQ ID NO: 43908 - protein, 182 aa, Coccidioides immitis RS
MAEKRAVFTEKGVPPLPVLSQAVVHNGMIYCSGSVGLDPATKEMVSGGVGQRTAQALQNLKVVLEAGGSSVKNVVKANVFLTSMKDFVEMNKAYESFFADGVKPCRTCVAVKELPFGTDVEIECIAYLIAGINHIQSSEASKYPLQQGTSAKLNLSLESIFYREGALFLVREHRVLAGSQPN

SEQ ID NO: 43909 - protein, 223 aa, Glycine latrobeana
PSPQEVVALYNQFNIRWMRIYGPSQEVLEALRAGSNIQLLLDIPNDNLKNLGSSQDNANKWVQDNIKNYANNVRFRYVSVGNEVKPEHSFAQFLVPALQNIQRAISNAGLGNQVKVSTAIETGALAESFPPSKGSFKSDYRGAYLDGVIRFLVNNNAPLLVNVYPYFAYIGNPRDISLDYALFRSPSVVVQDGSLGYRNLFDATVDAVYAALEKAGGGSLNIV

SEQ ID NO: 43910 - protein, 217 aa, Glycine falcata
ALYNQFNIRRMRIYGPSQEVLEALRGSNIQLLLDIPNDNLQNLASSQDNANKWVQDNIKNYANNVRFRYVSVGNEVKPEHSFAQFLVPALQNIQRAISNAGLGNQVKVSTAIETGALAESFPPSKGSFKSDYRGAYLDGVIRFLVNNNAPLLVNVYSYFAYSDNPRDISLDYALFRSPSVVVQDGSLGYRNLFDAMVDAVYAALEKAGGGSLNIVVS

SEQ ID NO: 43911 - protein, 181 aa, Salix bakko
MGLSFTKLLGRLFSKKEMRILMVGLDAAGKTTILYKLKLGEIVTTIPTIGFNVETVEYKNISFTVWDVGGQDKIRPLWRHYFQNTQGLIFVVDSNDRDRVGEARDELHRMLNEDELRDAVLLVFANKQDLPNAMNAAEITDKLGLHSLRQRHWYIQSTCATSGEGLYEGLDWLSNNISSKA

SEQ ID NO: 43912 - protein, 227 aa, Glycine soja
LGNNLPTPQEVVALYNQANIRRMRIYGPSPEVLEALRGSNIELLLDIPNDNLRNLASSQDNANKWVQDNIKNYANNVRFRYVSVGNEVKPEHSFAQFLVPALENIQRAISNAGLGNQVKVSTAIDTGALAESFPPSKGSFKSDYRGAYLDGVIRFLVNNNAPLMVNVYSYFAYTANPKDISLDYALFRSPSVVVQDGSLGYRNLFDASVDAVYAALEKAGGGSLNIV

SEQ ID NO: 43913 - protein, 420 aa, Thermoanaerobacter tengcongensis MB4
MITKVKNLFKGEHRPKLMALDFIKYIGPGLLVTVGFIDPGNWASNVAAGSSYGYKLLWMVTLSTIMLIILQHNAAHLGIVTGYCMSEAATKFLKPFTSRLVLISAVFAAILTAMAEILGAAIALQMLFKIPIKIGSLITVVFVSWMLYTNSYKKLEKWIISFVSLIGISFIFELSLIDVKWAEVASSWVKPEFPAGSMPIIMSVLGAVVMPHNLFLHSEIIQSRQWNLEDEKVIVKQLNYEYFDTIFSMIIGWGINSAMIIVAASAFFTNNVTVMELNQAQQMLKPLLGNASAVVFALALLFAGISSSITAGMAGGSIFAGIYGEPYDIHDAHTKVGVGITYIFAVLIIFFVKSPFQGLVYSQMFLSVQLPITIFLLIYLTSSKKIMGKFANTLLYKVLLWTIGIIVTVLNAMLLMSFVG

SEQ ID NO: 43914 - protein, 329 aa, Thermoanaerobacter tengcongensis MB4
MNIPKETLMRMYLEMVTIRLYEETMAEAYQEGKYPVFNIASGPVPGEMHLAAGQEPVAVGVCMHLKKEDAVVGTHRPHHFAIAKGVDLKRMTAEIFGKVTGLGRGKGGHMHLFDPDVHFSCSGIVGASIPQAVGAALAFKMRKEKRVAVAFFGDGAANQGTFHEGLNLAAIWKLPVVFVCEDNSWAISVPKEKSTAISQNADRAVAYGIPGVYVGENDVLAVYEAAGEAIERARQGGGPTIIEVKTDRFFGHFQGDPEVYRPKDEVQRLKQNDPIKRFRKYLIENDIATEDELKQLDDEARKRVEEAFLFARESPYPAPEEALLHVFVE

SEQ ID NO: 43915 - protein, 339 aa, Thermoanaerobacter tengcongensis MB4
MSAITSRKLTMAKAIAEAISLEMERDPRVFVMGEDVGVYGGIFGATAGLYEKFGPERVIDTPISEAGFIGAALGAAMEGMRPIVELMFVDFFGVAMDQIYNHIAKNTYFSGGNIRVPLVLMTAVGGGYNDAGQHSQCLWGTFAHLPGLKVVVPSTPYDAKGLMISAIRDDNPVIYMFHKGLLGLGWMTLIKDSTGPVPEEPYTIPFGKAEVKREGKDVSIISVAMGVYQALEAAKELEKEGISVEVLDLRTLVPLDREAIINTVKKTHRVLVVDEDYLSYGMSGEVAATIVEHAFDYLEAPVKRLAVPDVPIPYSRPLEQFVLPSSSKIVNAVKELLRS

SEQ ID NO: 43916 - protein, 399 aa, Thermoanaerobacter tengcongensis MB4
MPYEFRMPNVVSNGIEGFVVNWFKDEGQPVQAGELLLEVQFEKAAIELQAPVSGILTKILCPQGHVVKVGQLLCLIEEKSTEVAGGSGSAVPPVHAPEETPHFHGETERTTQSTPVDSQVHSSNTGDVRATPAARKLARELGIPLEAVPGTGPGGRITEEDVKNFAQRSEKTNLTARRVPLTPTQRLVGSRMLQSLRETAQYTLGREVDISALIKVRMELKQKGSPANITDLIHKAVVQAILENPVMQAVIDGDDMVVPAEVHLGFAVARGDELLVPVIKNAHRLNLNEMAVERRRLTDAVLQGIIKPEELQGGTFTVTNLGTYGVDFFTPVLYPKQSAILGIGRIVERPVLENGNIRSAQFMTLSLTVDHQVINGAPAARFLNRLAELLSQPEVLLEL

SEQ ID NO: 43917 - protein, 176 aa, Triticum aestivum
  misc_feature (31)..(31): Xaa can be any naturally occurring amino acid
  misc_feature (117)..(117): Xaa can be any naturally occurring amino acid
  unsure (1)..(176): unsure at all Xaa locations
MGATVMASSATSVAPFQGLKSTAGLPVSRRXSNGASLGSVSNGGRIRCMQVWSIDGIKKWETLSYLSPLSTEALLKQVDYLIRSKWVPCLEFSKVGYIFRDHNASPGYYDGRYWTMXKLPMFGCTDATQVINEVEEVKKEYPDAYVRIIGFDNMRQVQCVSFIAFKPPSCEESGQA

SEQ ID NO: 43918 - protein, 498 aa, Bordetella parapertussis 12822
MTLHDSAYWRAQAAALAPEGRAYIDGAYCDAADGATFAAHSPIDGRKLADIAACGAADVDRAVAAARRAFEAGVWSGLAPRERKHRLLRLAALITEHQEELALLETLDMGKPIRDALAFDLPETARCYAWYGEAIDKRYDEIAPTGADALATITREPLGVVAAVVPWNYPLMMAAWKVAPALAVGNSVILKPAEQASLSALRLAALAEQAGIPPGVFSVVPGLGAQAGQALGLHPDVDCIAFTGSTATGKRFMTYSGQSNLKRVWLECGGKSPHIVFADCPDLDRAAQVAALAIFSNQGEVCIAGSRLYVQHGIYDAFMEKVAAFAATLRPGNPLDPDSALGAMVDERQTQAVMARIAAGAQEGARLRLGGRQVLTDSGGYYIEPTIFDCPGQDNSLVREEIFGPVLAAQGFADEDEAVALANDSIYGLGAGLWTADLGRAHRLSRRLRAGLVWVNCYADGDITVPFGGVKQSGFGRDKSLHAMDKYSDLKTTWISLR

SEQ ID NO: 43919 - protein, 464 aa, Lactobacillus plantarum WCFS1
MKSAKTKDHAKMKAAEEKAIHSTGADSKSLDEVNGSVRVPKDASFWRTLIAYTGPGALVAVGYMDPGNWITSIAGGSQYKYALLSVILLSSLIAMLLQAMAARLGIVTGKDLAQLTRERTSKGMGIFLWIITELAIMATDVAEIIGSGIALKLLFGFPLIVGILITTADVLILLLLMKLGFRKIEAIVATLVAVILFVFLYEVIISQPNIPEMLKGYVPTSRIVSNRSMLFLALGIVGATVMPHNLYLGSSISQTRQVDRSDEKEVAKAVKFTTIDSNIQLSVAFVVNSLLLILGAALFFGTKGDLGRFVDLYNALGDSKVVGSIASPLLSMLFAIALLSSGQSSTITGTLSGQIIMEGFIRLKMPLWAQRLLTRLISVTPVLAFAIYYHGNEAKIEDLLTMSQVFLSIALPFAMIPLVMFTSNRALMGNFTNRVWVKWTAWIVTVILIILNIYLILQTVGLVK

SEQ ID NO: 43920 - protein, 445 aa, Arabidopsis thaliana
MATRANVPEQVRGAPLVDGLKIQNKNGAVKSRRALGDIGNLVSVPGVQGGKAQPPINRPITRSFRAQLLANAQLERKPINGDNKVPALGPKRQPLAARNPEAQRAVQKKNLVVKQQTKPVEVIETKKEVTKKEVAMSPKNKKVTYSSVLSARSKAACGIVNKPKIIDIDESDKDNHLAAVEYVDDMYSFYKEVEKESQPRMYMHIQTEMNEKMRAILIDWLLEVHIKFELNLETLYLTVNIIDRFLSVKAVPKRELQLVGISALLIASKYEEIWPPQVNDLVYVTDNAYSSRQILVMEKAILGNLEWYLTVPTQYVFLVRFIKASMSDPEMENMVHFLAELGMMHYDTLTFCPSMQAASAVYTARCSLNKSPAWTDTLQFHTGYTESEIMDCSKLLAFLHSRCGESRLRAVYKKYSKAENGGVAMVSPAKSLLSAAADWKKPVSS

SEQ ID NO: 43921 - protein, 458 aa, Bradyrhizobium sp. BTAi1
MLSNSLIELDRAHLVHPVASYRGHEASGARVLTSAKGAVVTDASGHQLVDGFAGLWCVNAGYGHESIVEAAAKQMRELPYATGYFSLASEPAIRLAAALAERAPGDLNHVYFTLGGSDAVDSTVRFIHNYWHVKGQPQRDQFITLQQGYHGSSTVGAGLTALPAFHANFGVPLNWQHKIPSHYPYRNPVGRNADAIIAASLAALDAKIAELGGPERVAAFYAEPIQGSGGVLVPPDGWMKAIRARCRQHGILFVADEVITGFGRTGPLFACTDDEVVPDLMTVAKGLTSGYVPMGAVLMSDHVYGVIADGAGAAAVGHGYTYSAHPVSAAVGLAVLDLYESGLLENGRRAGARLMAGLRAMQDHPLVGEVRGRGLLAAIELVVDKEKKTPLPASAEPSRRIFDRAWANGLVIRAFPTGVLGYAPPLCCSESDIDAIIARTARTLDQTLADPDVRQAMP

SEQ ID NO: 43922 - protein, 447 aa, Kluyveromyces lactis NRRL Y-1140
MQSLNSQLGGLPNSEQFFGKGAVQQQGPVGMNGMLFSPSMNSTRMMPQQSQQPHVLHGLENNGGLQNSYLLKQKMDVVNSAFGQQNNLQQQQQPGKMPLPNNGQVPMMMQNSISGGNSNNNTIPQQMQFPMPVQQQAMGNVNGLDTTPLPNASHTPISSPAHLLIREVWQNNVNFEFAIIRKMIEQYKVISISTEFVGTIARPIGNFRSKTDYHYQTMRSNVDLLTPIQIGLSLSDLQGNKPDNFPSTWQFNFHFDVTKETVNSESLELLKKSGVILERHQQNGVDFDEFAQLMMDSGLLLNDEVTWISYHAAYDYGFLINRLMNTNMPNNKEDFEWWVQKYIPTSYDLNLINKLVHEVTQQHPHPPPLHLLQSQQQQQQNQQQQYTLELLADELGIPIFPLFSSAAGQSLLALLAYTQLGKLSLYKLRNGTDFSYYKNLIYGITQE

SEQ ID NO: 43923 - protein, 370 aa, Methanothermobacter thermautotrophicus str. Delta H
MILPLGPMHPGYKEPIRLKVKTRGEKVLKAEIEYGYVHRGIERVMRNKTWQKAIYLSERVCGICSYIHTQTFAEAFEAISEVEAPPRAQFLRALTNELDRIQSHLIANSTYFKALDHETMFMYMLALREPVMDAIELLTGNRVNMGWNVVGGVRMDASESHLSMIREIIVDLEREFDRYVEMFEHGPLIGLRSREVGYMSQEEAEKARAVGPIGRASGIRYDFREDHPTYRDHLDFRTIWRDDGDNFARVMNRFDEIRVSIDLIKQVIDDMPGGPVRTKVDVKAGYGEWRNEAPRGEVAYMIETNGNLIKNISIRTPSIMNIDACAKYMLRDVATVADAVATYASADPCIACAERVMVVDEESGEREILL

SEQ ID NO: 43924 - protein, 370 aa, Saccharum officinarum
MDGAPVAEFRPTVTHGGRFLQYNIFGNLFEITHKYQPPIMPIGRGAYGIVCSVMNFETREMVAIKKIANAFDNHMDAKRTLREIKLLRHLDHENIIGIRDVIPPPIPQAFNDVYIGTELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQFPRRPFASLFPKVQSVAALDLIERMLTFNPLQRITVEEALEHPYLERLHDIADEPICTEPFSFDFEQQALTEDQMKQLIFNEAIEMNPNFRY

SEQ ID NO: 43925 - protein, 578 aa, Solanum tuberosum
MGNTCVGPSISKNGIFQSVSAAMWRSRSPDDTASTTNGESARIETPISVKEPDSPLPVQEPPEQMTMPKSEKKEEEKEQPKKPKKPAEMKRVSSAGLRTDSVLQKKTGNLKEFFSIGKKLGQGQFGTTFKCVEKATGKEYACKSIAKRKLLTDDDVEDVRREVQIMHHLAGHPHVISIKGAYEDAVAVHVVMEFCAGGELFDRIIQRGHYTERKAAELTRTIVGVVEACHSLGVMHRDLKPENFLFVDQKEDSLLKAIDFGLSIFFKPGDRFTDVVGSPYYVAPEVLRKRYGPEADVWSAGVILYILLSGVPPFWAENEQGIFEQVLHGDLDFKSDPWPSISEDAKDLMRRMLVRDPRRRLTAHEVLCHPWVQVDGVAPDKPLDSAVLSRMKQFSAMNKLKKMALRVIAESLSEEEIAGLKEMFKMIDTDNSGQITFEELKEGLKRFGSNLKETEIYDLMQAADVDNSGTIDYGEFIAATLHMNKIERQDHLFAAFCYFDKDGSGYITADELQQACEEFGIGDVRMEEMIREADQDNDGRIDYNEFVAMMQKGNPVLGGGKKGLEHSFSIGFREAVKL

SEQ ID NO: 43926 - protein, 899 aa, Photobacterium profundum SS9
MKRNKVSRRNFLKGSGFIASTAAGAGLFVAHNPELEAAPLTGEPTKRTTALAQCPYCGVGCGTIIQVENGKIVSMRPDKDHPTNYGLQCIKGLTAAEPMYVDRMEGDPYVRKDVWDEWNKPDHGDIEYISKTKGSFDEEHFIRVPYHDASDMVARKIAHFAKKYSGNSISLYGSGQLTMEGQYLENLFMKGVLGSNTIEANARMCMTSAVTGYFATLGSDTPPLAYDDIELADMVMHFGHNARESHPIIFWRIADHKKKKDIPTVVVDPRATGTNKGYADINDKNHVHVPLLNGDISFLNAIAHVLLKEHDDVIDWKFLKAHVTGWQEYIDGVKDNYSPEQVQDRMGGVNHDVSPEKIRRVAAMFADATRKRLARSKGKQEGEGYGGVIIMWGIGYNQHIHGQHNVISIINLLTLTGNLAKPGCGPFSMTGQPNAMGERFTGGLTGRLPFNEGLGNLKHRAHMAKMWRVPEKNLDNAASSPNPGYAVGMMERALKDDLKAMFLVYATHIDLPDQYNLVRPALAKTFNVVQEIYRHAPNNLYADVIFPACTWGEVNGVYISSERRINITEKAAQGPKGCRPDMDMVIDKGKEIAELLGMDGDKIFPYKRGKDGEYDAEEVFRDVCRASVGTDADLTGILDREKLDGISPYEQLKTLRGIQWPAPNYEAAKNGGTQRRYMMQEGQWENRPYGYFRTKDGKVHMKLCQQDYSQRKEITKKLMEFGVKKDHYTIDNQDLIIKARDMALTPDLPDEEFRGQSWQNVPKDKFPYWMGLGVVYEHFHTAKSNRSPTTRRLVPEMYVEMHAEDAKDLGIKDGEWVRVVSRRGSLEARAQVGGTDSLVKPARNSVPRGYMFGPWNLSVADSADPKKNKWLANGISNRCWDPVSGQVDFKKLACRIEKI

SEQ ID NO: 43927 - protein, 352 aa, Thermoanaerobacter tengcongensis MB4
MKGFAMLSIGKVGWIEKEKPTPGPFDAIVRPLAVAPCTSDVHTVFEGAIGERHNMILGHEAVGEVVEVGSEVKDFKPGDRVVVPAITPDWRTSEVQRGYHQHSGGMLAGWKFSNIKDGVFGEFFHVNDADMNLAHLPKEIPLEAAVMIPDMMTTGFHGAELADIELGATVAVLGIGPVGLMAVAGAKLRGAGRIIAVGSRPVCVDAAKYYGATDIVNYKDGPIDSQIMDLTEGKGVDAAIIAGGNVDIMATAVKIVKPGGTIANVNYFGEGDVLPVPRLEWGCGMAHKTIKGGLCPGGRLRMERLIDLVVYKRVDPSKLVTHVFRGFDNIEKAFMLMKDKPKDLIKPVVILA

SEQ ID NO: 43928 - protein, 396 aa, Burkholderia sp. 383
MSTNETSGSRGDPVVIVGTGLAGYTVAREWRKLDGDTPLVMISRDDGSFYSKPALSNALAQRKTPEQLAMSDARTMAEQLRATIRTHCAVRRICADEHEIVLDDGSTQRYRALVLATGADARRVPCEGDGAADVLSINDLADYARFRGGLRDCRSVALLGAGLIGCEFANDLVAAGLTVTVIDPADAPLSRLLPTEAGRVFGHALSDAGVHLRLGTGVRSIARLARGYRLALTDGGHLEADLVISAIGLVPRVALARDAGLDVADGIVTDAWCRTSAPDIFALGDCAAIEGRVRPYVLPIMHAARALAQCLHGTPTRVAFPVMPIVVKTPAIPAVVVAADSGGRWTTEVGVGDAPRATRALCADPDSGRITGFALLDAATAEKAALLKTMAGDAAK

SEQ ID NO: 43929 - protein, 227 aa, Glycine soja
LGNNLPTPQEVVALYNQANIRRMRIYGPSPEVLEALRGSNIELLLDIPNDNLRNLASSQDNANKWVQDNIKNYANNVRFRYVSVGNEVKPEHSFAQFLVPALENIQRAISNAGLGNQVKVSTAVDTGALAESFPPSKGSFKSDYRGAYLDGVIRFLVNNNAPLMVNVYSYFAYTANPKDISLDYALFRSPSVVVQDGSLGYRNLFDASVDAVYAALEKAGGGSLNIV

SEQ ID NO: 43930 - protein, 547 aa, Mesorhizobium loti MAFF303099
MDKSAFQKQLAALRDHRSAAPASMRQAFAADPQRFQAFTATDGDLLLDWSKCAVDATTMDLLEKLAAAADLEGRRAAMFAGKKINITEDRAVLHTALRNLSGTGVTVDGQDVKADVLSVLDAMGAFADAIRSGKALGATGKKITDIVNIGIGGSDLGPAMATLALAPYHDGPRAHYVSNIDGAHIHDTLKGLSAETTLFIVASKTFTTVETMTNAQTARDWVQKALGKQAVGKHFAAVSTALDLVAKFGIEADRVFGFWDWVGGRYSVWGAIGLPVMIAVGPRNFRAFLDGAHEMDQHFRTAPLAGNLPALLGLVGWWHRVICGYPARAVIPYDQRLSRLPAYLQQLDMESNGKGVTLDGTPVATPTGPLVWGEPGTNGQHAFFQLLHQGTDFIPVEFLAAAVGHEPELKHQHDLLLANCLAQSEALMKGRTLDEARAQMLAKGMKPADVDKIAPHRVFSGNRPSLTILYRKLDPRTFGRLIALYEHRVFVEGTLFNINSFDQWGVELGKELATGLLPVVEGKESAANRDASTRGLVERIHQLRGSE

SEQ ID NO: 43931 - protein, 560 aa, Pseudomonas syringae pv. phaseolicola 1448A
MLQTRVLAPADGAYQYPLLIKRLLSSGSRYEKTREIIYRDSVRYTYPTLNERICRLANVLTAAGVKAGDTVAVMDWDSHRYLECMFAIPMIGAVIHTVNVRLSPEQIAYTINHADDRLVLINSDFTGLYQAMSGHLTTVEKTLLLTDLPDKTADLPNLVGEYETLLAAASPEYAFEDFDENSVATTFYTTGTTGNPKGVYFTHRQLVLHTMGVAAILGCVESPRQLGNDDVYMPITPMFHVHAWGIPYVATMLGLKQVYPGRYEPELLVELWRKEKVTFSHCVPTILQMLLNAKSAQDADFGGWKIIIGGSSLNRSLYQAAKARGIQLSAAYGMSETGPLISVAHINDELKASSEDEQITYRIKAGVPGMLVEAAIVDQQGNFLPADGETQGELVLRAPWLTESYFREPEKGAELWAGGWLHTGDVATLDDMGFIDIRDRIKDVIKTGGEWISSLELEDLCSRHPAVREVAVVGIADPQWGERPFALLVIRDGHQLDAKGLKEHLKPFVEQGHINKWAIPSQIALVTEIPKTSVGKLDKKRMRLDIVEWQNSNSTFLSTL

SEQ ID NO: 43932 - protein, 214 aa, Prototheca wickerhamii
VDSKLQKLVKGIQNDGLRSILEDVYARNAEQDEFLQAVRGMVVSIAPVFEKHPEYLTAFKLLTEPERAIIFRVPWVDDAGQWQMNRGMRVQFSSAIGPYKGGLRFHPSVTLSIIKFLGFEQIFKNALTTLPMGGGKGGSDFDPKGRSEAEIMRFCQSFMTELYRHIGSDVDVPAGDIGVGGREIGYMYGQYKRITRDRGGVLTGKGMGWGGSEI

SEQ ID NO: 43933 - protein, 375 aa, Azoarcus sp. BH72
MSKRDYYEVLGVNRDAGDDEIKKAYRKLAMKYHPDRNPDSKEAEEKFKEAKEAYEVLSDAQKKGAYDRYGHAGVDPSMGGGGGGQGFEGFADAFGDIFGDLFGGRGGGGGRSNVYRGADLRYNLEISLEEAARGAEKTIRIPTVEECGTCHGSGAKPGTQPKTCPTCGGAGQVRIQQGFFSIQQTCPKCHGTGRIIPDPCGDCGGAGRVKKQKTLEVKIPAGIDEGMRLRHSGHGEPGVNGGPPGDLYVEIHIRQHPVFERDHDDLHCEMPISFATAALGGEIEIPTLEGMARIKIPAETQSGKVFRLRGKGIKNVRSHTHGDLMCHVVVETPVNLTERQKELLREFEEVSKGDAERHNPKAKSWMDKVRDFFAT

SEQ ID NO: 43934 - protein, 533 aa, Desulfitobacterium hafniense DCB-2
MVIITSWKRFKEYLYYDQELELLLDISRMNFSAEFLTELAEPMRDAYHQLQLLEKGALANPDEGRMVGHYWLRNPDLAPTEEIAQDIKETLKEILDFAEQIHSGRLQGEKGNPFRNILLVGVGGSILGPRFVADALASSRDKMKAFFIDNGDPDGIDRVLSRIGEELPATLCLIISKSGGTIETRNGMLEVRRAYEEAGLSFPDHAVAITQRGSQLDKLSQKEGWLRAFPMWDWVGGRTSLLSAVGLLSLALQGIDVAGLLQGAKDCDGRTRRPDTLANPGALLALMWYYSTQGQGGKQMVVLPYKDRLELFTKYLQQLIMESLGKEKNLQGETVHQGITVYGNKGSSDQHSYLQQLLEGPDNFFVTFIEVLKDRQGSSAYMEENSTSGEYLQAFLLGTREALTQKGRESLTITVKEVNAYTIGVLIALFERAVSIYALLVGINAYHQPAVEMGKKAAGQAIQLKNNIVECLKKHPDKRFSVHEIALAIGEEAHQEMVFKLLLHLTTNPEHGVNMAAGHPLPESRFFVSGPIL

SEQ ID NO: 43935 - protein, 510 aa, Pseudomonas syringae pv. phaseolicola 1448A
MTATPKPLVLIILDGFGHSESHEGNAILAAKMPVMDRLYETMPNGLISGSGMDVGLPDGQMGNSEVGHMNLGAGRVVYQDFTRVTKAIRDGEFFENPTICAAVDKAVGAGKAVHIMGLLSDGGVHSHQGHLVAMAELAVKRGAEKIYLHAFLDGRDTPPRSAKKSLELMDATFARLGKGRTATIIGRYFAMDRDNRWDRVSTAYNLIVDSTAEFHADSGVAGLEAAYARDENDEFVKATRIGEPARVEDGDAVVFMNFRADRARELTRVFVEDDFKDFERARQPKVNYVMLTQYAASIPAPSAFAAGSLKNVLGEYLADNGKTQLRIAETEKYAHVTFFFSGGREEPFPGEERILIPSPKVATYDLQPEMSAPEVTDKIVDAIEHQRYDVIIVNYANGDMVGHSGIMEAAIKAVECLDVCVGRITAALEKVGGEALITADHGNVEQMTDDSTGQAHTAHTSEPVPFVYVGKRPLKVREGGVLADVAPTMLHLLGMEKPQEMTGHSILVAK

SEQ ID NO: 43936 - protein, 372 aa, Desulfitobacterium hafniense DCB-2
MTNAIGMIFGNLNSSALQGLDPNRPIGTVPFGGRYRLLDFALSSMVNSGIHTVGLITPQQYRPMLDHLGAGRDWSLDRKSGGLFFLPGVIHSLNHTVHFSLQDIAVNIDFLEKDCAKNIIISSSDQVFNLDFRPVLEEHEQAQADITLVYNQSVHPPEGSERIYLRMNAHKKVTAMSKSKEVAGLQSPWNYFIDILIIRRELLLQMLRGYGSIGTIELSEVIAHHLDIINVQGYFCGGYVGRIRSVQDYFLNNMALLQEEVRRDLFINTRPIRTKIRDNPPTKYGKQAQVKNSLISSGCTLEGKVENTILSRGVVIEEGCEVRNCIIMSKCVIGKHSVLENLIMDKFVEINEGSVLKGQPNKLMVIPKKAVI

SEQ ID NO: 43937 - protein, 398 aa, Desulfitobacterium hafniense DCB-2
MRKKECIAMLLAGGQGSRLGCLTRNIPKPAVSFAGKYRIIDFSLSNCSNSNIDTVGVLTQYKPFALNTYINMGSAWDLNCLNGGIHILPPFVGEAQGSWYKGTANAIYQNMDFINFYNPEYILILSGDHIYQMDYYEMLSCHKQKHAEVTLSAIAVPWEEASRFGVMVTDAGGRIIRFEEKPPRPESNLASMGVYIFNWDVLKEALLEDERDPQSDHDFGKNVLPRLLQQGRRLYSYLFHGYWRDVGTIESYYNANMEVLQEERVDKFFELKQRVFSNEEILAPQHLGERAKIHNSLIGNGCTILGEVRDSVIASGVYVGEGSLIEQSILLPNSEIYEDVRLHKTILGENAIVRAHCRIGDKREGNPPQEGITVIGDHLHIPEGTVISEGENVRKDTA

SEQ ID NO: 43938 - protein, 459 aa, Bradyrhizobium sp. BTAi1
MRTNSLQSKDIAHQIHPATNLRRHERVGPIVIDRGSGIYVYDDEGREYIEGLAGLWSVGVGFGEKRLVEAATRQMAKLPYYHIFAHKTHEPSTLLAEKLVSMAPANLKHVFFTSSGGEANDSAIKFVWYYNNALGRTDKKKFIARQGAYHGITIAAGSLTGLQANQRGFDLPLPFAKHLTCPHYYRFGLPGESEEAFTERLAKELEDLILSEGPDTVGAFIGEPLMGAGGVIVPPVNYWQRIQEVCRKYDVLVIADEVINGFGRLGTLFGCDTFGIRPDILVCSKQITSSYQPLAAVLISDEMYQAMADQSDRLGTFGHGYTASAHPVATAVALENLAIIEERNLVANAAEVGAHLHAGLSRFADHPLVGEVRGRGLIAAVELVADKATKARFDPVGKVGLKFFDRAHQHGLIIRNVGDSIAICPPMIITAAQVDELLKRFKATLDDITDWVNAGMPEA

SEQ ID NO: 43939 - protein, 1079 aa, Desulfitobacterium hafniense DCB-2
MPLNPAWKKVLVIGSGPIVIGQAAEFDYAGTQACKALREVGIEVILVNSNPATIMTDEQMADRIYLEPLLPQNLEGILAQERPDALLPTLGGQTGLNLAMKLQEEGILERYGVALIGCNAETIYKAEDREAFKETMLEIGEPLAESAIVTSLEEGLAFTARRGYPVIVRPAYTLGGTGGGFAKNEKELLEVLHRGLQASPIHQCLLERSVAGWKEIEYEVMRDAMDNCITVCNMENIDPVGIHTGDSIVVAPSQTLTDGEYQMLRSSSLKIIRALGVNGGCNVQFALDPESREYVVIEVNPRVSRSSALASKATGYPIAKMAALLAVGFTLPELRNPVTGHTSACFEPALDYVVVKFPRWPFDKFPAADNHLGTQMKATGEVMAIDRTLEGALLKAVRSLEIGAVGLRIADSGRWTEMEIEHKLAQADHERFFAIAEAFRRDWTILEVQMLTKIDPFFLNKLKELVLLERRLGSEPLTLELLRSAKSQGFSDQAIGRLRGVTQEEIRQERCRYGLKPVYKTVDTCAAEFYSSTPYYYSTYEEEDEVAVHSGPKVIVLGSGPIRIGQGIEFDYCSVHALWALQELGIESIMINNNPETVSTDFDTGDKLYFEPLTLEDVLHIIEKEEADGVLVQFGGQTAINLASPLQKAGVRILGSQVDAIDKAEDRERFAQLLLELGIPQSEGCAATSVSQARAIAGELGFPVLVRPSYVIGGRAMQVVEDLAELEGYLTRAITLSPEHPILVDRYLEGKEVEVDAIADGEITVIPGIMEHIERAGVHSGDSLAVYPTQSLTPAEIQQIQDYTCRIAKGMEVRGLLNIQFVVVNGKVYVIEVNPRASRTVPILSKVTGIPLVALAVRVAMGEKLADLGYAHGLAPEIPFVVVKAPVFSFEKLTQVETSLGPEMKSTGEVLGMDVNFGHALAKAFAASHVPLPDKGDILVAVAEKDRPEAIAMTRELSRLGFGVKATGNTAKALLFCGVPLEEVREASTELKEAVRRQEFSFVLSTPSKGDSEERTGYLLRRLAAEHRVPCLTSMDTAQAVVRALKEIRNHTAPQTLPLQAYLAMKRSTVERSTPIPNA

SEQ ID NO: 43940 - protein, 220 aa, Xanthomonas campestris pv. vesicatoria str. 85-10
MNELNHLLENNRAWSERIRREDPEFFSKLSTQQTPEYLWIGCSDSRVPANQIIDMAPGEVFVHRNIANVVVHTDLNCLSVIQFAVDVLKVKHVLVVGHYGCGGVFASLTQKRMGLVDNWIRHVTDVADKHEACLHNAGELSVQHARLCELNVLEQVVNVCRTTIVHDAWERGQQLSVHGWVYSLRDGRAHDLGMSIDRPELLQERYDAALAQIQADRAER

SEQ ID NO: 43941 - protein, 379 aa, Campylobacter jejuni
MEISYYEILEITQNADKETIKKAYRKMALKYHPDRNQGDKEAEDKFKLVNEAYEVLTNDEKRAIYDRYGKDALKGGGFGSSSSGFAGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNETKDSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRIGNQIVQISIKFPTFLNDEQKELLEKLSEVLVSKMVCIKTKKDFLKKSLIGLSLNFPKAF

SEQ ID NO: 43942 - protein, 307 aa, Solanum virginianum
MGSKHSKETTSTSHRVPFVDLQEATNNFDDNFLIGEGGFGKVYRGVWRDGTKVALKRYNPKSGQGIAQFRTEIKMLSQLRHPYLVSLIGYCDENNEMTLIYEYMENGNLRKHLYGSDLPTLSWEQRLEICIGAAKGLHYLHTTAVIHCDVKCTNILLAENFVAKVADFGLSKKGTVLDETHTTTMMKGTFGYLDPEYYRTLRLTEKSDVYSFGVVLLDVLCARPAVASSSSKGIINLAEWAMKWKKKGQLERIIDPNLVGKIIPDSLRKFGETAEKCLAESGVDRTSMNTVLWNLEYALHLQEPVIQ

SEQ ID NO: 43943 - protein, 513 aa, Apium graveolens var. dulce
MITGEVSVDSYDTNKPKPKRNKYAFACALLASMNSILLGYDTGVLSGASIYIKEDLHFSDVQIEIIIGIINIYSLLGSAIAGRTSDWIGRRYTMVLAGIIFFLGAIFMGLATNFAFLMFGRFVAGIGVGYAMMIAPVYTAEVAPSSSRGFLTSFPEVFINSGVLLGYVSNFAFAKCPLWLGWRIMLGIGAFPSVALAIIVLYMPESPRWLVMQGRLGEARTVLEKTSTSKEEAHQRLSDIKEAAGIDKDCNDDVVQVPKRTKDEAVWKELILHPTKPVRHAAITGIGIHFFQQACGIDAVVLYSPRIFEKAGIKSNSKKLLATIAVGVCKTVFILISTFQLDKIGRRPLMLTSMGGMVIALFVLAGSLTVINKSHHTGHWAGGLAIFTVYAFVSIFSSGMGPIAWVYSSEVFPLRLRAQGCSIGVAVNRGMSGIIGMTFISMYKAMTIGGAFLLFAVVASIGWVFMYTMFPETQGRNLEEIELLFGSYFGWRKTLKDLKAKEAAEAKSRESEV

SEQ ID NO: 43944 - protein, 376 aa, Antirrhinum hispanicum
MMDGRFPRQDVTSEILLFSSVKSLLRFRLVSKSWCSLIKSHDFIDNHLLRRQTNGNVMVVKRYVRTPERDMFSFYDINSPELDELLPDLPNPYFKNIKFDYDYFYLPQRVNLMGPCNGLVCLAYGDCVLLSNPALREIKRLPPTPFANPEGHCTDIIGYGFGNTCNDCYKVVLIESVGPEDHHINIYVYYSDTNSWKHIEDDSTPIKYICHFPCNELFFKGAFHWNANSTDIFYADFILTFDIITEVFKEMAYPHCLAQFSNSFLSLMSLNECLAMVRYKEWMEEPELFDIWVMNQYGVRESWTKQYVIGPQVVVCSHVCWKNDECLIVEDGNGQLVSCAFRTNEIKKLPIYAVEETLRVLIVDESLISLNRVLNF

SEQ ID NO: 43945 - protein, 132 aa, Brassica napus
MTTSFRSPAGAATVFSSDQKILNALRSSRSVFLGRNVRGGVHSLPPSSSSSSSIQAVSTPEAAAKATTKRSKVEIIKEKSNFIRYPLNEELLTEAPNVNESAVQLIKFHGSYQQYNREERGGRSYSFMLRTK

SEQ ID NO: 43946 - protein, 376 aa, Antirrhinum hispanicum
MMDGRFPRQDVTSEILLFSSVKSLLRFRLVSKSWCSLIKSNDFIDNHLLRRQTNGNVMVVKRYVRTPERDMFSFYNINSPELDELLPDLPNPYFKNIKFDYDYFYLPQRVNLMGPCNGLICLAYGDCVLLSNPALREIKRLPPTPFANPEGHCTDIIGYGFGNTCNDCYKVVLIESVGPEDHHINIYVYYSDTNSWKHIEDDSTPIKYICHFPCNELFFKGAFHWNANSTDIFYADFILTFDIITEVFKEMAYPHCLAQFSNSFLSLMSLNECLAMVRYKEWMEEPELFDIWVMKQYGVRESWTKQYVIGPQVVVCSHVCWKSDECLIVEDGNGQLVSCAFRTNEIKKLPIYAVEETLRVLIVDESLISLNRVLNF

SEQ ID NO: 43947 - protein, 267 aa, Salvia miltiorrhiza
TRESLSLVFNSSSRFGRLQKIKCAIAGKNLYMRFTCSTGDAMGMNMVSKGVQNVLDFLVNQFPDMDVLGISGNYCSDKKPAAVNWIEGRGKSVVCEAVIKEEVVHKVLKTNVAALVELNMLKNLTGSAIAGALGGFNAHASNIVSAVYIATGQDPAQNVESSHCITMMEAVNGGKDLHVSVSMPSIEVGTVGGGTQLASQSACLNLLGVKGASKEVPGANSRLLATIVAASVLAGELSLMSAIAAGQLVKSHMKYNRSSKDVTKLST

SEQ ID NO: 43948 - protein, 344 aa, Zea mays
MSPELTGKMAAKAAAAAAAVKPATRAYVTFLAGNGDYWKGVVGLAKGLRKVGSAYPLVVALLPDVPESHRRILVSQGCILREIEPVYPPENQTQFAMAYYVINYSKLRIWEFVEYEKMVYLDADIQVFENIDELFELEKGYFYAVMDCFCEKTWSHTPQYKIGYCQQCPDKVTWPTTELGPPPPLYFNAGMFAHEPSMATAKALLDTLRVTPPTPFAEQDFLNMFFRDQYRPIPNVYNLVLPMLWRHPENVQLEKVKVVHYCAAGSKPWRFTGKEANMDREDIKSLVNKWWDIYNDESLDFKGLPLSPADADADDEVEAVAKKPLRAALAEAGTVKYVTAPSAA

SEQ ID NO: 43949 - protein, 150 aa, Zea mays
MATPARKRLMWDFKRLQKDPPLGISGAPQDNNIMHWNALIFGPDDSPWDGGTFKLTLQFTEDYPNKPPVVRFVSRMFHPNIYADGSICLDILQNQWSPIYDVSAILTSIQSLLCDPNPNSPANSEAARLFSENKREYNRKVMEIVEQSYA

SEQ ID NO: 43950 - protein, 348 aa, Zea mays
MAPELMTAKMTANAAAAAAAAAAAKPATRAYVTFLAGDGDYWKGVVGLAKGLRKVRSAYPLVVAVLPDVPESHRRILVSQGCVVREIEPVYPPENQTQFAMAYYVINYSKLRIWEFVEYERMVYLDADIQVFENIDGLFELEKGYFYAVMAGFCEKTWSHTPQYRIGYCQQCPDKVAWPTRTAELGLPPSSYFNAGMFLKEPNLATAKGSPETLRLIPPTPFAKKDFLKMFFRDNYRPIPNVYNLVLAMLWRHPENVQLEKVKVVHYCAAGSKPWRFTGKEANMDREDINALVKKWWDIYNDETLDLKGCLASRPTTTTRWRRCPRSRFARPWRRPARSKYVTAPSAA

SEQ ID NO: 43951 - protein, 745 aa, Pseudomonas syringae pv. phaseolicola 1448A
MSQLDKDAFEVLLANCADEPIQFPGAIQPHGLLFTLEEPNLTILQVSANVQSVLGHAPEHVLGKGLDHVLGAGWAEVIRSASAHDSFVDAQRLLMTVNGIEFEALMHRNQGVLVLELEIQDKDAQAVSYTERTGNMGRMLRQLHAASDLQTLYEVSVREIQRMTGYDRVLIYRFEEEGHGQVIAEASAPSMELFNGLFFPASDIPEQARELYRRNWLRIIPDADYTPVPLVPQLRPDTQQQLDLSFSTLRSVSPIHCQYMKNMGVLSSMSVSLIQGGKLWGLISCGHRTPLYVSHELRSACQAIGQVLSLQISAMEALEISRQREAKVRALEQLHQAMAESEENVFDGLAQQPQLLMDLVGATGVAIIEDRQTHCYGACPEVSDIRALHTWMIAGGEPVYASHHLSSVYAPGEAYQPVASGVLAMNLPKPVDNGVIWFRSEVKESVQWSGDPNKPLNMESSEGGMRLRPRTSFEIWKVEMTGIAPKWSHGDVFAANDLRRSALENDLASQVRKEQQAVRARDELVAVVSHDLRNPMTVISMLCGMMQKSFSSDGPHTSRRISTAIDTMQQAASRMNVLLEDLLDTSKIEAGRYTITPQPLEVSQIFEEAYTLLAPLAMDKSIEISFNAEPDLKVQADPERLFQVLSNLIGNAIKFTPKLGKIGVAAMSNGTEIVFTVRDSGEGIPPEQLPHIFERYWTVKEGNPTGTGLGLYISQGIIKAHGGELGAQSQLGEGSEFRFTVPIAV

SEQ ID NO: 43952 - protein, 372 aa, Arabidopsis thaliana
MSSPERKRKKRSLEPSPESTPNPSLPDDLIVSILARVSRLYYPILSLVSKSSRTLVTSPELYKTRSFFNRTESCLYVCLDFPPDPNPRWFTLYRKPNQNITEKTKNSSGFVLAPIPNHHSHSSSIVAIGSNIYAIGGSIENAPSSKVSILDCRSHTWHEAPSMRMKRNYPAANVVDGKIYVAGGLEEFDSSKWMEVFDIKTQTWEFVLSPLAERFIYRSLVIEGEIYIFGDKVVTYKPKEDRWGGVGEHQSMDLGLFFHSYCVIDNVLYCYRPGGIKWYESEKRSWRKLRGLKGLSKLASSCVKLADYGGKMALLWDKYIPCSGNKSHSISCAVVSLERCKNQGIRGKVEWFDDMLTVPSSYNFVGALAATL

SEQ ID NO: 43953 - protein, 472 aa, Blastopirellula marina DSM 3645
MATEVKLPELGDGIDSGDILSVYVSEGDVVTKNQNILELETDKATVEIPTNVAGKVTKVHVKTGDAVPIGGALISVEASEGAAKEESKPAPAPKKEAEAPKAEAKKAEPAPKAEAPKAEPPKPAPAAAKPAPTPEPAVTYAAPVARAATSSADLIYQEEDDVPAGPAIRRFAREVGVDLRRVRGTGNNGRVTRDDVLATVRELSQGGAPTLTAVAPAKADKPTTTPAVTPPGEQGEDAYGPVRIEKMAKIRKTIANQMVMSWTTAPRVTNFDDADVTALEALRQQSKDDYASAGVKLTSMSFLVKAVALALRNNPAINALIDMENNQVVYKEYVNVGIAVDSERGLVVPNIRNADRLAIPEIARDVQKLAADVRGGTFSMDQIRGGTFTISNLGAIGGTYSTPIINVPEVAILLVGRSRKLPVVVNDQIVPRMMMPLSLSYDHRLVDGATAARFLNEIKSYLEAPSRLLLAP

SEQ ID NO: 43954 - protein, 138 aa, Triticum aestivum
  misc_feature (21)..(21): Xaa can be any naturally occurring amino acid
  misc_feature (80)..(80): Xaa can be any naturally occurring amino acid
  misc_feature (99)..(99): Xaa can be any naturally occurring amino acid
  misc_feature (102)..(102): Xaa can be any naturally occurring amino acid
  misc_feature (110)..(110): Xaa can be any naturally occurring amino acid
  unsure (1)..(138): unsure at all Xaa locations
MAPAVMASSATTAAPFQGLKXTAGLPVSRRSCSAGLSSVSNGGRIRCMQVWPIEGIKKFETLSYLPPLSTEALLKQVDYXIRSKWVPCLEFSKVGFRLXREXNSSPRVLXTVRYWDKCGNCPIVRGCTDAKGCGWREV

SEQ ID NO: 43955 - protein, 905 aa, Blastopirellula marina DSM 3645
MAEAKLMPAEENILRHNPAAHSQDIDPNETKEWLDSLDYIIESKGGERVRYLLSALENRAHSRGVDLPFAANTPYINTIHVNQQPAYPGNREFERRIKSVIRWNAMAMVTRANRDFSGLGGHISSYASAATLYEVAFNHFFRGRSSGYEGDQVYFQGHASPGIYARAFVEGRLSEKNLENFRRELQEEKGLSSYPHPWLMPDFWEFPTVSMGLGPICSIYQARFNRYMQDRGIKKTEGTRVWAFLGDGECDEPETLGAISLAAREGLNNLTWVINCNLQRLDGPVRGNGKIIQELEAVFRGAGWNVVKVIWGSDWDPLLEADQSGLLVKRMEEVVDGQYQKYVVMPGAYIREHFFGKYPELLELVKNYSDERLEKMVRGGHDPEKVYSAYKAAVECTTKPTVILAKTVKGYGLGEAGEGRNVTHNQKKLNEKELAEFRTRFSIPISDEEVVKAPFYRPPEGSAEMKYLVKRREALGGFMPTRPTTCPQMDVPSLDDYQEFLGDSGGKELSTTMGFVRLLSKLVKDKNIGKNIVPIVPDESRTFGMEGMFRQIGIYAHGGQLYEPVDSDQLMYYKEAKDGQILEEGITEAGSMSSFIAAGNSYCQHGINMVPFFIYYSMFGFQRVGDLIWAAADTRAKGFMLGGTAGRTTLNGEGLQHQDGHSHLNAIAFPTVRSFDPAFAYETTVLIFDGMKKMYVDGETAIYYITVGNENYQMPAMPAGAEEGIVRGIYKFNSLDSAKGKTRVQLFGSGPILRCVLDAQQILADKYNISSDVWSVTSYTELRRDAHACQRWNMLHPLETPRKSYLEEVMEGVQGPFIASSDNVRALPEQIRDYLPGALFALGTDGMGRSETREALRRHFEIDSASVVIATLYQLFREGKVDAKKVAKAIKDLDYNPEKVDPYFA

SEQ ID NO: 43956 - protein, 311 aa, Archaeoglobus fulgidus DSM 4304
MLDMPIDPVYYQLAEYFDSLPKFDQFSSAREYREAINRIYEERNRQLSQHERVERVEDRTIKGRNGDIRVRVYQQKPDSPVLVYYHGGGFVICSIESHDALCRRIARLSNSTVVSVDYRLAPEHKFPAAVYDCYDATKWVAENAEELRIDPSKIFVGGDSAGGNLAAAVSIMARDSGEDFIKHQILIYPVVNFVAPTPSLLEFGEGLWILDQKIMSWFSEQYFSREEDKFNPLASVIFADLENLPPALIITAEYDPLRDEGEVFGQMLRRAGVEASIVRYRGVLHGFINYYPVLKAARDAINQIAALLVFD

SEQ ID NO: 43957 - protein, 91 aa, Brassica napus
RPELNMYLDLHPFSNASPYTVLETMSLAKAVVLFREVGLRHILVIPKLSNRPPLVGILTRHDFMPEHILGLRPSLSRSRWKRLRIRLPFLS

SEQ ID NO: 43958 - protein, 348 aa, Coccidioides immitis RS
MATENKALFYQKVPTEFPVPGEHLTIEKVPFDPEAPAPDGGLTLQALYTSFDPYMRGGMRPAQVKSYRPAYEIGKPLPSISIVKVLKSNNDRFKPGDIAIGFMPIQQYIAAPAETVQALRLLDNPLGLDDLRYFLGALGMPGLTAYSSLMEIGKPKKGETIFISSAAGAVGQVVGQIAKHEGLRVVGSVGSDEKLNYIINDLGFDAGFNYKKEKPRDALKRLIPEGIDIYYENVGGEHLDAAIESMNDFGRIVTCGMISQYNVKPEDRYPIKNLFMVVTKRITMRGFIVSDPGMGDKWAKEHRERVSQWIKDGTFKPMIHETVGIDNAAEGLVGLFQGKNFGKAVLKL

SEQ ID NO: 43959 - protein, 250 aa, Brassica napus
  misc_feature (222)..(222): Xaa can be any naturally occurring amino acid
  unsure (1)..(250): unsure at all Xaa locations
MASHDHDHHHHDHEQGHKKPEGGGGDTSWVGPDGRVYHSHDGLAPHSHEPIYSPGYFSRRAPPLNDRNFSERAFTVGIGGPVGTGKTALMLALCRVLRDKYSLAAVTNDIFTKEDGEFLVKHGALPEERIRAVVTGGCPHAAIREDISINLGPLEELSNLFKTDLLLCESGGDNLAANFSRELADYIIYIIDVSAGDKIPRKGGPGITQADLLVINKTDKSXPTAAAKSVFLEKKNNHRLPRCCSSMKAL

SEQ ID NO: 43960 - protein, 432 aa, Bradyrhizobium sp. BTAi1
MSSSLHAVACERGIKYFLISYTDLFGVQRAKLVPAAAIDGMVKTGAGFAGFATWLDMTPADPDVFAMPDPASLIQLPWKPEVGWLAADPWMNGKPVAHAPRNLLKRMVADAAAQGYELKSGVECEFFLITADGSAPSDVADKQSKPCYDQQALMRRYEVIAEICDAMLALGWKPYQNDHEDANGQFEMNWEFDTALTTADRHAFFKYMVRSIAEKHGLRATFMPKPFVDLTGNGCHAHVSVWKDGRNLFEDEAGELGVSELGYQFLGGIMHSADALAALFNPTVNSYKRINAARTTSGATWAPNSVTYSGNNRTHLIRIPEAGRFEVRLADGAANPYLLQAGLLAAGLDGIANDRDPGPRLDINMYTDGHAVKTGKKLPLNLLDAIRALQASPVMAEKLGDFIPCYVKLKTEEWNAYARHLTEWERETTLDC

SEQ ID NO: 43961 - protein, 469 aa, Zea mays
  misc_feature (454)..(454): Xaa can be any naturally occurring amino acid
  unsure (1)..(469): unsure at all Xaa locations
MAARAADENRRPGVGRPAPCVRDMGSRRALTDIKNLVGVAPNPCAVAKKPVLQYSPAPRSFLCHGSWVQEEQKGRKEDSVAKQPADDKVRTRASCSCALAFLGGFDLIWVLLWLLRKFVASLASKGQPECQPTGADPEPGVDQRKEPIGDGIIDIDVELDEPVDDSDCDVDMGDETENKDIMNQDESLMDIDSADSGNPLAATEYVEELYKFYRENEAKSCVRPDYMSSQQDINSKMRAILIDWLIEVHYKFELMDETLFLMVNIIDRFLEKEVVPRKKLQLVGVTAMLLACKYEEVSVPVVEDLVLISDRAYTKGQILEMEKLILNTLQFNMSVPTPYVFMKRFLKAADADKQLELVSFFMLELCLVEYQMLNYRPSHLAAAAVYTAQCAINRCQQWTKVCESHSRYTGDQLLECSRMMVDFHQKAGTGKLTGVHRKYSTYKFGCVAKILPAXFLLESGGTPPPSGAN

SEQ ID NO: 43962 - protein, 376 aa, Antirrhinum hispanicum
MMDGRFPRQDVISEILLFSSVKSLLRFRCVSKSWCSLIKSNDFIDNHLLRRQTNGNVMVVKRYVRTPERDMFSFYNINSPKLEELLPDLPNPYFKNIKFDYDYFYLPQRVNLMGPCNGLICLAYGDCVLLSNPALREIKRLPPTPFANPEGHCTDIIGYGFGNTCNDCYKVVLIESVGPEDHHINIYVYYSDTNSWKHIEDDSTPIKYICHFPCNELFFKGAFHWNANSTDIFYADFILTFDIITEVFKEMAYPHCLAQFSNSFLSLMSLNECLAMVRYKEWMEEPELFDIWVMNQYGVRESWTKQYVIGPQVVVCSHVCWKNDECLIVEDGNGQLVSCAFRTNEIKKLPIYAVEETLRVLIVDESLISLNRVLNF

SEQ ID NO: 43963 - protein, 404 aa, Antirrhinum hispanicum
MKNLCQSTSSGEKMSDDQLQSKDVFIQILVQLSVRALMRFRCISKSWCALIKSSTFHLLRDRKYDNVLLVRRYLPPPEDEDCFSFYDLNSLEVKQVLPNLSIPLLKDLRFKYDHPYCPEAAYLLGPDSGLICIACIGNYYLCNPALREFKQLPPCPFVCPKGFSNEIFAEGFGCTCTNDFKIVLIRRVTLYDDYDPDLYIMVHLYTSNTNLWRTFAGDVISVKNLCNYACSELLFNGVCHWNANSTGFSSPDTILTFNIRTEVFGQLEFIPDWEEEVYGYCVSLIAIDNCLGMVRYEGWLEEPQLIDIWVMNEYGVGESWTKSFVIGPYEVICPFMFWNNDEWLLVESTEGQLVACALHTNEARRLQICGVERTLRSVIYKESLISLNQVRAQFFFQIKISYKL

SEQ ID NO: 43964 - protein, 393 aa, Ehrlichia chaffeensis str. Arkansas
MSDRVKITPMTLNFGPQHPAAHGVMRLVLEMGGEVIERIDPHIGLLHRGTEKLIEYKTYLQALPYFDRLDYVSPMCQEHAYSLCVEKLLKCEIPIRAKYLRVIFCELTRILNHLLNISSQALDIGAMTPLLWMFEEREKILGFYERASGARFHSAYIRPGGVAADVPDDLIDDIFKFIKTFPKFIDDVDELLTENRIWKQRNVDIGIVSKEQALDWGFSGPMLRACGIPWDLRKSQPYEIYEDLEFEIPIGKKGDCYDRYLVRMAEIRQSIKLLEQCLNRLPNGPIKTDDRKIAPPKRSEMKESMEALIHHFKLYSEGYSVPIGETYMAVEAPKGEFGVYIVSDGTNKPYRCRIRAPGFAHLQAIDMMAKGHMLADLTAIIGSLDIVFGEIDR

SEQ ID NO: 43965 - protein, 538 aa, Oryza sativa (japonica cultivar-group)
MATVSPARREPTPQAVRASPMPSAAAALVRRGGGGSGGTVLGKYELGRVLGQGSFAKVYQARHLETDECVAIKVLDKEKAVKGGMVHLVKREINVLRRVRHPNIVQLFEVMASKTKIYFVMEYVRGGELFSRVSKGRLREDTARRYFQQLVSAVDFCHARGVFHRDLKPENLLVDENGDLKVSDFGLAAGPDQFDPDGLLHTFCGTPAYVAPEVLRRRGYDGAKADIWSCGVILFALMAGYLPFHDHNIMVLYRKIYNGEFRCPRWFSKDFTRLITRLLDANPKTRITVPEIIESDWFKKGYKPVKFYIEDDKLYNLSDDVLNLEPADPVPPPLGLAPPVPPPPQGDDPDGSGSESDSSVVSCPATLSTGESQRVRGSLPRPASLNAFDIISFSKGFNLSGLFEERGNEIRFVSGEPMSDIVKKLEEIAKVKSFTVRRKDWRVSIEGTREGVKGPLTIGAEIFELTPSLVVVEVKRKAGDNEEYEDFCNMELKPGMQHLVHQMLPAPNGTPVSEKVERSSSLQAPLTLKLIGTEGSMS

SEQ ID NO: 43966 - protein, 810 aa, Thermoproteus tenax
MGLILWLEEITKKDHALVGGKGANLGEVSRLVRVPPGFVVTTEAFRAFLETTGLKSKISEVLKSVRGGSPEDYEKASETIREMIYREPMPREIADEIVRAYLKLSEKVGVKDVSVAVRSSATAEDIQEASFAGQQDTYLNVRGSENVIEHVKRVWASLYTARAIYYREQMGISHDNVSIAVVVQKLVNARSAGVMFTLDPTNGDTSKVVIEAAWGLGEGVVRGIVTPDEYVVDKNTLKIVERRISQKRLAVVRDERGLTKEVELPPEKSGAPALTDEEVIEYAKMALELERHYGHPLDIEFSVDSDVPFPQNLYVVQVRPETVWSRRAQPAEAKEAKAEGRVVVKGIAASPGVAVGRAKICLTLEDAKRKLQKGDILVTKMTDPDWVPYMRLASAIVTDEGGRTSHAAIVSRELGIPAVVGTGNATQVLRDGELYTVDGSKGVVLEGAAVQPQAKVAEAAQAAIAVPKEIILHIYRSIPTGTKVYMNLGEPDKIDEYKDLPFEGIGLMRIEFVITSWIGEHPLYLMSIGREDKFVDKMAEGVARVASAIYPRPVVVRFSDFKTNEYRSLQGGEKFEPEERNPMLGWRGVSRYVSLQYEKAFRLELRAIKKVREEMGLTNVWVMAPFVRTTWEAERFNRLLEEEGLVRDRDFKVWAMAEVPSVAFLVEEFAPYFDGFSIGSNDLTQLTLGVDRDNDFLVRINPKYFDEREMPVLKAIYELIQRAHRVGKTVSICGQGPSVYPQLVEFLVRAGIDSISVNPDAVLNTRILVASVEMKLLRERLDAIYRALYKVGDDEEFREIIKKVFGGLKY

SEQ ID NO: 43967 - protein, 345 aa, Zea mays
MAPELMTAKMTAKAAAAAAAVKPATRAYVTFLAGDGDYWKGVVGLAKGLRKVRSAYPLVVAVLPDVPESHRRILVSQGCVVREIEPVYPPENQTQFAMAYYVINYSKLRIWEFVEYERMVYLDADIQVFENIDGLFELEKGYFYAVMDCFCEKTWSHTPQYRIGYCQQCPDKVAWPAATAELGPPPSLYFNAGMFVHEPSVATAKALLDTLRVTPPTPFAEQDFLNMFFRDQYRPIPNVYNLVLAMLWRHPENVQLEKVKVVHYCAAGSKPWRFTGKEANMDREDINALVNKWWDIYNDETLDLKGLPSLSPDDDDEVEAVAKKPLRAALAEAGTVKYVTAPSAA

SEQ ID NO: 43968 - protein, 302 aa, Thermoproteus tenax
IHPREAAEHHAKVAVILLKKALEIAGRSPRDIDAVAYSAGPGLGPALRMGAVLARSLAVKYRRPLVPVHHGIAHIEIARYSTRSCDPLVLLISGGHTVIAGFADGRYRVFGETLDLAIGNAIDKFAREVGLGYPGVPAVEKCAERAERVLPLPMNIIGQDLAFSGLVTQAIYLYKNGRADLPTLCKSVIENSYYMLAEVVERALAYTMKRELVVAGGVARSPRLGSILRAIAEDRGVSLKIVPPEYAGDNGAMIALAGYYAFKRGLFVNVERSFVKQRWRLDQVDVPWFNDLCYSDSSSRAN

SEQ ID NO: 43969 - protein, 605 aa, Bacillus cereus ATCC 10987
MIFHRGPDDEGYFRDEHVQFGFRRLSIIDLEAGHQPLTYENDRYVIIFNGEIYNYVELREMLLEKGATFATQSDTEVIIALYAHMKEKCVDYLRGMFAFMIWDREEKKLFGARDHFGIKPLYIAQQGDTTFFASEKKSIMHVMEDKGVNPTSLQHYFTYQYGPEPETLTIDVNKIEPGHYFVKEIGKEMEIHRYWKPYFNASSATKEEHIQAIRDVLYDSVKVHMRSDVPVGSFLSGGIDSSIIASIAREMNPNLLTFSVGFEQRGFSEVDVAKETAEKLGVKNHNVFISAKEFMDEFPKIIWHMDDPLADPAAVPLYFVAKEARKHVTVVLSGEGADELFGGYNIYREPNSLKMFSYIPSPGKSVLKALSGALKEGFKGKSFLERGCTPIEERYYGNAKIFREEEKAELMKYYNESVNYMDITKPLYNEIKDYDDVSKMQYIDMFTWLRGDILLKADKMTMANSLELRVPFLDKEVFDVASKIPTEFKIANGTTKAILREAARGIVPDHVLDRKKLGFPVPIRHWLKDEMHDWAINIINESKTEHLIDKQYVLNLLEAHCADKGDYSRKIWTVLAFMVWHQIYVEHKYDTNKFHEETKRAYSLV

SEQ ID NO: 43970 - protein, 915 aa, Thermoproteus tenax
MPKKYVFDFDEADYRNKRLFGGKGASLVQMAQLGLRVPPGFIITTEACKDFFGPKREEIAELEAQLARQPPPDVRDALITKLFSIIDSLDLPQGLWEEVVEHMKRLEDRTGRRFGDPKNPLLVSVRSGAAVSMPGMMDTVLNLGLNDETVKGLAEQTNNEWFAYDAYRRFINMFGRIVLNIDDKLFSKAWDDIKRKYGVKEDPQMPIEGLKEAVEIFKKIVAESRGAFPQDPWEQLKLAIKAVFRSWDSPRAIFYRIAEKITSDIADCTAVNVVTMVFGNMGWDSGTGVVFSRDVATGENRLYGEFLPVAQGEDVVAGIRTPMDIDEFKKRFPHLYEELYNGVKLLEKVNKDVQDVEFTVERGRLYFLQCRNAKMTPMARVKTAVDMAKEGIITKDEALMKVSPEHVLQLLYPRIDPKANARPIAKGLPASPGAVSGQLVFNPDDAVKWARDGKKVVLARVETKPDDVHGFYAAVGILTTRGGMTSHAAVVARAIGKPAVVGAEDAVVDEQNKVLRAGGLILKEGDWVTIDGNTGLVYPGVVPTLEPELIPELEELLRWADEVRRLGVRANADLPEDAAIARKFGAEGIGLLRIERMFRKPERLDLLRRIILAENREERIKHLEQLYRMLKEDFKAIFEIMDGLPVVVRLIDPPLHEFLPKPEEVLQQICEGRMSGKDVSSLERLYNRLKALQEANPMLGHRGVRVGVSYPEVYYYLTKAIAEAASELKKEGRNPVVEIMIPQVSDVREIKYVKEKGIMPALRDVEESSGVKLDIKIGTMIETVRAALTVEKIAREVDFISFGTNDLTQAVFSFSRDDAENKFIPQYLDLKILDADPFETLDPEGVAKLVEQASRSAKEANPAIEVGVCGEHGGEPKSISLFSRMKIDYVSASPFRVPLARLAAAQAAIASSKRE

SEQ ID NO: 43971 - protein, 569 aa, Ustilago maydis 521
MQVKLSSSSLVSESVLGKLAATAHSHRPTTFIGYVALAIGTVVLLLGLLITYSLAKMLYRTTIYHYYISPLRHLPGPDPKPFLGNVEEFAKKPGAGAELDWSRKYNKDGVYRSTFLFGREAIHFHRPKALRQILVEDPYTYPKPALAWKLLGLIAGYGLLTVEGDTHRKMRKTMNPAFSLTNLIEQFPVYYAKIYPLVDVLNQKVEESPEESAVIDCDAWVNKALLDIICLTAFGYDADSVNNPSNELASAYHAVTSMQNGRNQARLNLLLNLPFGDTVLDWASDTSGWDWFLKRCKPGTAWQTFFQLLNGMHRIKNVSKEILYKQLNSGERAAQGGQFKAIIDIIEESYLTENDGKPKSLKQAERDMITQVLTFLGAGHETTASGVSWTLWNLATHQDIQDKLRKECKGLMDQDDRPPYSAIKGLAYLDAVINESMRITPPVPRTIRMASKASYIDGIYIPKNTLLPISNRAINMDPTVWGEDADEFKPERWFNLPDKYDRTFSMITFIAGAHACIGRTMSYLEMKAVICILVSNFKFEPVSKDQSPIMDTLITMKPQGGLELRVSKV

SEQ ID NO: 43972 - protein, 456 aa, Archaeoglobus fulgidus DSM 4304
MYRVKTFKYYSTYKICMIEEVFELTQNGRAKKWHAFYGGKIEILPKVPIRTLDDFSIWYTPGVAEVCNEIAEDEEKAYDYTNKWNLIAIITDGSRTLGLGNIGPKAAMPVMEGKALLFKFLGAVDAFPIALAEQDADRFIEIVKAISPTFGGVNLEDISSPKCFYILERLQKELDIPVWHDDQQGTATATLAALINALKIVGKDISEVKISIIGVGAANFATIRLLKAAGADPKKMFVVDSKGILHPDRADLKEKKGYKWQVAIETNGERRTGGMEEAIRGTDVLIAASKPGPDVIKKEWIAEMNDDAIVFPLANPTPEIWPWEAKDAGARIVGTGRSDFPNQVNNSLVFPGVFRGALTVRARKITDEMCLAAANALAEFAERNGLSEDYIIPRMTEKEVFPEVATAVGVKAVELGLARLELREEEIYEIAELMISATQRKIKKLYELGFIKEPPS

SEQ ID NO: 43973 - protein, 311 aa, Coccidioides immitis RS
MAFGGSRGGRGGPPRGGRGGPRGGGRGGARGGLGSRGGRGGGRGAPRGGRGGRGGRGGGRGGKPGAKGGAKVIIEPHRHAGVFVARGGKEDLLVTKNLTPGEAVYGEKRISVEAPATVDGDNTTTKVEYRVWNPFRSKLAAGILGGLDEIYIKPGAKVLYLGAASGTSVSHVADIVGPTGTVYAVEFSHRSGRDLIGMATHRTNVIPIVDDARHPLRYRMLVGMVDAIFADVAQPDQARIVGLNAHLFLKAGGGILVSIKANCIDSTAKPEVVFAREVQKLREERIKPKEQLTLEPFERDHCIVVGVYRPS

SEQ ID NO: 43974 - protein, 116 aa, Blastopirellula marina DSM 3645
MSQDLMNKVEAAYKKPEVDQFEIGDTVEVHTKILEGNKERIQVYSGTVIARSGSGTREMFTVRRIVGGEGVEKKFPLHSPKVDKVVSTRKSVVRRAKLYYLRDRVGKATRLTERRV

SEQ ID NO: 43975 - protein, 667 aa, delta proteobacterium MLMS-1
MAPTRKDLANAIRALSMDAIQQANSGHPGAPLGMADIAQVLWNDFLKHNPANPSWPDRDRFVFSNGHGSMLLYSVLHLTGYQLTIEDLKNFRQLHSPTPGHPEYGYTPGVETTSGPLGQGIANAVGMAIAERTLAAQFNHPGHAIIDHHTYVFLGDGCLMEGISHEACSLAGTLGLNKLIAIYDDNGISIDGEVGGWFTEDIPGRFEAYGWRVIPAVDGHDPEAVKQAIEQARAEEQRPTLICCKTIIGCCSPNKQGKEICHGAPLGDEEIELTRKEMNWPHPPFVIPEEIAAAWNARQRGNQAEAAWRDRLAAYRQQFPAQAAELERRLAGELPANWPQQATDFIAASEEKAAKVASRKASQLTLEGYGPLLPELIGGSADLAGSNLTIWSGSRDIKQQADGNYIYFGVREFAMVAIGNGLALHGGFIPYTATFLIFSDYARNAIRMAALMKQRAIFVLTHDSIGLGEDGPTHQPIEQAASLRLIPNLHVWRPCDAVETAVAWKAGVERVDGPSALLLSRQGLPHQSRTAQQSADIARGGYVLLDCQGQPETILLATGSEVELAMAAARQLNEQGRKIRVVSLPCLELFAAQDEAYRQQVLPDSVEHRVAIEAGCTAGWYKYVGRRGQVIGLDRFGESAPAEQLFELFGFTVEKVVAAVVSVHQGQ

SEQ ID NO: 43976 - protein, 393 aa, Mycobacterium smegmatis str. MC2 155
MKAVTWHGRRDVRVDNVPDPKIEQPTDAIIEVTSTNICGSDLHLYEVLGAFMNEGDILGHEPMGIVREVGSAVDGLSVGDRVVIPFQISCGHCFMCDQKLYTQCETTQVREQGMGAALFGYSELYGSVPGGQAQYLRVPQAQFTHIKVPDGPPDSRYVYLSDVLPTAWQSVAYAEIPKGGTVTVLGLGPIGDMAARIAHHLGYEVFAVDRIPERLRRAADRGIQAIDLGAIDEPLGDVIRSMTHGRGTDAVIDAVGMEAHGSPVAKIMQTAAAALPDAVAKPMMENAGVDRLDALYSAIDTVRRGGTISLIGVYGGTADPIPMLTLFDKQIQLRMGQANVKRWVDDIMPLLGDDDPLGVDDFATHILPIDEAPHAYEIFQKKQDGAVKIILKP

SEQ ID NO: 43977 - protein, 389 aa, Mycobacterium smegmatis str. MC2 155
MGEMNDRVALRAGVPPFYVMDVWQAAAERQRTHGDLVNLSAGQPSAGAPAPVRDAAAAALGRNQLGYTVALGIPELREQIAQTYHTRHDIDVGVDDVVLTTGSSGGFLLTFLACFDVGDRVAITSPGYPCYRNILSALGCEVVEIPCGPETRFQPTAAMLEALDPPVQGVIVASPANPTGTVIAPEELAAIARWCDASGARLVSDEIYHGLVYEGAPETTCAWETSRNAVVVNSFSKYFAMTGWRLGWLLVPEKLRRAVDCLTGNFTICPPALAQYAALAAFTPESLAEAEGLLTHYAENRHLLLNGLRGLGIDKLAPTDGAFYVYADVSKYTDNSLQFCEKLLNDTGVAIAPGIDFDTVRGNSYVRLSFAGPTHDIEEALRRIGPWLG

SEQ ID NO: 43978 - protein, 635 aa, Arabidopsis thaliana
MSLEAFVSTMAPLIDMEKEAEISMSLTSGASRNIETAQKKGTTILNLKCVDVQTGLMGKSLIEFQSNKGDALPAHKFGNHDVVVLKLNKSDLGSSPLAQGVVYRLKDSSITVVFDEVPEEGLNTSLRLEKLANEVTYRRMKDTLIQLSKGVLRGPASDLVPVLFGERQPSVSKKDVKSFTPFNKNLDQSQKDAITKALSSKDVFLLHGPPGTGKTTTVVEIVLQEVKRGSKILACAASNIAVDNIVERLVPHKVKLVRVGHPARLLPQVLDSALDAQVLKGDNSGLANDIRKEMKALNGKLLKAKDKNTRRLIQKELRTLGKEERKRQQLAVSDVIKNADVILTTLTGALTRKLDNRTFDLVIIDEGAQALEVACWIALLKGSRCILAGDHLQLPPTIQSAEAERKGLGRTLFERLADLYGDEIKSMLTVQYRMHELIMNWSSKELYDNKITAHSSVASHMLFDLENVTKSSSTEATLLLVDTAGCDMEEKKDEEESTYNEGEAEVAMAHAKRLMESGVQPSDIGIITPYAAQVMLLRILRGKEEKLKDMEISTVDGFQGREKEAIIISMVRSNSKKEVGFLKDQRRMNVAVTRSRRQCCIVCDTETVSSDAFLKRMIEYFEEHGEYLSASEYTN

SEQ ID NO: 43979 - protein, 386 aa, Enterobacter sakazakii
MSQTPLTPESKLPALGTTIFTRMSALAQQHQAINLSQGFPDFDGPRYLQERLAHHVAAGANQYAPMTGVQALREAIADKTEALYGHRPDANSDITVTAGATEALYAAITALVRPGDEVICFDPSYDSYAPAVALSGGVLKRIALTPPHFRVDWAQFAALLSERTRLVILNTPHNPSATVWRNADFAALWQAIAEREIYVLSDEVYEHICFAKEGHASVLAHPQLRERAIAVSSFGKTYHMTGWKVGYCVAPAALSAEVRKVHQYLTFSVNTPAQLALADMLRAEPAHYLDLPDFYRARRDRFIQALGDSRFKILPCEGTYFLLADYSAISTLDDVSFCEWLTTEAGVAAIPLSVFCDAPFPHKLIRLCFAKQEATLLAAAERLARL

SEQ ID NO: 43980 - protein, 261 aa, Mycobacterium smegmatis str. MC2 155
MARKPLIAGNWKMNLNHFEAIALVQKIAFALPDKYFDKVDVTVIPPFTDLRSVQTLVDGDKLRLTYGAQDLSQHDSGAYTGEISGAFLAKLGCTFVIVGHSERRTYHGETDELVAAKAKAAHKHGLTPIVCIGEQLEVREAGNHVEFNVNSLRGSLAGLTPEQIGQTVIAYEPVWAIGTGRVAGAADAQEVCKAIRGELANLSSSEIAAGVRVLYGGSVNAKNVGEIVSQGDVDGALVGGASLDGEQFATLSAIAAGGPLP

SEQ ID NO: 43981 - protein, 227 aa, Glycine soja
LGNNLPTPQEVVALYNQANIRRMRIYGPSPEVLEALRGSNIELLLDIPNDNLRNLASSQDNANKLVQDNIKNYANNVRFRYVSVGNEVKPEHSFAQFLVPALENIQRAISNAGLGNQVKVSTAIDTGALAESFPPSKGSFKSDYRGAYLDGVIRFLVNNNAPLMVNVYSYFAYTANPKDISLDYALFRSPSVVVQDGSLGYRNLFDASVDAVYAALEKAGGGSLNIV

SEQ ID NO: 43982 - protein, 255 aa, Nostoc punctiforme PCC 73102
MDWKEVRGNWVIIPRNPIGIIHFLGGAFVATAPHITYRWLLEQLASKGYVVIATPFVNTLDHTAIAKSVLLNFDRTLERLHDSGALRKLYFPIYGLGHSMGCKLHLLIGSLFKVERAGNILISFNNYAAKEAIPLVEQFNSTLKIEFTPSPLETNKLVQERYNIRRNLLIKFSNDTIDQSAALTKILQERFDDMVTAQTLPGTHTTPLGQDIKWQTGTSFTPFDALGQWFKQEAYRDLNQLKSSILLWMNPLAPP

SEQ ID NO: 43983 - protein, 320 aa, Erwinia carotovora subsp. atroseptica SCRI1043
MIRRIGVLTSGGDAPGMNAAIRGVVRAALSEGLEIYGIYDGYQGLYEDRMEQLDRYSVSDVINRGGTFLGSARFPQFRDEAVRQVCVENMQRRGLDALVVIGGDGSYMGAKRLTEMGFPCIGLPGTIDNDVAGTDYTIGYFTALETVLEAIDRLRDTSSSHQRISIVEVMGRHCGDLTLAAAIAGGCEFIVLPEVPFSPEDLVSEIKAGIEKGKKHAIVAITELVCDVDELAKYIEKETGRETRSTVLGHIQRGGSPVAYDRILASRMGAYSIELLQQGYGGRCVGIQNEKMVHHDIVDAIENMKRPFKGDWLETAKKLF

SEQ ID NO: 43984 - protein, 604 aa, Helicobacter hepaticus ATCC 51449
MKALIVPQEYIRNFSIIAHIDHGKSTLADRLIQECGAVSEREMTAQIMDTMDIEKERGITIKAQSVRLNYPYKGQTYTLNLIDTPGHVDFSYEVSRSLSSCEGALLVVDASQGVEAQTIANVYIAMENNLEILPVINKIDLPAADPLRVAEDIESTIGLDCTDVLQVSAKSGEGIKNLLERIIECIPAPSGDENAPTKALIYDSWFDNYLGALALVRLVNGTLRVGQEVQVMSSGKKYEVLALYYPHPVQKILTQTIGCGEIGIISLGLKSVTEMAVGDTITDSKNPTKVPVEGFRPAKPFVFAGIYPIETDKFEELREALHKLKLNDSALSFEPETSVALGFGFRVGFLGLLHMEVVKERLEREFSLNLIATAPTVVYEVYMTDGSKVLVQNPSELPEVQKIESIYEPYVRASIITPSEYVGNIITLLSNRRGVQEKMEYLNQSRVMLTYALPSNEIVMDFYDKLKSCTKGYASFDYEPIEYRQGDLVRLDIRVAGEIVDALSIIVDKSKSYEKGRALVESMKEIVPRQLFEVAIQASVGNKVIARENIKSMGKNVTAKCYGGDITRKRKLLEKQKEGKKRMKAIGKVELPQEAFLAILKIDG

SEQ ID NO: 43985 - protein, 283 aa, Chromobacterium violaceum ATCC 12472
MEDPSKPRPSWLERLSTMLLREPEDREELIELLHNAFERNLLDAEALGMIEGVLEVSELTVRDVMIPRSQMHVLNIDDPIARFLPTVIDSGHSRFPVIGESKDDVQGILLAKELLRYFHAPSTFNLKNVLRPAVFVPESKPLNVLLRDFRATHNHMAVVVDEYGGVCGLVTIEDVIEQIVGDIEDEYDIDDDEDDIVPVRGNERYRVKALTEIEDFNHYFGTDYADDDVDTVGGLVISLTGHLPKRGEKIEAAGLRFTVLRADSRRLDTLLVERIQASIDIAE

SEQ ID NO: 43986 - protein, 214 aa, Glycine soja
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVG

SEQ ID NO: 43987 - protein, 476 aa, Enterobacter sakazakii
MDTFIHPTNLCFFTQPLSPGKLSKPPHWRRIPRLAAHPVYPWCSPDRLSHWNLSLFTDCQEVVMKALTYHGPHNVKVENVPDPIIEAQDDIILRVTATAICGSDLHLYRGKIPQVHHGDIFGHEFMGEVVETGSAVKDIRKGDRVVIPFVIACGDCFFCKLQQYSACENTNKGTGAALNKKQIPAPAALFGYSHLYGGIPGGQAEYVRVPKGNVGPFKVPPVLSDDKALFLSDILPTAWQAVKNGQVQKGSQVAIYGAGPVGLLSAACARLLGAEQIFMVDHNDYRLAFAKERYGVIPINFDENDDPAAFIIENTPGNRGVDAVIDAVGFEAKGSLTETVLSNLKIEGSSGKALRQCIAAVRRGGVVSVPGVYAGFIHGFLFGDAFDKGISFKMGQTHVHAFLPELLPLIEQGLLTPEEIVTHYLPLEDAARGYKIFEKREEECRKVILVPGAATPEAAREKVTALMNAPLQPLQP

SEQ ID NO: 43988 - protein, 576 aa, Rhizobium leguminosarum bv. viciae 3841
MRSGDSRCGAPKGFALTNFESLGVSKPIVATLFQLGIETPTPIQEHSIPLLLEGRDLIGLAQTGTGKTAAFGLPLIEKLLADERRPDNRTTRTLILAPTRELVNQIAESLKKFIRKSSLRINVVVGGVSINKQQLQLEKGTDILVATPGRLLDLINRRAITLTAVRYLVLDEADQMLDLGFVHDLRKIAKMVPKKRQTMLFSATMPKAIADLAGEYLVDPVKVEVTPPGKAADKVEQYVHFVGGKNDKTELLRKSLTENPDGRAMVFLRTKHGAEKLMKHLENIGYSVASIHGNKSQGQRERALKAFRDGSIKTLIATDVAARGIDIPAVSHVYNYDLPEVPDAYVHRIGRTARAGRDGIAIAFCAPDEAKLLRDIERLMGIDITVASGEAPANIGGGPRRANGNGNNRNRNGGQGREGQGRGEGRGDQNRSEHRGSRQERRPRREGEGSEVRAGGEERRPRPERPTSRNEDFRGQRRGEATPDLGPDNDLASTSDFRASAKPQRPAHHGAHANGEPSGHHRGNSRHAHGRPARKHGEDRGPQQAQAGEPRRDGNGGNRRGGSGSRNGGGQRRERA

SEQ ID NO: 43989 - protein, 233 aa, Triticum aestivum
  misc_feature (231)..(231): Xaa can be any naturally occurring amino acid
  unsure (1)..(233): unsure at all Xaa locations
MEDDVQALVIDNGSGMCKAGFAGDDAPRAVFPSIVGRPRHTGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYMMKILTERGYSFTTTAEREIVRDIKEKLAYVALDFEQEMATAXSS

SEQ ID NO: 43990 - protein, 135 aa, Ananas comosus
MADEQPKKPVPAAEEAPAAEAEAEEEEGLHLEDDQEPREHPIMGGIYDAPLNNENGFDKEDLARFAVREYNNKNNALLEFVRVVKAKEQVVSGMMHYLTVEVNDAGKKKLYEAKVWEQVWMNFRQLQEFTYLGDA

SEQ ID NO: 43991 - protein, 407 aa, Oryza sativa
  misc_feature (245)..(245): Xaa can be any naturally occurring amino acid
  misc_feature (296)..(296): Xaa can be any naturally occurring amino acid
  unsure (1)..(407): unsure at all Xaa locations
MSQSSRRTSVCDRISALPDELLHHVMTFLTAKEAVQTCVLSRRWQNVWASVGYLNVDSCNFITVKHFKKFVDNLLLQRSCALLDMFCIHTSYDSSDDSLDYSDIHPWVCHALRCNVKTLGILNYCDGKLLSVDGYPVPFTFLHLKSVYLCKFSIDNRFVEKLFSGCPELLHLELRHCAIKATMFCSATLKILTITAADRTQDDPEGFQHLVINMPNLICLHVEEIANRNLRLLDISSVESASVYXNRFSFGHSDVDCTILSALSNAARLHLMSSSIYEDVVQKVLLRDLPRCGIFXHLTSLALGELFFSDGCYPLLYLLRHSPNIEKLSLHLVKHGAYAYDHDTNSANATADLDPTCEGTGTAVNCEKLRKIKIICPQGDRRVHIIVKILFSIINPLPQIKIHPQNG

SEQ ID NO: 43992 - protein, 387 aa, Oryza sativa (japonica cultivar-group)
MLPAVKLSPGPVAFAGTNLRSRSASVSSVSSLKPSKFVVSSLRPLYLAPLDGPRAAGQKAQRQPLEFRCAASAADDKESKTEVVPVRSEAAQKLKISIYFATWWALNVIFNIYNKKVLNAFPYPWLTSTLSLACGSAMMLVSWATRLVEAPKTDLDFWKVLFPVAVAHTIGHVAATVSMSKVAVSFTHIIKSAEPAFSVLVSRFLLGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVVWWVAAQSVFYHLYNQVSYMSLDEISPLTFSIGNTMKRISVIVSSIIIFHTPVRPVNALGAAIAILGTFLYSQAKQ

SEQ ID NO: 43993 - protein, 501 aa, Medicago truncatula
MIINQGDKEDQTNTFNKYAFACAIVASMVSIVSGYDTGVMSGAMLFIKEDLGISDTQQEVLAGILNLCALVGSLTAGRTSDYIGRRYTIFLASILFILGAGLMGYGPNYAILMVGRCVCGVGVGFALMIAPVYSAEISSASSRGFLTSLPELCIGIGILLGYISNYVLGKYLSLKLGWRLMLGIAALPSFVVAFCILTMPESPRWLVMQGQLGKAKKVLMQVSNTTQEAELRLKDIKIAAGLDENCNDETVKLPQKSHQGEGVWKELILRPTPSVRWMLIAAVGIHFFEHATGIEAVMLYSPRIFRKAGITSKEKLLLATIGVGLTKIVFLVIALFLLDKLGRRRLLQISTGGMIIGLTLLGLSLTVVDKSNGNVLWALILSIVATYAYVAFFNIGLGPITWVYSSEIFPLKLRAQGASIGVAVNRTMNAVVSMTFISIYKAITIGGSFFMFAGISVLAWLFFYFFLPETKGKALEEMEMVFTKKSSGKNVAIEMDPIQKV

SEQ ID NO: 43994 - protein, 159 aa, Frankia sp. FE59
ITKEQYSRDPRNIAKKAEAYLRGTGIADTAYFGPEAEFYIFDDVRYDYNPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARSRGKTV

SEQ ID NO: 43995 - protein, 292 aa, Azoarcus sp. BH72
MITGSIVAIVTPMHEDGSLDFPRLRSLIDWHVAEGTDGIVIVGTTGESPTVSVDEHCELIRVAVEHAAGRIPVIAGTGANSTAEAIALARYAQQAGAVAHLSVVPYYNRPSQEGLYQHFRSVAEAVELPLILYNVPGRTVADLSNDTALRLAEIPNIIGLKDATGSIDRACDLIERAPEGFALYSGDDMTVAAFILLGGHGTISVTANVAPRAMHEMCAAALAGDAAKARTINARLVGLHRHLFCEANPIPVKWAVQRMGLVEGGLRLPLTPLAESFHDRVLTAMRQAGIQA

SEQ ID NO: 43996 - protein, 316 aa, Triticum aestivum
  misc_feature (156)..(156): Xaa can be any naturally occurring amino acid
  misc_feature (159)..(160): Xaa can be any naturally occurring amino acid
  misc_feature (177)..(177): Xaa can be any naturally occurring amino acid
  misc_feature (190)..(190): Xaa can be any naturally occurring amino acid
  misc_feature (209)..(209): Xaa can be any naturally occurring amino acid
  misc_feature (232)..(232): Xaa can be any naturally occurring amino acid
  misc_feature (296)..(296): Xaa can be any naturally occurring amino acid
  unsure (1)..(316): unsure at all Xaa locations
MRPATAQIDPSPSPSPAALAKSRLKRLFERQVLRVSPAERLPPVSAGGDKDREKDDLEPSSVCLDGMVRSFLEDGGGAVGERAPAARCCNCFNGGDASDDEDGPAAAEASAISDAAETIKGLVHCASLRERNLLADVSTLVERHRAAGARKRELLXPLXXSLRAMGHDAALALSRWXDKSSSHPAGEHAXVNSFLPPGSERANRERVLXDVDFRSQFEVARPTKAYRAVLHXLPWAFAGKENSLRLLLPPPEDSSRANLKKGGLHFPPWRKAGDMRANGRAPYEREAPPPCAGRPXSASASELADTGEGGEDGPKA

SEQ ID NO: 43997 - protein, 288 aa, Oryza sativa (japonica cultivar-group)
MTPRCHLPPPCRAASTTPATSTALSTPPPSRAGPDELRSTWAHRAWTLAGSAAVLSSLSTSATLAAADADANGAAAAFAAPLAAALAAYSLADLATGVYHWLVDNYGDADTPVLGPQIAAFQGHHRHPSTITRREPCNNLHALARAVALALPPAGAALAAAGAPASAHAFAAVFAACVVLSQQFHAWAHGNPRRLPPGVGAMQRAGVLVSRAQHGAHHRAPYDNNYCIVSGMWNATLDRHRVFEAMEMVVFLRTGVRPRSWDEPDAAWTEDYDDTAAVAGGDTSLDTQ

SEQ ID NO: 43998 - protein, 421 aa, Brucella suis 1330
MNHFEYRNGVLHAENVSLPEIAKAVGTPFYVYSRATIERHFRVFHDAFADMDTLVTYALKANSNQAVLTALAKLGAGADTVSQGEIRRALAAGIPANRIVFSGVGKTPREMDFALEAGIYCFNVESEPELEILSARAVAAGKVAPVSLRINPDVDAKTHAKISTGKSENKFGIPRDKARAAYARAASLPGLNVVGIDMHIGSQIIDLEPFDNAFALMAELVKELQADGHNIRHVDVGGGLGIPYRTDNTPPPPPVAYAQIVAKHIKPLGLKTVFEPGRLIVGNAGLLVTEVIFVKEGDAKNFVIVDAAMNDLIRPTLYDAFHDIRPVIMPNDNAPRIRADFVGPVCETGDYLGLDREVAKPAPGDLIAICTTGAYGAVLSSTYNSRLLIPEVLVDGERYHVVRPRRTYEELLALDSVPDWL

SEQ ID NO: 43999 - protein, 436 aa, Archaeoglobus fulgidus DSM 4304
MQVLRLDRRHYKSGKIRRAMSSRIPGFYKLSVEERLKKVAEFAGLSDEEVKAVLSQGLPLDVADRMIENVIGTFELPLGIATNFLIDGKDYLIPMAIEEPSVVAAASNAARMARESGGFTTDYTGSLMIGQIQVTKLLNPNAAKFEVLRQKDEIIERANECDPMLVNLGGGCKDIEARVIDTIMGKMLIVHLIVDVKDAMGANAVNTMCEKVAPFIERITGGKVYLRIISNLAAYRLARAKAVFDKDVIGGEEVVEGIMLAYAFAAADPFRCATHNKGIMNGISALMIATGNDFRAIEAGAHSYAAIGGYKPLTTYEVDRKGNLVGTIEIPMAVGVIGGATKVNPLAKISLKILGVNTAEELARVAAALGLAQNFAALRALATEGIQRGHMELHARNLAIMAGATGDEVDRVVEIMVRDGKIRLDYAKEVLERLRS

SEQ ID NO: 44000 - protein, 119 aa, Brassica napus
KDAWVFSCITCTPEGNAGVCTACCLTCHDGHELLELWTKRNFRCDCGNSKFGTLACKLLPGKDVQNPENSYNHNFKGLYCSCDKPYPDPNGEDHGEMIQCCICDDWFHEEHLARKPSDG

SEQ ID NO: 44001 - protein, 216 aa, Bradyrhizobium sp. BTAi1
MLHALRQAKAQATATVAARVGIGGPVGSGKTALIEALIPVLQRRGVDFAVVTNDLVTKEDAERLRRSGLIDPDRVSAVEAGACPHTVIREDPTLNIAAGDELEARFPGVELILFESGGDNLASTFSLDLVDWWIFVIDVAGGDDIPRKRGPGLLRCDLLVVNKIDLAPHVGVDLDRMLADARQVRGGKPVIATNLKAGTGVEAVADAISAAVLFRI

SEQ ID NO: 44002 - protein, 186 aa, Brassica napus
  misc_feature (103)..(103): Xaa can be any naturally occurring amino acid
  misc_feature (110)..(110): Xaa can be any naturally occurring amino acid
  misc_feature (131)..(131): Xaa can be any naturally occurring amino acid
  unsure (1)..(186): unsure at all Xaa locations
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPLCWNFELXEHGFVYXREHGKHPPDTTDGRYWTMWEXLPCSGCTDSAQVLKEVQECKTEYPNAFIRIIGFDNNRQVQCISFIAYKPPSFTGA

SEQ ID NO: 44003 - protein, 249 aa, Pseudomonas aeruginosa PAO1
METRRLFDQGSAAYASARPRYPDALYRHLAGLCGQRRRAWDCATGTGQAALGLAQYFGEVLASDTSTQQIEHAVVHPGIRYSVQDAEATDYPDAAFDLVCVAQAWHWFDHSRFNRELLRVLRPGGVFAAWGYGWFSIDAQIDAAIDEEYLRPIGPYWAQQNRLLWNAYRDVELPLGELPAPAFVIEQQWSLARLFDYMATWSASRLCREAQGNAFVRQALQRVAALWGEPTSTRRVRMPLALRIARKDA

SEQ ID NO: 44004 - protein, 304 aa, Chromobacterium violaceum ATCC 12472
MNLQALIEDIRQQVLPFYDQGRVADYIPALASVPPHQFGIAIHTLDGREHACGDADTPFSIQSISKAFMLALTLQADGEQLWRHVGKEPSGNPFNSLVQLEYEHGIPRNPFINAGALVVTDRAIGHFGDAHARLLAWLREETGNAGLMADQAIAASERAHGDRNAALAHFMKSYGNLGHPVETVLDQYFHNCSIAMSCRELARAGLFLANHGLSPQTGTQYLSRSQAKQVNAVMLTCGTYDAAGEFAYRVGLPVKSGVGGGLLAVIPGKMAIAAWSPQLDARGNSVLGLEALDRFTTRTGLSIF

SEQ ID NO: 44005 - protein, 214 aa, Glycine soja
  misc_feature (173)..(173): Xaa can be any naturally occurring amino acid
  unsure (1)..(214): unsure at all Xaa locations
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVXNQQSIGLDYALFTKHGNNEVGYQNLFDALLDSLYAALEKVG

SEQ ID NO: 44006 - protein, 204 aa, Glycine soja
VDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVGA

SEQ ID NO: 44007 - protein, 193 aa, Bacillus cereus ATCC 10987
MKKILLLLADGFEAVEASVFTDVLGWNKWEGDGSTEVITVGLRDKLTCTWNFTIIPEKTVDNIQLDEFDALAIPGGFEEAGFYRDAYSKEFLHVIQHFHVKQKPIASICVASLALGKSGILIGKKATTYSHPTSERKEQLKNFGAKVQNDLIVQDGNIITSSNPGTAFDVAFLLLEKLTSKQNAKHVKDLMGF

SEQ ID NO: 44008 - protein, 215 aa, Glycine soja
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVGA

SEQ ID NO: 44009 - protein, 373 aa, Zea mays
MDSSGGGGGGAQIKGMATHGGRYVLYNVYGNLFEVSSKYAPPIRPIGRGAYGIVCAAVNSQSGEEVAIKKVGNAFDNHIDAKRTLREIKLLRHMDHENILALKDVIRPPTRENFNDVYIVTELMDTDLHQIVRSNQPLTDDHCQYFLYQLLRGLKYVHSANILHRDLKPSNLFLNANCDLKIADFGLARTTSETDLMTEYVVTRWYRAPELLLNCSQYTAAIDVWSVGCILGEIVTRQPLFPGRDYIQQLKLITELIGSPDDASLGFLRSDNAKRYMKQLPQFPRQDFRLRFRNMSPGAVDLLERMLVFDPSRRITVDEALHHPYLASLHEINDEPTCPAPFSFDFEQPSFTEAHIKELIWRESLAFNPEPPY

SEQ ID NO: 44010 - protein, 338 aa, Arabidopsis thaliana
MTSFCSMISLLLLLLLLSLSSAVFSDDASFQKLPVPETRSGPEAFAFDSTGKGFYTGVSGGKILKYLPETGYVDFAQITESSNSSWCDGTIGTALAGRCGRPAGIAFNEKTGDLYVADAPLGLHVISPAGGLATKITDSVDGKPFKFLDGLDVDPTTGVVYFTSFSSRFSPIQVLIALGLKDATGKLYKYDPSTKVVTVLMEGLSGSAGCAVSSDGSFVLVSQFTKSNIKRYWIKGPKAGSSEDFTNSVSNPDNIKRIGSTGNFWVASVVNKIIVPTNPSAVKVNSNGEVLQTIPLKDKFGDTLLSEVNEFEGNLYIGTLTGPFAGILKLEKGSCPAT

SEQ ID NO: 44011 - protein, 159 aa, Frankia sp. FE56
ITKEQYSRDPRNIAKKAEAYLRGTGIADTAYFGPEAEFYIFDDVRYDYNPYGSMHAVDSVEAAWNTARKEEGGNLGYKPRFKGGYFPVPTTDHFTDLRSEMTRVLFEVGITVEMQHHEVGTAGQAEIDIRYDTLLKTADNLMLYKYVIRNVARSRGKTV

SEQ ID NO: 44012 - protein, 159 aa, Frankia sp. FE41
ITKEQYSRDPRNIAKKAEAYLRGTGIADTAYFGPEAEFYIFVDVRYDYNPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARIRGKTV

SEQ ID NO: 44013 - protein, 477 aa, Rhizobium leguminosarum bv. viciae 3841
MTIYQNLIAGEWVGSNATKNINPSDTNEVVGLYADGSADDTRNAIAAAKAAFPAWSRSGIWERHVILKKTGDEIMARKDELGALLAREEGKTLPEATGEVIRASQIFEFFAGEALRLAGEVIPSVRPNIGVEITREALGVIGIITPWNFPIAIPAWKIAPALCYGNTIVFKPAELVPACSWAIVDILNRAGLPKGVLNLVMGKGSVVGQAMLESPDVHGITFTGSTGTGRRVAAASIEHNRKFQLEMGGKNPMVVLDDADLNVAVEAAANSGFFSTGQRCTASSRLIVTEGIHDKFVAALTDKLKTLVVDNALKAGTHIGPVVDERQLKTDTDYIEIGKSEGAKLAFGGEVISRDTPGFYLQPTLFTEATNQMRISREEIFGPVVSVIRAKDYDEALAIANDTPFGLSAGIATTSLKHATHFKRNSEAGMVMVNLPTAGVDFHVPFGGRKGSSYGPREQGKYAAEFYTTVKTAYTLA

SEQ ID NO: 44014 - protein, 159 aa, Frankia sp. FE1
ITKEQYSRDPRNIAKKAEAYLRGTGIADTAYFGPEAEFYIFDDVRYDYTPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARSRGKTV

SEQ ID NO: 44015 - protein, 734 aa, Arabidopsis thaliana
MAPNLRIKKACDAMKLLGISETKTRAFLRKLLKTYENNWDFIEEDAYKVLLDAIFDEADAQSTEKNKKEEEKKKKEEEKKSRSVATSRGRRKAPEPLVQDEEDDMDEDEFPLKRRLRSRRGRASSSSSSSSSYNNEDLKTQPEEEDEDDGVTELPPLKRYVRRNGERGLAMTVYNNASPSSSSRLSMEPEEVPPMVLLPAHPMETKVSEASALVILNDEPNIDHKPVISDTGNCSAPMLEMGKSNIHVQEWDWETKDILNDTTAMDVSPSSAIGESSEHKVAAASVELASSTSGEAKICLSFAPATGETTNLHLPSMEDLRRAMEEKCLKSYKIVHPEFSVLGFMKDMCSCYIDLAKNSTSQLLETETVCDMSKAGDESGAVGISMPLVVVPECEISGDGWKAISNMKDITAGEENVEIPWVNEINEKVPSRFRYMPHSFVFQDAPVIFSLSSFSDEQSCSTSCIEDCLASEMSCNCAIGVDNGFAYTLDGLLKEEFLEARISEARDQRKQVLRFCEECPLERAKKVEILEPCKGHLKRGAIKECWFKCGCTKRCGNRVVQRGMHNKLQVFFTPNGKGWGLRTLEKLPKGAFICEYIGEILTIPELYQRSFEDKPTLPVILDAHWGSEERLEGDKALCLDGMFYGNISRFLNHRCLDANLIEIPVQVETPDQHYYHLAFFTTRDIEAMEELAWDYGIDFNDNDSLMKPFDCLCGSRFCRNKKRSTKTMQILNKA

SEQ ID NO: 44016 - protein, 157 aa, Frankia sp. FE39
ITKEQYSRDPRNIAKKAEEYLRGTGIADTAYFGPEAEFYIFDDVRYDYSPSGSMHAVDSVEAAWNTARKEEGGNLGYKPRFKGGYFPVPPTDHFTDLRSEMTRVLFDVGITVEMQHHEVGTAGQAEIDIRYDTLLKTADNLMLYKYVIRNVARSRGK

SEQ ID NO: 44017 - protein, 495 aa, Blastopirellula marina DSM 3645
MICVSIGRGRHKHIIAEHRHLVDLGVKLVELRLDYINGTIKLKRLLNDRPGPVLVTCRREQDGGRWAGMEAERQMVLRTAIVDGADYVDIEEDIAANIPRYGTTKRIISYHNFRETPADIEEIHERMCKLDPDIVKLATMANSPHDNIRMLKLAQRNNVPTIALCMGDMGTPTRILGAKYGVPITYSTYSNERTLAPGQIGYQQMREVYGYDQINAETEIYGVIADPIGHSLSPQLHNACFRDQGSNRCYLPFRVPREHLASFIQEDCPALEIKGLSVTIPHKETIVRMIKKPNAAVQGIGAANTVLFDEGGPSGFNSDCDAALASLSTALPQDVANPYENKTALVLGSGGVAKAIAWGLKNRGVDVIIASRTDENADDLAKGLGCRMVSWEDRGLERVDILINGTPVGMHPNVNESPIDKVRLRAGMVVFDTVYNPEQTLLIKEARQRECRVVTGVDMFVRQAALQYQLFTGSEPSRDLMRDTLKKITGAVKAS

SEQ ID NO: 44018 - protein, 391 aa, Lactobacillus plantarum WCFS1
MKFEESKILQQLPKQFFANLVKKVNAKAAAGADVINLGQGNPDQPTPEFVVKAMQTATANPADHKYSLFRGLPRFKQAAADFYEREYGVKLDPETEIAVLGGSKIGLVELPFALLNPGDTMILPDPGYPDYLSGITLAQVKLALLRLTAANHFLPDYQQVDPQVAAAAKLLYLNYPNNPTGAVATSQFFQDTVDFANEHQIGIVHDFAYGAIGFDGQRPVSFLQTPGAKDVGIEMYTLSKSFNMAGWRVGFAAGNADMIEALNLIQDHLFVSVFPAIQDAAIAALNSDQQTVHELVRLYERRRNQFFTTARKIGWEPYPSGGSFYAWMPVPEGYTSEAFADLLLDKAAVAVAPGNGFGAGGEGYVRVGLLIDEPRFTEACQRIAKLHLFDR

SEQ ID NO: 44019 - protein, 228 aa, Brucella suis 1330
MLNKLSAEFFGTFWLVFGGCGSAILAAAFPELGIGFLGVALAFGLTVLTMAYAVGGISGGHFNPAVSLSLTVAGRLPAKDLIPYWVAQVLGAIATAAILYVIASGKDGFSAGGLASNGYGELSPGGYSMMAGLLIEIILTAFFIIIILGSTSSLAPAGFAPIAIGFGLTLIHLVSIPVTNTSVNPARSTGVALFADTAALSQLWLFWVAPLVGAVIGAIIWKGLLGRD

SEQ ID NO: 44020 - protein, 221 aa, Triticum aestivum
  misc_feature (195)..(195): Xaa can be any naturally occurring amino acid
  unsure (1)..(221): unsure at all Xaa locations
MSAAGDRDLRELAPLEAILFDIDGTLCDSDPFHFLAFRELLQEVGFNNGVPITEEFYSANISGWHNDALAGALFPELEHAKGMEFMDRKEALFRKLAAGELKGLEGLQELCTWIEGRNLKRAAVTNAPRANAELVLSLLGLTSFFPVLVIGSECERAKPSPDPYLKALELIGASPDRTFIFEDSASGIRAGVPAXVAVVGLTTGNPEKVLRDPGPNPTDPR

SEQ ID NO: 44021 - protein, 412 aa, Burkholderia sp. 383
MSLDSRQLATLAQQYGTPLWVYDADVIRDRIAQLRQFDVIRYAQKANSNIHILKLMREEGACVDAVSLGEIERSLAAGFSPASEPEGVVFTADLIDRPTLAAVLKHGVTVNAGSLDMLARIGEHAPGHRVWLRVNPGFGHGHSNKTNTGGPQSKHGIWIDDVPRAIEIVRQYGLKLVGIHMHIGSGVDYGHLSQVCDAMVALVTSLGHDIDAISAGGGLSIPYRDGEPRVDVGHYFSQWDAARKRIERHLGHPVRIEIEPGRFLVAEAGTLVTEVQAVNRRPKHDFVLIDAGFNDLMRPSMYGSYHEVSVHTHEGALLAGRPLVDLAIAGPLCESGDVFTQDAGGVVTHRKLAQPQIGDLLFLHDAGAYGASMSSNYNSRPLAPEVLVDRSAPRLIRRRQTIDELLALETFE

SEQ ID NO: 44022 - protein, 285 aa, Fusobacterium nucleatum subsp. vincentii ATCC 49256
MRRYKMDTRFNGGVIMDVTTKEQAIIAEEAGAVAVMALERIPADIRAAGGVSRMSDPKLIKEIMSAVKIPVMAKVRIGHFVEAEILQAIGIDFIDESEVLSPADSVYHVNKKNFSTPFVCGARNLGEALRRICEGAKMIRTKGEAGTGDVVQAVSHMRQIMKEINLVKALREDELYVMAKDLQVPYDLVKYVHENGRLPVPNFSAGGVATPADAALMRRLGADGVFVGSGIFKSGDPKKRAKAIVEAVKNYNNPEIIAKVSEDLGEAMVGINENEIKIIMAERGV

SEQ ID NO: 44023 - protein, 345 aa, Zea mays
MKRKENSAHSAPPLNRPRGKRKALAELPKSNGLNMNHDSAPRPSKPRTRSAARAEAEAEAAMKRRKAGDAARWPMDTRQPDAEAAVAPYVGDIDRYLRSLEVEPLRRPSHSYFQDIQKNICPKMRAILVDWLVEVAEEFKLHAETLHLAVSYVDRFLTMNVVARNKLQLLGVTALLVAAKYEEIESSKMKVVKMETDLLKSLSFQIGGPTVTTFLRQFIASCRGGNSASRGKLEFVCSYLAELSLLDYDCISYLPSVVAAACLFVARFIIHPKTRPWNLSLEQSTGYRVFDLQKSIYVIHELQLTIRCPNQVAIREKYKDPKFGCVSTMVSPREIPTSFLEGCHK

SEQ ID NO: 44024 - protein, 501 aa, Oryza sativa (japonica cultivar-group)
MPPPPPSKNRGHVPAPRPPPGKPPGRRMASRDAAERAAFFARREAAAVLRRVLRGDASRRAAGSIKSLVYSPSVRNKRATFALVCQTLKYLPILKEVLASTGVLTSKWKKQEELVFVTAYDILFGQETAASGSVEQLIMLHKDTIMAALEKMCIRRKVRSVEDLVSKKRTVKPKPRFLRVNTLRTSTDSVIEELNKIHKVDKDELVPDLLVLPPGTDLHNHHLVSEGKGKASCMVAVALCPEPGWKVIDACAAPGNKTVHLAALMNGEGSITACELNKERTKTLQNTIRRSGANNIETINGDFLDIDSNDPSYAEVRAILLDPSCSGSGISTERLDHLLPSHSRGNQDDASTSSRIRKLSAFQRKALSHALSFPSVERVVYSTCSIHQAENEDVVSSVLPLASSLGFELATPFPQWRRRGLPVFEGSEHLLRTDPEDGLEGFFISLFVRKAAAAADAVKPSNGGLGVSKQVFKRRNGLMAFGSSRLSRMMMLCSTRGLSRR

SEQ ID NO: 44025 - protein, 219 aa, Glycine soja
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPFLANVYPYFAYVNNQQSIGLDYALFTKHGNNEVGYQNLFDALLDSLYAALEKVGAPNVK

SEQ ID NO: 44026 - protein, 264 aa, Triticum aestivum
  misc_feature (167)..(167): Xaa can be any naturally occurring amino acid
  unsure (1)..(264): unsure at all Xaa locations
FRAAARAGSGINAEPKANDQYLPPFVIVDESGKSVGPIVDGDAVVTFNFRADRMVMLVTALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKXLEIAERTRDAIFSGKFDQVRITWPTVTWLVTLVIFKPHLALQGCLLSLSECLGPWGPRWWYLSCQLYPWNRQDLFKRTNLASRCSKRGGPPDFLFDP

SEQ ID NO: 44027 - protein, 211 aa, Burkholderia xenovorans LB400
MNRPKRLLVANVAWAHETAVRNPAFFRDLVRGQNPHVLWIGCSDSRVPAETITHCEPGDLFVHRNIANLFQAGDDNSASVLEYAVKVLKVGHVIVCGHYGCGGVRAALLPPEPGLPHVNRRIAPLCALARAHHEELDGHANERQRIDRLAELNVLEQVRGLRAHPVVRDADPAPLVHGWIFALEDGRIKVLSSGYEADDAMTCTTAAHSAA

SEQ ID NO: 44028 - protein, 512 aa, Zea mays
  misc_feature (88)..(88): Xaa can be any naturally occurring amino acid
  unsure (1)..(512): unsure at all Xaa locations
MASNGCNGNGNGNGNGKAAPAGVVVPEIKFTKLFINGEFVDAASGKTFDTRDPRTGDVLAHVAEADKADVDLAVKSARDAFEHGKWPXRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 44029 - protein, 235 aa, Pyrobaculum aerophilum str. IM2
MSIEVVEVKPHERHYGVYVVKFEDGTERIATKNLTPGRRVYGERLIKWGGDEYREWNPYRSKLAAAILNGLKLVPIKEGTHILYLGAASGTTPSHISDIVGENGLIYSVEFSPRVFREFMEKLVDQGRRNVVPILGDARFPYQYAHYVKGVDVVYIDVAQPAQAKILADNADYFLKPGGHVMLVIKAMSIDVTAPATETFKQEINTLKERGFDILETVHLEPYDTAHAMVIAKKR

SEQ ID NO: 44030 - protein, 456 aa, Saccharopolyspora erythraea
MTDTSADLVILGGGSGGYACAFRAAELGLSVVLIEKDKLGGTCLHRGCIPTKALLHAAEVADSARDGDQFGVKTSLEGIDIAGVNSYKDGVVSKLYKGVQGLFKAHKITVVEGAGTLVDAKTVRVDGTRYTGRNVVLATGSYSKSLPGLELGGRVIASEQALNLDFVPEKVVVLGGGVIGVEFASVWRSFGAEVTIVEALPHLVPNEDEFISKRLEREFRKRGIKFKTEVKFTGAQQSAEGVSVRLENGDQYDADLLLVAVGRGPNTAALGFEEAGVTMERGFVRTDDRLRTSVDGVYAVGDIVPGLQLAHRGFQQGIFVAEEIAGLNPQAIDESGIPRVTYSHPEVASVGLTEAAAKEQYGSVETFNYDLAGNGKSQILKTSGAVKLVRPTDGPVVGLHMVGDRVGELIGEAQLIYNWEALPEDVAPLVHAHPTQTEALGEAHLAQAGKPLHVHG

SEQ ID NO: 44031 - protein, 374 aa, Glycine max
  misc_feature (286)..(286): Xaa can be any naturally occurring amino acid
  unsure (1)..(374): unsure at all Xaa locations
MSLNVDEDLVTEMEEAPTLAPSIPLENVQEMVRNDPFHVPIGYVTSQEELEKANYMPHLSSEIPVIDLALLSNGNKEELLKFDVACKEWGFFQIVNHGVQTELMQKMKDAASEFFNLPIEEKNKYAMVSSETQGYGKGCVVSGEQTLDWSDSLILITYPTQYRKLQFWPKTPEGFMEIIEAYASEVRRVGEELLSSMSVIMGMRKHVLFGLHKESYQVLRLNYYPPCSTPEQVQGLSPHSDTSSITLLMQDDDVTGLEIRHQGGWVPVNPIPDALVVNVGDVTEVXDNGKYKSVEHRAMTNKNKERISYGLFLCPQHDVEVEPLDHMIDSHNPKLFQKVRYGDYLRQSLKRKLEGKTHLNEAKLKESDLRNQDD

SEQ ID NO: 44032 - protein, 266 aa, Archaeoglobus fulgidus DSM 4304
MTLRTKDGLTLYTRRWDVESPRAVICLVHGLGEHSGRYEHVARFFNENGISFAAFDLRGHGRSEGKRGHAEYQQLMDDITLFLQSLDYDCPKILYGHSMGGNLALNYILRYDPDIAGGIISAPFLALPKELPKHLFFILKLLNVVAPSIQLSNGIDPNLISRDREVVEAYVSDPLVHDKISPRFILQSLEAGKWALENADRLRKPILLIHGTADQITSYRASQEFAKRAGELCKFVSYEGFYHEPHNEPEKERVLADMLKWIEEVI

SEQ ID NO: 44033 - protein, 423 aa, Oryza sativa
MIIKFQSAHDTYSTNGLRGRGSDTMFKRDAPSTDMISGLPEGVLHRIMSFLTLREAVQTCVLSRRWRNLWLSMPLINADYKQFFEMTDTKAGYDEALAVAVPMFKRFVNRLLELRDPVASIDKFCLWYSISDDNEDDTESQDAAANRWISQALQKKARVVEVYGDLVFADLYPLVIDHSVFTSSYLTKVVFSSVLLEDGFFKQLESGCPALEDLSLDDCVISGDEISSQTLKVLTIKDTKFSMEHKTSINTPSVTSLTLWRPAHGIVVLKDMASVVTASVKPSEFIDEFDARGLRQYLWALSGVKNLEFYYLGELTIEGNLQLCPKFNNVVNLTLGRWCLDANFYALILFMQNTPRLEKLTLKLHPFRYQQQRIIGELTERSFTCGHLKIVEVICSENDPLINHLVDFFVSSGMTTAQIHIKH

SEQ ID NO: 44034 - protein, 381 aa, Oryza sativa (japonica cultivar-group)
MAHLSVQSVDTDAGSGWTWVREERETRGWAAGRASDPGAPAPVDRELAFSEADSSRSNKQQPLPGGRGSWKPEMVAAAGDRLDLPVVDLASSDLRSSAESIRKACVECGFFYVVNHGIEEGLLEKVFAENRRFFEQPLEEKMALLRNSSHLGYTPPYTEKLDASSKFRGDLSETFKIGPIGDEGFQNDANQWPSEERLPCWKETMKLYRGTALGTGKRILSLVALSLNLDAEFFDCPLAFLRLLHYPGEINESDDGNYGASAHSDYGILTLLATDGIPGLQICREKDRHPQLWEDVHHIDGALIINIGDLLERWTNCVFRSTLHRVVAVGKERYSVAFFLDPDPDLVVQCLESCCSEACPPRFPPIKSGDYLEERLSSTYK

SEQ ID NO: 44035 - protein, 688 aa, Dechloromonas aromatica RCB
MSTALLLALGCAVLAVLYGWISSRQILALPAGNERMQEIAKAIQQGAEAYLSRQYKTIAMVGVILFLVIGLIPKLGWLTAFGFLIGAVLSGAAGFIGMNVSVRANVRTAEAARSGIAAALDVAFKGGAITGMLVVGLGLLGVAGYFAFLKSTAAPGADLHHIIEPLVGLAFGSSLISIFARLGGGIFTKGADVGADLVGKVEAGIPEDDPRNPAVIADNVGDNVGDCAGMAADLFETYAVTVVATMVLAALTIKSVPGLGENLVLYPLALGGVSIIASIVGCYFVKATEGGKIMAALYRGLIVAGVLALAAYYPITSWLIGAGATLPDGTTINTMTMFGCSVVGLVLTAALVWITEYYTGTDYAPVKHVASSCQTGHATNIIAGIGVSMKACAWPVLSVCAAIYAAFAMGGLFGIAIAATSMLSMAGIVVALDAYGPITDNAGGIAEMAELPKEVRNVTDPLDAVGNTTKAVTKGYAIGSAGLAALVLFADYTHGLEAASGKVFTFDLSNHLVIIGLFIGGLIPYLFGAMAMEAVGRSASAVVMEVRRQFKEIPGIMEGTAKPDYSRAVDMLTVAAIKEMMIPSILPVAVPIVVGLVLGPQALGGLLVGTIVTGLFVAISMTTGGGAWDNAKKYIEDGHFGGKGSEAHKAAVTGDTVGDPYKDTAGPAVNPLIKIINLVALLIVPLIA

SEQ ID NO: 44036 - protein, 419 aa, Dechloromonas aromatica RCB
MAAKNAFYAQSGGVTAVINATACGLIQEARRHPEKIGKVYAGRDGIIGALTEDLIDTSLESDEDIARLRHTPGGAFGSCRYKLKSLEQHRAQYERLIEVFKAHDIGYFFYNGGNDSMDTAWKVSQIAEKMGYPVVCVGVPKTVDNDLPHTDCCPGFGSVAKYVATSIREAGYDVASMARTSTKIFVLEVMGRHAGWITAACGLASENAGEPPHILLFPEVPFDPERFLVRVDECVKQYGYCTVAVSEGLSDAAGNLIAESGTKDAFGHSQLGGVGQMVAQLIKDKLGYKYHWALADYLQRSARHLASKTDLDQAHALGVAAVDLALQGKNAVMATIERLADAPYRWQIGDAPLAEIANVERKMPPEFISPDGFHITDACRTYLQPLIDGEEPPPYRNGLPDYIRLKNISVAKKLEIFTI

SEQ ID NO: 44037 - protein, 219 aa, Glycine soja
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKKGNNEVGYQNLFDALLDSLYAALEKVGAPNVK

SEQ ID NO: 44038 - protein, 219 aa, Glycine soja
NGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVGAPMVK

SEQ ID NO: 44039 - protein, 973 aa, Aspergillus oryzae
MYNAKLPLTASYLLSTLQGHPDIQVLYAVPYALKLLSESEQGLESLARMELVMFGGSSCPKPIGDTLVKNGTLLVSHYGTTETGQLMTSFRERSDLDWDYVRPGPSLLPYIRWEERFPGIYELSVLEGWPSKVASNRPDGSYATKDLFEKHPTKPNAWRYYARLDDTLVLENGEKANPLIIEGVARNHPDVGEAIAFGANKDRLGLFLVRAANALSKTDEEIIDAVFPAIEKCNADSPSYAHISRDMIQVLPSDTVYRATDKGTVIRSAFYRDFNEQIEQVYELGDATGDRVLEGTELNMFLRESLLEVAPTINSAVLDDTTDVFSLGVDSLQSIRLRKIITKTLNVGGQRLSQNFVFEHPSIQRMADEITRLRLGLDADKEIPIEEQMSQLIDKYSNNFKAHIPVRQTVNGERIAVTGATGSLGAHLVAQLVQMEQVHTVFCLVRANSAHDALRRVRQSLYDRGLLYSLSPPDERKIVALPAQLSNTSRLGLDEPTYKQLTQSLTAVIHCAWSVNFNWSLGSFEDSCIAATRNLLDLCLDAQAPMPARFSFCSSVSTVARTPGHWVPEELPESLSYAQGMGYAQSKLVTEHIVNRAAQHTNIAARVLRVGQIVADTVHGIWNATEAIPMILQTAKTIKALPELDDILSWTPVDVIATSVVELTLGTNVANIVNLTNPTLSHWTRDLLPFLKTAGLEFEQLPQREWLNRLRQSNPDPAANPPIKLIEFFASKYDNDRPSRVLLYDTKKAQAGAPALRQAGGLNAQFVSRFMAHFQNQCWSNKDTTSISKKSREVIFLAGPCGCGKSTAAQALAQRFSILIIEGDDLHSPASRQRMANNIPLTDSDRWDWLAHIRGAVMDRLQHSAAPAVVVTCSALRTIYRDELRRLSRLFDFPVNVTFLMLSIKDRAQLKDRLIARSAKEGHYMSSAMVDSQLDTLESPSGSEGDVILLDSDEPMEKMLEGVQDVVQGLLDV

SEQ ID NO: 44040 - protein, 457 aa, Nostoc punctiforme PCC 73102
MRTEWVAKRRGQVNVSQMHYARQGVITEEMHYVAQRENLPTDLIRDEVARGRMIIPANINHTNLEPMAIGIASKCKVNANIGASPNSSNLQEEVDKLNLAVKYGADTVMDLSTGGGNLDEIRTAIIKASPVPIGTVPVYQALESVHGTIENLTADDFLHIIEKHAQQGVDYQTIHAGILIEHLPLVRNRITGIVSRGGGILARWMLHHHKQNPLYTHFQDIIEIFKRYDVSFSLGDSLRPGCTHDASDEAQLAELKTLGQLTRKAWEDDVQVMVEGPGHVPMDQIEFNVRKQMEECSEAPFYVLGPLVTDIAPGYDHITSAIGAAMAGWYGTAMLCYVTPKEHLGLPNAEDVRNGLIAYKIAAHAADIARHRPGARDRDDELSKARYNFDWNRQFELSLDPERAKEYHDETLPADIYKTAEFCSMCGPKFCPMQTKVDADALTELEKFLAKEPVTQS

SEQ ID NO: 44041 - protein, 258 aa, Burkholderia xenovorans LB400
MSKQRAKLVVGNWKMHGRLAENAVLLQAVAQGAGELPAQVRVGVCVPSPYLAQSQSLLEGSRVAWGVQDVSAFTHGAYTGEVAAPMAVDFGATLAIVGHSERRAYHRESAELVAVKTQRVLEAGLTPIVCVGETLEEREAGSTEQVVGMQLDEVLAKLSEQEAARIVVAYEPVWAIGTGKSASSEQAQAVHAFLRARLAAKGAAVADVPLLYGGSVKPENAEELFRQPDIDGGLIGGASLKAQDFLVICKAATTSVAG

SEQ ID NO: 44042 - protein, 214 aa, Glycine soja
NGNNLPTKQAVVDLYKSNRIGKIRLYYPDEGVLQALRGSNLEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVG

SEQ ID NO: 44043 - protein, 226 aa, Arabidopsis thaliana
MVSLRRRRLLGLCCGPNGYVTPLPFLTAEEMITGIPNPNARAAYNPGPAETVTTVIVEKKAIEERSRRTRSKHMHFRSDYSDISPVNSDSISPKYQPPKRRKQHRRKRVHNQEPCLMRGVYYKNMKWQAAIKVEKKQIHLGTFSSQEEAARLYDRAAFMCGREPNFELSEEVIRELKQQTWEEFLNCTRRTITNKKPKSRIEHEDTKINASMPHQPEEEEQDSDKM

SEQ ID NO: 44044 - protein, 510 aa, Oryza sativa (japonica cultivar-group)
MAPPRANSGDGNDGAVGGQSKLSPSGLLIREIPGGYGVPFLSPLRDRLDYYYFQGADEFFRSRVARHGGATVLRVNMPPGPFLAGDPRVVALLDARSFRVLLDDSMVDKADTLDGTFMPSLALFGGHRPLAFLDAADPRHAKIKRVVMSLAAARMHHVAPAFRAAFAAMFDEVDAGLVAGGPVEFNKLNMRYMLDFTCAALFGGAPPSKAMGDAAVTKAVKWLIFQLHPLASKVVKPWPLEDLLLHTFRLPPFLVRREYGEITAYFAAAAAAILDDAEKNHPGIPRDELLHNLVFVAVFNAYGGFKIFLPHIVKWLARAGPELHAKLASEVRAAAPAGGGEITISAVEKEMPLVKSVVWEALRMNPPVEFQYGRARRDMVVESHDAAYEVRKGELLFGYQPLATRDEKVFDRAGEFVPDRFVSGAGSAARPLLEHVVWSNGPETGTPSEGNKQCPGKDMVVAVGRLMVAGLFRRYDTFAADVEELPLEPVVTFTSLTRAADGDGAARRGV

SEQ ID NO: 44045 - protein, 143 aa, Salmonella enterica subsp. enterica serovar Typhi
HISPGIYARAFLEGRLTQEQMDNFRQEVHGNGLSSYPHPKLMPEFWQFPTVSMGLGPIGAIYQAKFLKYLEHCGLKDTSKQTVYAFLGDGEMDEPESKGAITIATREKLDNLVFVINCNLQRLDGPVTGNGKIVNELEGIFAG

SEQ ID NO: 44046 - protein, 417 aa, Burkholderia xenovorans LB400
MAEIKNYTLNFGPQHPAAHGVLRLVLELDGEVIQRADPHIGLLHRATEKLAETKTFIQSVPYMDRLDYVSMMVNEHGYVMAIEKLLGIDVPVRAQYIRVMFDEITRVLNHLMWIGAHALDVGAMAVFLYAFREREDLMDVYEAVSGARMHAAYYRPGGVYRDLPDAMPQYKASKIRNAKALSKMNENRQGSLLDFIDDFFTRFPKCVDEYETLLTDNRIWKQRLVGIGVVSPERALNLGMTGAMLRGSGIEWDLRKKQPYEVYDKLDFDIPVGVNGDCYDRYLVRVEEMRQSTRIVKQCVEWLRKNPGPVMIDNHKVAPPSRVGMKSNMEELIHHFKLFTEGFHVPEGEAYAAVEHPKGEFGIYLISDGANKPYRLKIRAPGYAHLSTLDEMARGHMIADAVTIIGTQDIVFGEVDR

SEQ ID NO: 44047 - protein, 313 aa, Oryza sativa (indica cultivar-group)
MASGEEADLEAFQRHVAAHLADLRGGEDELLSIEWIRRLLEAFLLCQEEFRVVVALARRRGALSAAAEKMVGDFYERAVKALDVCNAARDGVDQVRRWERLAGIAASVLLAPGEIHEGQLRRARKALSDLSRSRNWSAARQLQAIGSGLAAPRAHEGGLVAPVYSMGCLLHLAAWALVAAVPCPDRAAALQAHHLPAAPPRAAFPWAPPLLALQERLTEEGKRKDRRNSCGLLKEIHALEKCTQRLAEAIDAAPVPLSGEREAEVREAAAELAAVCAAMRAGLEPLERQVREVFHRIVRSRMEGLDSPMLNAD

SEQ ID NO: 44048 - protein, 174 aa, Zea mays
MTDLYVSLFISNYSPTPIEKVISLVSRTGRYLQRYDTTGYRQVVGCIPYRYKNDGEIEVLLISAQKKGKGMLLPKGGWEIDESIEEAALRETMEEAGVTGHLEETLGKWQYKSKRHNMVHDGFMFPLLVSEQFEQWPESGFRQRKWVCLSEAIDLCQNWWMREALDAFIDRKCL

SEQ ID NO: 44049 - protein, 222 aa, Lactobacillus plantarum WCFS1
MTIKQAIVQQALTLIKPQMVVGFGGGSTVGELVKEAANHVNDITVVTPSPTTRQLATVLGYTVVDTAYCDRVDIAFDGCDQLDHHGNALKSGGGIHANEKIIASLADEYWLLTMQDRLVDQFDIKTPLVLEVLPAALSLVMRTVSDLGGQATIRTANNRDGFTLTDSGNLLIDCHFPTYAKLTDLNVELATLAGVVETSYFDHLVTNAWLGDATTNTVKALF

SEQ ID NO: 44050 - protein, 575 aa, Oryza sativa (japonica cultivar-group)
MVSDHEVRCCSFDRGMSLHCCPAAGDPPAPAGTAEELLERARSLVPAALDAARAATGFGGRWKVIAARLERVPPCLSDLSSHPCFSKNSLCRELLQSVAATLAEAAELGARCREPPRAGKLQMQSDLDALAGKLDLNLRDCALLIKTGVLSDATVPPVAPAAEAAAQTDVRELLARLQIGHAEAKHRAVDGLLDALREDEKSVLSALGRGNVAALVQLLTATAPKIREKAATVLCLLAESGSCECLLVSEGALPPLIRLVESGSLVGREKAVITLQRLSMSPDIARAIVGHSGVRPLIDICQTGDSISQSAAAGALKNLSAVPEVRQALAEEGIVRVMVNLLDCGVVLGCKEYAAECLQSLTSSNDGLRRAVVSEGGLRSLLAYLDGPLPQESAVGALRNLVSSAISPDSLVSLGVLPRLVHVLREGSVGAQQAAAAAICRVSSSSEMKRLVGEHGCMPLLVRLLEAKSNGAREVAAQAVASLMSCLANARDIKKDEKSVPNLVQLLEPSPQNTAKKYAISCLLTLSASKRCKKLMISHGAIGYLKKLSEMDVAGAKKLLEKLERGKLRNLFSRK

SEQ ID NO: 44051 - protein, 127 aa, Coxiella burnetii RSA 493
MKQIIGTNKAPRAIGTYSQAVKAGNTVYFSGQIPLEPETMEIISGDFKDHVHRVFKNIAAIAEAAGGSLAQIVKLTIYLTDMENFHLVNEVMKHYYEEPYPARAVIAVKQLPKNALIEIDAVMVLGE

SEQ ID NO: 44052 - protein, 162 aa, Burkholderia xenovorans LB400
MTAIQNFFKTFFLTELLKGLALTGRYTFQRKVTVQFPEEKTPISPRFRGLHALRRYENGEERCIACKLCEAVCPALAITIESETRADNTRRTTRYDIDLTKCIFCGFCEESCPVDSIVETHILEYHGEKRGDLYFTKDMLLAVGDRYETEIAANKAADAPYR

SEQ ID NO: 44053 - protein, 396 aa, Zea mays
MAAAASSALHAVGAVASAKPRSVVPAVATRRSVRVAPAAKRGPGSGGGRLVARSAVAAKADEAAAAAGSKSGGHELLMFEALREALIEEMNLDPTVCVMGEDVGHYGGSYKVTKGLAEMFGDLRVLDTPIAENSFTGMGVGAAMKGLRPVVEGMNMGFLLLAYNQISNNCGMLHYTSGGQFKIPVVIRGPGGVGRQLGAEHSQRLESYFQSIPGLQMVACSTPYNAKGLMKAAIRSENPVVLFEHVLLYNLKEKIPDEEYICCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAATLEDATVVQPAQIVAAVEQICQ

SEQ ID NO: 44054 - protein, 416 aa, Gracilaria gracilis
MAFVAPVSSVFSTSSKSAVCSGRSSFAQFSGLKKVNNTARLQTAEQGSAFGGVSDANDAFFNAVNTMGAPARTSNAPSMKVRVAINGFGRIGRNFIRCWAGRTDSNMDVVCINDTSGVKTASHLLKYDSILGTFDSDVVAGEDSITVDGKTIKVVSNRNPLELPWKEMEIDIVVEATGVFVDAVGAGKHIQAGAKKVLITAPGKGEGVGTFVVGVNDHLYSHDKFDIVSNASCTTNCMAPFMKVLDDEFGVVRGMMTTTHSYTGDQRLLDAGHRDLRRARSAALNIVPTTTGAAKAVALVVPTLAGKLNGIALRVPTPNVSVCDVVMQVSKKTFKEEVNGALLKAANGSMKGIIKYSDEPLVSCDYRGTDESTIIDSSLTMVMGDDMLKVVAWYDNEWGYSQRVVDLGEVMASQWK

SEQ ID NO: 44055 - protein, 99 aa, Carica papaya
MEPGIVIGGLQDVEGDANNLEYQELARFAVDEHNKKTNAMLQFKRVVNVKQAVVEGLKYCITLEAVDGHKTKVYEAEIWLKLWENFRSLEGFKLLGDAH

SEQ ID NO: 44056 - protein, 571 aa, Oryza sativa
RPLISWCPPPRPVIHQRRNATHHDATMASHAVTDALLLPRSEGAVAGAVDFRGRPASRASTGRWSAAMFVLGVEIAERFAYHGVSANLISYLTGPLGESTAGAAAAINLWSGVATMLPLLVACVADAWLGRYRTIVLASLLFVVSMGMLTLSSALPAFHGDGGGCSYTSKSLSCAPSTAQVAIFYVSLYLVALAEAGHKPCAQAFGADQFDQNDAKESVSRSSFFNWWYFGMCSGTAMTTMVSSYIQDNIGWGLGFGIPCLVMAFALAMFLLGTRNYRYYVSTQSSPFARLARAFVALIRGSKDDALAVVDDDDGGDHREELRGVLRLFPIWATCIIYAVIFSQSSTFFTKQAATLDRRIGESFRVPPAALQTFISVTIIAFIPVYDRAFVPVARRFTRASSGITMLQRIGTGLVLALAAMVVAALVEARRLGVARDAGMVDDPKAALPMSLWWMVPQYVLFGLSDVFAMIGLQEFFYDQVPDALRSLGLAFFLSIFGVGHFFSSFIISAIDGATKKSGASWFANNLNRAHLDYFYWLLAGLCAVELVAFVFVSRVYVYKKRVPHNGCDVM

SEQ ID NO: 44057 - protein, 337 aa, Cochliobolus heterostrophus
MVVKVGINGFGRIGRIVFRNAIEHNDVDIVAVNDPFIEPHYAAYMLKYDSTHGQFKGDIKVDGNNLTVNGKTIRFHMEKDPANIPWSETGAYYVVESTGVFTTTEKAKAHLKGGAKKVVISAPSPDAPMFVMGVNHETYKPDIEALSNASCTTNCLAPLAKVIHDKYTIIEGLMTTIHSYTATQKVVDGPSAKDWRGGRTAAQNIIPSSTGAAKAVGKVIPELNGKLTGMAMRVPTANVSVVDLTVRIEKGASYDEIKQAVKEASEGSLNGILGYTEDDIVSTDLNGDNRSSIFDAKAGISLNKNFVKLVSWYDNEWGYSRRVLDLLVYIAKIDGNA

SEQ ID NO: 44058 - protein, 391 aa, Oryza sativa (indica cultivar-group)
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELEAAKSSSSVEKSYELPDGQVITIGAERFRCPEVLFQPSFIGMEAPGIHETTYNSIMKCDVDIRKDLYGNIVLSGGSTMFPGIADRMSKEITALAPSSMKIKVVAPPERKYSVWIGGSILASLSTFQQVNLTPTLYEVARMQMWISKGEYDESGPAIVHRKCF

SEQ ID NO: 44059 - protein, 569 aa, Archaeoglobus fulgidus DSM 4304
MLGVEGKSITEIDEKEINRIWLKHYDEGVRPNIDYPEIPLYQLLEDTAKKYPDKTALIFFGKKITYRELDEMSDRIAGFLKSLGIKKGDRVILDLPNVPQYVAAYYGILKVGATVVQCNPLYTEREIRYIQENSEAEYGFFVEFVYPRIKGLLAEGKLKKAVICKIEDYLPFPLNILYPLKKEKVRIEKSDKVVYWKDALKSPLTKERPEINPKDDVAIFLYTGGTTGVPKAVMSTHFNLVANVYQTLEWVVDRTPDDVFIGVLPYFHSFGMTTSMNAPIANGSTIVLIPDPRDIKRILESIQKYRASIFCGVPTMYAAIINHPDVKKYDLSSVKACISGAAPLPVEVKRRFEEITGGKLVEGYGLSETSPVALGNPVYGLNKEGSIGIPFPDTYAVVIDDEGKVLPIGEVGELVIKGPQVMKGYYKMEEETKKVLVNGWLLTGDMAKMDEDGYFYIVDRKKDMIIAGGYNIYPREVEEVLYEHPAVVEAAVVGVPDPYRGETVKAYIVLKPEYKGKVTEQEIIQFCKERLAAYKVPKLVEFRDELPKSAVGKILRRVLREEEIKKIKG

SEQ ID NO: 44060 - protein, 573 aa, Candida albicans SC5314
MCGIFAAYRQPEVEDFKSKALQYSKLIRHRGPDWSGNVVQNSTILCHERLAIVGLDSGAQPIVSPDGNFTLAVNGEIYNHIQLREQFPDYKFKSLSDCEPIIPLFTKYDIDAPKHLDGMFAWVLYDKKNDRIVAARDPIGITTLYMGKSSKSPKTRYFASELKCLIEECDEIFAFPPGHVYDSNTDEITRYFQPSWWDASKVPEQHVDFKKVRETLELAVRKRLMAEVPYGVLLSGGLDSSLIASIASRETKKAAQASFNPEGIDANKELSGVDDKGSLHSTGVFNQLHSFAIGLPGAPDLLAAEKVAHFIGTIHHSHTFTLEEGLDALDDVIYHLETYDVTTIRASTPMYLLSRKIKAQGVKMVLSGEGSDEIFGGYLYFANAPSAKEFHEECVKRVKNLHYADCLRANKSTMAWGLEARVPFLDKQFLEVCMNINPEDKLIQPGKIEKYILRKAFDTSDEPDVKPYLPEEILWRQKEQFSDGVGYSWIDGLKDTAEKMVSDEEFAHPKPEWGDDIPTTKEAYWYRCKFDKMFNGSKAAASTVMRWIPKAEWGCHADPSGRYAATHDHKVAQ

SEQ ID NO: 44061 - protein, 429 aa, Ralstonia eutropha JMP134
MSRNQQLFDRAQQTIPGGVNSPVRAFRSVGGTPRFITCAEGAYMWDADGQRYIDYIGSWGPMIVGHAHPDVVRAVQETAAHSFSFGAPTEAEIDMAEEICKLVPSIEQVRLVSSGTEATMSALRLARGFTGRDLIIKFEGCYHGHADSLLVKAGSGLLTFADTTQNAPSSAGVPADVTRHTMVLEYNNVAQLEEAFAQHRGEIAAVIVEVVAGNMNLVRASDAFLKAMRELCTRDGAVLIFDEVMTGFRVALGGAQSHYGITPDMTCLGKVIGGGMPAAAFGGRRDIMAKLAPLGGVYQAGTLSGNPLAVAAGLTTLRLIQAPGFYDKLTAQTRKLADGLSEAARAAGVPFAADAIGGMFGIYFRDGVPGSFAEVTKSDTARFNRFFHAMLDNGVYLAPSAFEAGFVSACHDDAILQATLDAARKAFAA

SEQ ID NO: 44062 - protein, 154 aa, Saccharomyces cerevisiae
GAASGTSVSHVSDVVGPEGVVYAVEFSHRPGRELISMAKKRPNIIPIIEDARHPQKYRMLIGMVDCVFADVAQPDQARIIALNSHMFLKDQGGVVISIKANCIDSTVDAETVFAREVQKLREERIKPLEQLTLEPYERDHCIVVGRYMRSGLKK

SEQ ID NO: 44063 - protein, 122 aa, Triticum aestivum
  misc_feature (63)..(63): Xaa can be any naturally occurring amino acid
  unsure (1)..(122): unsure at all Xaa locations
MTSVWKTKVLPGLNKIFDKDGKKAAAAEFLKSFNKEEIDKEIGDKKTELEPKLVETIEASPPXEIKGLIKDKKTSKIKKNRLPSTPWTIGQDWECFCCLNLENKICEKIIHKWITFTSLTRS

SEQ ID NO: 44064 - protein, 436 aa, Magnaporthe grisea 70-15
MAPPPAMDVDEMDVEEDFDQEQRIINEEYKTWKKNSPFLYDMILSTALAWPTLTVQWLPDVKEPEGKNYRIHRVLLGTHTSGATDEYLQIAEVEIPKAVQPNPADYDEDRGEIGGYGGSKGSEAAAIKWNITQKIDHPGEVNKARYQPQNPDIIATACVDGKILIFDRTKHSLQPSGTPNPQYELVGHKAEGYGLNWSPHDEGCLVTGSSDQTVLLWDLKDVQPNNRILKPKRKYTHHSQVVNDVQYHPLVKHFIGTVSDDLTLQILDTRQESNDKAALVAKNGHSDAINALDFCPASEFLVATASADKTIGLWDLRNVKDKIHTLEGHRDAVTSVFWHPHEAGILASGSYDRRILFWDLSRVGEEQQPDDAEDGPPELLFMHGGHTNHLADFSWNPNEPWMVCSAAEDNLLQVWKVAESIVKRDDADLPVDELGP

SEQ ID NO: 44065 - protein, 1419 aa, Aspergillus oryzae
MEGQDYYAKAPPSDNRDDTDSTATMMGDESAPTPRPANVSRAEDWSLMPQVKQQHERDVASGFKSRELGVTWKNVNVEVVSSEAAVNENFLSQFNIPQKIKDGRNKPPLRSILQNSHGCVKPGEMLLVLGRPGSGCTTLLKMLSNRRLGYKSVEGDVRFGSLTHKEANRYHGQIVMNTEEELFFPTLTVGQTMDFATRLKIPFNLPKGVESAEAYRLEMKKFLLEAMGISHTNDTKVGNEYVRGVSGGERKRVSIIECMASRGSVFCWDNSTRGLDASTALEWTKAIRALTDVMGLSTIVTLYQAGNGIYDLFDKVLVLDEGKQVYYGPMSQARPFMEDLGFVCREGSNVADFLTGVTVPTERKIRPGYENRFPRNADMLLAEYEKSPIRAQMMAEYDYPDSDLARERTDNFEMAISHDRSKKLPKNSPMTVDFVQQVKACIIRQYQILWGDKATFIIKQVSTLAQALIAGSLFYNAPNNSGGLFVKSGALFFSLLYNSLLSMSEVTDSFSGRPVLVKHKGFAFFHPAAFCIAQITADIPVLLFQISIFSLVVYFMVGLTMSASGFFTYWVLVFATTMVMTALFRAVGALFTTFDGASKVSGFLISALIMYTGYMITKPQMHPWFGWIYWINPLAYGFDALLSSEFHNKIIPCVGTNLIPTGPGYENVPNHQSCAGVGGAIQGNNYVTGDQYLASLSYSHNHVWRNFGILWAWWALFVAVTIIATSRWKAASESGNTLLIPRERLDKHSQVARFDEESQVNEKEKKRNDGSSQEGDDLDNQLVRNTSVFTWKDLTYTVKTPTGDRVLLDNVYGWVKPGMLGALMGSSGAGKTTLLDVLAQRKTEGTIHGSIMVDGRPLPVSFQRSAGYCEQLDVHEPFATVREALEFSALLRQPRDVPDDEKLKYVDTIIELLELHDIADTLIGRVGAGLSVEQRKRVTIGVELVSKPSILIFLDEPTSGLDGQSAYNTVRFLRKLADVGQAVLVTIHQPSAQLFAEFDTLLLLAKGGKMVYFGDIGDNGQTVKDYFGRYGAACPPGVNPAEHMIDVVSGTLSQGRDWNKVWLESPENQRSIEELDRIISDAASKPPGTFDDGREFATSLWTQIKLVSQRMCVALYRNTDYVNNKLALHVGSALFNGFSFWMISDTVHSMQLRLFTIFNFIFVAPGVINQLQPLFLERRDIYDAREKKSKMYSWVAFVTALIVSEIPYLCLCAVLYFACWYYTVGFPTDSNKSGAVFFVMLMYEFVYTGIGQFISAYAPNAIFASLINPVIIGTLASFCGVMVPYQQIQAFWRYWIYWMNPFNYLMGSMMTFTIFDVNVKCKDSEYALFDPPNGSTCGEYLTEFMQGMGARMNLLDADATSGCRVCQYTRGSDYLLSVNLMDYYYGWRDAAIVALFALSSYALVYVLMKLRTKASKQAE

SEQ ID NO: 44066 - protein, 339 aa, Oryza sativa (indica cultivar-group)
MDRDDERLGRALAAFGGGGGGGGGVWELVDAALACAARDRPDELRARRDGIVERLYAAAGGGGGNCGAAAATTPSPRGAAVAEGEDDDDEAAAAADGLEIKILAIKDFLEDEDQSEDELLSLLQSLADMDITYKALQETDIGRHVNGLRKHPSGEVRLLVKQLIRKWKEIVDDWVRLHNSSGDASNSIITDGNSPEKIQGKNQQSSQVSEFKYSPSPSRHNNSSSERVSNGIASIAATKHRASPAPAHHNARQINNTHHSTTSSSAPAWRMVKEQKDSHLDLERLDSARKRLQENYQEAQNAKKQRTIQVMDINEIPKPKNRNAFIRKGNGGGFPARHR

SEQ ID NO: 44067 - protein, 739 aa, Oryza sativa (indica cultivar-group)
MDFFLTVTDSSIGPPCPAQYANGFLGLDARGAAHCWKTRIGRGEGGKWVAARRRGGAAGRGGRWPISPALVERSGVGEASPAAGRRRGGWEAVMETAHEVAIYIDRFHNLDLFQQGWYRLKISAAWEEDEYRAPVSPARVVQYEVPDIGSKGAFGLWKIDDVDNSFYTQPFQIKYSRQDIYLSVMVSFYIPNTEDELIYVPTLEDRTEIEDPSDIYVPVHEFRIPYKALLGLHAYFPVHFDAFHPVLVDLTMHIVYLKAGVTKSSQKASEQGLCSKSCYIIKALLSSREILLEEVMKMSAGIGKTLEDLDDADLTLGKHEPIDSSKAGLPKYSKGLYIPTKCFGHLTGVLHDLIERSDNVVRSTNDILLYTLSKEDLLELFQAPVQNSSSRAELHRRSIAQMKVGSQSMLKTETICITPKKRILTQIILQINARFIQDMQIYANPSEIPVVHIEQHVMVVPQHGSSKRLGHHLDLRLIRNQWILCDPGAECLLSQTNEDRTCGDFKEMGRRLSNEVVAFLKRKIDRYSRNGGCKDLKLSFVGHSIGNIIIRSALADPKMQPFLKNLYTYMSISGPHLGYWYSSNSLFNSGLWLMKRLKGVQCMHQLTFSDEQDPQNTFFYKLCKLNTLDNFKNIILVSSPQDGYVPYHSARIDSCPASSSDNSKKGQVFTEMLNNCLDQLRAPSSETRVFMRCDVSFDQSSHGRRRSLNTMIGRAAHIEFLENDLYARFIMWSFPDFFR

SEQ ID NO: 44068 - protein, 656 aa, Medicago truncatula
MRTLFIILFTIISFSTILPLSNSQKNDTFSTCNESYFTCGTNTNVSFPFWGKNRPNICGKNEFKLTCMHNQNTSVQIGSQKFNVLNINQTASTMKIVRTNLINDICSSNFTNTSLNGSPFTFLPNVQNLTVFYNCPIENSSIIGKNINSFTCENNGSNKHVFYVVKNETQLQNQFSNLQNCGASVQVQVSMDGVSESGVEVVQEGFDVKYDEGAGWSSECEVCRESGGTCGTNQNDSSQFSCYCPGGTHAANCSARKSSKRTKVLKLVLGFVGTGMLLPLIAVIICRNKAKIWKVIKTQFSKITRNNQHIEDFLESQGPLNIKRYSYSDIKKMTESFKVKLGEGGYGSVYKGKLLNGGSVAVKVLSESKGCGEDFINEVATICKTSHVNVVTLLGFCLDGTKKALIYEFMSNGSLEKFIQNHNKESEKAEKTKTSPSLSWENLHQIAIGIARGLEYLHKGCNTRIFHFDIKPHNILLDETYRPKISDFGLAKLSTSNESIISMSNARGTVGYVAPEVFNKSFGGVSHKSDVYSYGMMLLEMVGGRKNVNIVEASRSSELYFPHLVIYKKLEKGNDLELDDGVMSNEENEIAKKLTMVGLWCIQTIPTHRPTISKVIDMLDGSMDSLEMPPKPVMFSPPRSIPEFSTSSKSLESFSS

SEQ ID NO: 44069 - protein, 279 aa, Zea mays
MDREALRMLCSPQFWRMAVLWALSLLHSYLLVFHCGRADAPRRRRPRPAEGRCPICVVTGATSGLGRAAAAALAREGYHVVLAGRSTQLLYETVQEIQRQQPDAHLKEFQVDLASFKSIKKFGSSLKQWVHEKNVEPSIQLLVNNAGILAKSHRITEDGLDEMIQTNYIGPFMLTNILLPLLKNSSVPSRVVNLTSFTHRCVSGLDVCEDALRGMKFGRCSIGESYPLASTYEYTKLCMLMFSYELHRQLHMSSGVSVIAADPGVVETKIMRELPECLS

SEQ ID NO: 44070 - protein, 355 aa, Colletotrichum lagenarium
MSRANAPNPSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDNLSKEQLKQLIYQEIMR

SEQ ID NO: 44071 - protein, 281 aa, Leptospira interrogans serovar Lai str. 56601
MMELWLDEALELKNGRALKIKVKEFLHSRTTPFQKIDVFESVGFGRMFTLDGVVMMTEADEFAYHEMIVHVPMMSHPNPEKVLVIGGGDGGTVREVLKHPSVKEVHLCEIDKGVIDVCYEYFPEIANAMKDPRVKHAYEDGAKYVKDYQNYFDCIMVDSSDPVGPAEVLFKRPFYETMANCLKEGGICTTQGESFYYHGSIIRELFNFIPEIFKHCGYYYTVVPTYPSGIIGFTYCSKGPDPYTVVPDPQRVPQGLKYYSAEMHKAAFVLPQFAQKHIVRK

SEQ ID NO: 44072 - protein, 582 aa, Medicago truncatula
MVLFNVSRIETTPFDGQKPGTSGLRKKVKVFVQTHYLENFVQASFNALTEEKVRGATLVVSGDGRYYSEQAIQVITKMAAANGVRRIWVGLNGLLSTPAVSAVIRERVGVDGSKATGAFILTASHNPGGPNEDFGIKYNMENGGPAPEGITNKIYEYTTTIKEYLIAPDLPNVDITTVGVTNFTGPEGPFDVEVFDSASDYIKLMKSIFDFGSIRKLLSSPKFTFCFDGLHGVAGAYAKRIFVDELGAQESSLLNCVPKEDFGGGHPDPNLTYAKELVARMGLGKSESEGEPPEFGAAADGDADRNMILGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAYKNKDNIEDKLVTVEDIVRQHWAKYGRHYYTRYDYENVDAGAAKELMAHLVKLQSSLSEANGIVKGASSDVSNVVHGDEFEYNDPVDGSISSHQGIRYLFEDGSRLIFRLSGTGSEGATIRLYIEQYEKNPSKIGRLSHEALAPLVEAALKLSKMEEFTGRSAPTVIT

SEQ ID NO: 44073 - protein, 331 aa, Bartonella koehlerae
STASCESKITYIDGNEGILLYRGYPIDQLAEKGDFLESCYLLLYGELPTKQEKIDFDRCIMQHTVVHEQFARFFHGFRRDSHPMAVMIACLGAMSAFYHDSIDITDPQQRMIASIRLISKVPTLAAMAYKYSIGQAFVYPRNDLSYAANFLHMCFSIPCEEYKINPVLTRAMDRIFTLHADHEQNASTSTVRLAGSSGANPFACIAAGVACLWGPAHGGANEACLKMLQEIGSVERIPQFIARAKDKNDSFRLMGFGHRVYKNYDPRAKIMQQTCHEVLKELNIQDDPLLDIAIALENIALNDEYFVGKKLYPNVDFYSGITLKALGFPTE

SEQ ID NO: 44074 - protein, 382 aa, Pseudomonas putida GB-1
MIRSKLPNVGTTIFTTMSQLAVQTGALNLSQGFPDFNGPQALLDAVGRHVAAGHNQYSPMTGLPALRQQVAAKVERLYGARVDADQEVTITPGATEAIFCAIQAVVHAGDEVIVFDPCYDSYEPSVELAGGRCVHVQLSDGNFRIDWQKFSDALSPRTRMVILNSPHNPSGALITREDLDQLAKLVADRDIYLVSDEVYEHLVYDGVRHASVLAHEQLYQRAFVVSSFGKTYHVTGWKTGYVIAPPALSAELRKVHQYVNFCGVTPLQCALADFMAEHPEHIDELPAFYQAKRDLFCGLLEGSRFSFARTAGTYFQLVDYSQIRPDLNDVDMSLWLTREHGVATIPVSVFYQQPIPEQRLVRLCFAKREETLRQAAERLCAI

SEQ ID NO: 44075 - protein, 377 aa, Alteromonadales bacterium TW-7
MNKPPIIWTNVLFFSLTFLAAITLVPWYGISYGFTSAHWIAFVACMFFAGLSITAGYHRLWAHKTYNAHPAVEFIFALGGAFALQNSALHWSSDHRIHHGQVDDPIKDPYAATNGFWYSHIGWMLRDYQGDSYGDYSNCRDLQRNKIVMWQHKHYLKLVIAMNVGLPLVLGLLVGDVWGMLILAGLLRLVLSQHFTFFINSVAHIWGSRPYTEKNTARDNGFLALFTYGEGYHNFHHIFASDYRNGIKWFHYDPTKWMIRSLAAVGLASKLKRTPVERIEKAKADTLMSKTQTRLAKLPLAQDRLTLLQQEYDLLLKKLQTYCSLQKQVLEVKKNNMAKQCERSALMAQYHELEAAWENQKQAWLALNARLLKASFN

SEQ ID NO: 44076 - protein, 373 aa, Nicotiana tabacum
MRPLQPPPPAAAATTSSSTTASPMPPPPSRNRPRRRTDLTLPLPQRDPALAVPLPLPPTSAPSSSSSSSSSPLPTPLNFSELERINRIGSGAGGTVYKVLHRPTGRLYALKVIYGNHEDSVRLQMCREIEILRDVDNPNVVRCHDMFDHNGEIQVLLEFMDKGSLEGIHIPKESALSDLTRQVLSGLYYLHRRKIVHRDIKPSNLLINSRREVKIADFGVSRVLAQTMDPCNSSVGTIAYMSPERINTDLNHGQYDGYAGDIWSLGVSILEFYLGRFPFSVGRSGDWASLMCAICMSQPPEAPANASREFRDFIACCLQRDPARRWTAVQLLRHPFITQNSPAATTTGNMMPLPNQVHQPAHQLLPPPPHFSS

SEQ ID NO: 44077 - protein, 448 aa, Chromobacterium violaceum ATCC 12472
MSNQAWLERSFAAVWHPCTQMKRHERLPIVPIASADGVWLTDFDGKRYLDGVSSWWVNLFGHGHPRIKQAVRKQLDSLEHVMLAGFTHRPVVELSERLAALSGLGHAFYGSDGASATEIALKMSFHYWKNVGRPQKTRFVSLENSYHGETVGALAVTDVPLFSSTYAELLKPGLRAPSPDARQAVPGERAADVALRAARSLENLLAKHGGEIAAVIVEPLVQGAAGMAMHDPIYLTELRRLCDQYQVHLIADEIAVGFGRTGSFFAYQQAGITPDFLCLSKGITGGFLPLSCVLTRDEIYQAFYHDDVARGFLHSHSYTGNALACAAALAVLDIFDDEDVLEANRVKAEGFTRQMRPLAERPEIRHFRQRGMIWAFDVDTARSDFALAYFSAMLNRGCLLRPIGKSVYFMPPYTLKSEEMDWLASASVDALDEVLAGESVGGDPTALP

SEQ ID NO: 44078 - protein, 343 aa, Oryza sativa
  misc_feature (316)..(316): Xaa can be any naturally occurring amino acid
  unsure (1)..(343): unsure at all Xaa locations
MRAGDMPGRGARRRPDLTLPMPQRDAPTSLAVPLPLPPAATTTTSAPPAGGAMHPLAPAGAAPPPPLEELERVRRVGSGAGGTVWMVRHRGTGKEYALKVLYGNHDDAVRRQIAREIAILRTAEHPAVVRCHDMYERGGELQILLEYMDGGSLDGRRIADERFLADVARQVLSGIAYLHRRHIVHRDIKPSNLLIDSARRVKIADFGVGRILNQTMDPCNSSVGTIAYMSPERINTDLNDGAYDGYAGDIWSFGLSILEFYMGKFPFGENLGKQGDWAALMCAICYSDPPEPPAAVSPEFRSFVGYCLQKNPAKRXPSAAQLMQHPFVAGPQPQPLAAPPPSS

SEQ ID NO: 44079 - protein, 395 aa, Streptococcus pneumoniae R6
MKLSNRVLEMEESVTLAAGARAKALKAEGRDILSLTLGEPDFTTPKNIQDAAIASIRDGRASFYTVTSGLPELKAVVNSYFERFYGYSVASNQVTVAAGAKYSLYTFFMAVVNPGDEVIIPTPYWVSYGDQVKMAEGVPVFVSAKEDNHFKVTVEQLEAARTDKTKVLVLNSPSNPTGMIYTREELLAIGNWAVENDILILADDIYGRLVYNGHEFTPISSLSEAIRKQTVVINGVSKTYAMTGWRIGYAVGEADIIAAMSKIAGQTTSNPSAVAQYAAVEALSGEQDTVESMRQAFEERLNTIYPLLAEVPGFEVVKPQGAFYLFPNVKKAMEMKGYTDVTDFTTAILEEAEVALVTGAGFGAPENVRLSYATDLDTLKEAVERLKAFMGSEND

SEQ ID NO: 44080 - protein, 358 aa, Alteromonadales bacterium TW-7
MSKTNYSVAVLAGDGIGPEVMAAAEQVLDAVSNKFGFTLNREHHAIGGAAIDEFGEALPPKTLSACENADAILFGSVGGPKWENLPPNEQPERASLLPLRKHFGLFCNLRPAQLLPALSAASPLRADISEKGFDILCVRELTGGIYFGEKGRGGEGEEEFAFDTQNYSRKEIERIARFAFEAAKLRSNHVTSVDKANVLASSVLWREVVTEVSKDYPEVSLDYIYVDNAAMQLVKQPSQFDVLLCDNLFGDILSDECAMITGSMGLLPSASLNQSGFGLYEPAGGSAPDIAGKGVANPIAQILSAALMLRYSLGQDEAARTIEKAVAEAVEAGVGTPDIYPQGGYSTSDVAAAIVSRI

SEQ ID NO: 44081 - protein, 190 aa, Oryza sativa
MLQAQKVRITSFLDERSAYLTKFAKDADTEFDLIGQNAMKELDEVGDQIMERLDSKMQAFEETAEVQRQEIEMNERVLEDFEDWIEKEKNEGMFFKSLGKVKPRNKKKLTVKPIPKLEAQKVKDIAKESAGSKTRMNIYLGLMAILGLTIANAVFATPEVEWRKVAALGLIFIGLVAQVIYEQEISLARS

SEQ ID NO: 44082 - protein, 390 aa, Burkholderia xenovorans LB400
MNAPHDTPTSPTFPSRLPNVGTTIFTVMSALAAEKGAVNLGQGFPDFNCDPRIVDAVANAMREGHNQYPPMAGAAPLRQAISDKIANLYGRRYDATTEITVTAGATQALLTAILCSVHPGDEVVVVEPTYDSYLPSIELAGGKPVFVTLEAPDYAIPFDRLAAAITPKTRLLLINTPHNPTGTVWREQDMRKLEEIVRGTNVLILSDEVYEHMVYDGAPHESVARYPELAQRSFVVSSFGKTYHVTGWKVGYVAAPAALTVEFRKVHQFNVFTVNTPMQIGLADYMKDPAPYLDLPAFYQKKRDFFRAGLANSRFRLLPCTGTYFQCVDYSAISDLPEAEFAQWLTGEIGVAAIPVSAFYHEAHESGVVRFCFAKQESTLATALERLARL

SEQ ID NO: 44083 - protein, 148 aa, Astragalus sinicus
MGFTEAQEVLVNSSWEAFKQNLPHNSILFYTFVLEKAPAAKDLFSFLKNSDGVPKNNPALQAHAEKVFGLVRDAAVQLRAKGTVTLGDASLGGVHVQKGVVDPHFVVVKEALLQTIKEVAGGSWSAELSAAWEAAYDGLAAEIKKAMS

SEQ ID NO: 44084 - protein, 617 aa, Candida glabrata CBS 138
MTELAEQVSMPEGQQRRGGYVPPHIRNGGGRRGDSAPRGGFNNGGGRGGFFRNNGDRGGFGFGGRGGGFGGNRGGFGGNRGGFGGGMRGRWVDGKHVPGQRNERIELELFGAPEDPSFQSSGINFDNYDDIPVEASGEDVPEAITEFTSPPLDSLLLENIKLARFTKPTPVQKYSVPIVSKGRDLMACAQTGSGKTGGFLFPVLSESFLTGPAEKAANDGYSYQRKAFPTAVVMAPTRELATQIFDEAKKFCYRSWVKPCVVYGGAPIGNQMREMDHGCDLLVATPGRLNDLLERGKVSLSNVKYLVLDEADRMLDMGFEPQIRHIVEDCDMPPTGERQTLMFSATFPHDIQHLARDFLHDYIFLSVGRVGSTSENITQRILYVENRDKNSALLDLLAASNDNLTLIFVETKRMADQLTDFLIMQNFSATAIHGDRSQAERERALAAFRSGRANILVATAVAARGLDIPNVTHVINYDLPSDVDDYVHRIGRTGRAGNTGVATAFFNRDNNNIVKGLYEILEEANQEIPPFLEDCLREVSFSRSGSNRSTRGNRSSNTRDYRKHGGNGSFGQNSRNSSWGSARGGGFGGSTGGWGNDRAGGSAGGWGASNTKTSSWW

SEQ ID NO: 44085 - protein, 200 aa, Ehrlichia chaffeensis str. Arkansas
MKLKTIMSKCEFMIGATHIKSLPDFSIPEIAIAGRSNVGKSSLINAITNNKKNAKTSSKPGCTKQINFYLINKDFMVLVDLPGYGYSKADKTTINNYLCLMEYYLLNSRNLLKVILLIDAKVGFKEIDLDFINWLELHQIHYQLVLTKIDKIKKEMLDVNVNYIKNLNLDFIMYPIISTSSQCKQGIEELIYEIAQCIKK

SEQ ID NO: 44086 - protein, 210 aa, Candida glabrata CBS 138
MAFVKRVTQETNIQLALDLDGGSVSVRESILGKEYASGDGQTIHVHTGVGFLDHMLTALAKHGGWSLILECIGDLHIDDHHTVEDCGIALGQAFKEALGSVRGIKRFGHGFAPLDEALSRAVVDFSNRPFAVVELGLKRERIGQLSTEMIPHFLESFATEARITMHVDCLRGTNDHHRSESAFKALAIAIREARTPTGRDDVPSTKGVLA

SEQ ID NO: 44087 - protein, 558 aa, Glycine max
DLPLLLVGYGFGASFVALFAQLGGGIYTKAADVGADLVGKVEQGIPEDDPRNPAVIADLVGDNVGDCAARGADLFESIAAEIISAMILGGTMAQRCKIADPSGFILFPLVVHSFDLIVSSAGIFSIRGTRETGVIVPVEDPMTILQKGYSFTIVLAVLAFGLSTRWLLYTEQAPSAWFNFALCGLIGIITAYIFVWIAKYYTDYKHEPVRILALSSSTGHGTNIIAGVSLGLESTALPVLVISVSIISAFWLGHTCGLVDETGNPTGGLFGTAVATMGMLSTAAYILTMDMFGPIADNAGGIVEMSQQPESVREITDVLDAVGNTTKATTKGFAIGSAALASFLLFSAYMDEVSSFAHEPFKQVDIAIPEVFVGGLLGSMLIFVFSAWACSAVGRTAQEVVNEVRRQFIERPGIMDYKEKPDYGRCVAIVASASLREMIKPGALAIISPILVGIVFRILGYYTGQPLLGAKVVAALLMFATVTGILMALFLNTAGGAWDNAKKYIETGALGGKGSEAHKAAITGDTVGDPFKDTAGPSIHVLIKMLATITLVMAPVFL

SEQ ID NO: 44088 - protein, 319 aa, Zea mays
MFSYAAPPITYSPVPPPPPYAAGLLYPPPYYGGPVVPTPAVHVVQLRSVTATNFAAELDLIGSLLQNYPYIVVDTEYPGTVHRPPAGRRDDDLSPDEWYAMLKANVDELPPVQLGITLCDSHGNLPVVLDYGYGYTEGCWEVELSDFDIRRHRHAAQSVAFLRSQGVDFDAVRARGVGSAAFGAKLAEILLASRGAGVGLTWVAFGGAYDLAYLVKMIGGIGQPLPETRQGFLERVRVLLGGRVFDARFMAENCGRADLRDVGLRSVAINLGAVMPAADLPWLAGPKSLIVSRIHTIMKLHVLSDDDTTAFQGIIDRLY

SEQ ID NO: 44089 - protein, 173 aa, Arabidopsis thaliana
MAASVDPLVVGRVIGDVLDMFIPTANMSVYFGPKHITNGCEIKPSTAVNPPKVNISGHSDELYTLVMTDPDAPSPSEPNMREWVHWIVVDIPGGTNPSRGKEILPYMEPRPPVGIHRYILVLFRQNSPVGLMVQQPPSRANFSTRMFAGHFDLGLPVATVYFNAQKEPASRRR

SEQ ID NO: 44090 - protein, 432 aa, Saccharomyces cerevisiae
MCEHQLTQEDLEFDKKHIWHPYTSITTPLKVYPVTKAEGSYLYLDNGTKVVDGMASWWCVQQGYNNHRLNAAAISQINKMSHVMFGGITHKAGIDFCKKLLALLPDTLECALLADSGSISVDIAMKMALRYHHSLGNTTKKRFLTIKKGYHGDAFGAVSVCDPVNSRHNTYNGFLAENIFCKAPEVRFDCREKDVEKLVEELDVKPFAEIIDKHHSEISGVVMESIVQGAGGLRMYHPYFLKRVRALCNDFNILLILDEVAVGLGRTGMLFGFEHAGIVPDIVCLGKTLTAGYLTLSATVTTREIGDQISSGPEGCFMHGQTYMANPLACAVASENLSILMEGKWKSQVRQIEVQLKKELVPLLEHPIVADVRILGAIGVVEVTKRVNVEVLQEQFIKAGAWIRPFGNIIYILPPYIITSEELTVLTEAIRS

SEQ ID NO: 44091 - protein, 506 aa, Brucella suis 1330
MVMSTIVKPQPLTGLEVREFSMLIDGKWVGSDSGKSIERVAPGHGVTVSRYPAGNKADVERAVSAARKAFDDGRWSSTTASQRSLVLLKAADLIEARAEELAYLDAIEAGKPISQVRGEISGSVDIWRYAAALARDLHGESYNTLGDGTLGVVLREAIGVVSIITPWNFPFLIVGQKLPFALAAGCTAVVKPSELTSGSTLLLGEILAEAGVPDGVVNIVTGTGADVGQHMSTHPHVDMVSFTGSTGVGKLTMANAAQTLKKVSLELGGKNPQILFPDADMDAFIDAAVFGAWFNAGECCNAGSRLIVHRSVVDAIVGRVADLSKKVIVGDPLDASTQVGAIITPQHLTKVGAYVDQARKAGAAIAHGGEVLDLGLGQYMGPTILAGVKADMAVAREEVFGPVLSVLSFDTVEEAISIANAVDYGLSAGVWSRDFDTCMTIGRKVRAGTVWMNTFMDGTPELPFGGYRQSGLGRELGRHAVEDYTETKTLNMHIGARTGWWMPQAK

SEQ ID NO: 44092 - protein, 175 aa, Medicago truncatula
MGNTSSMLTQYDIEEVQQHCKHAFTQQEIVSLYQRFCQLDRNNCGFIPSDEFLSIPEFAVNPLSQSLLRMLDGFNFKEFIAFLSAFSPRSTLQHKIEFIFKVYDTDCNGKVSFDDMLTVLRDLTGQYMSEHQRKEVLAQVLEEAGYTKDSFLVLSDFMKILGNSDLKMEAEVPVD

SEQ ID NO: 44093 - protein, 381 aa, Pseudomonas putida GB-1
MTTSTGKINLLGLTQPEMEQFFDSIGEKRFRAGQVMKWIHHFGVSDFAAMTNVGKVLREKLEAVAEIRPPEVVSEDISADGTRKWVIRVASGSCVETVYIPTDDRGTLCVSSQAGCALDCSFCSTGKQGFNSNLTAAEVIGQVWLANKSFGTVPAKVDRAITNVVMMGMGEPLLNFDNVIAAMKIMMDDLGYGISKRRVTLSTSGVVPMIDELAKHIDVSLALSLHAPNDELRNKLVPINKKYPLKVLLESCMGYMSTLGGKRVLTVEYTLLKDVNDQPEHAAQMIELLRDVPCKINLIPFNPFPHSGYERPSNNAIRRFQDLLHHGGFNVTTRTTRGDDIDAACGQLVGQVNDRTRRSERYIAVRQLSADVELQDSAASH

SEQ ID NO: 44094 - protein, 554 aa, Podospora anserina
MGGLVPLLKKQLTGSKILFHILFWTFHWGIFAYGWWKQAADARLAGLNTLQYSVWLSRGAGLVLSVDGMLILLPVCRTIMRFIRPKIKFIPLDENIWMHRQLAYSMLLFTIIHTAAHYVNFYNVEKTQIRPVTAVQIHYVQPGGATGHVMLLCMLLMYTTAHHRIRQQSFETFWYTHHLFIPFFLGLYTHTVGCFVRDTADAISPFAGDEYWEHCIGYLGWRWELWTGGFYLIERLYREIRAIRETKITRVVKHPYDVVEIQFNKPSFKYKAGQWLFLQVPSVSKYQWHPFTITSCPYDPYVSVHIRQVGDFTRELGNAVGAGGIHAKLYEGVDPLGMYDVALANGQKMPALRIDGPYGAPAEDVFENEIAVLIGTGIGVTPWASILKNIWHLRNGPNPPTRLRRVEFIWVCKDTSSFEWFQTLLLSLEEQSAEAARVPGSSGVEFLKIHTYLTQKLDMDTTQNIVLNSVGSSVDPLTELKARTNFGRPNFGRIFQSMSEGIQNRTYLNGLEGNMRTTVGVYFCGPSAAARDIKKAAKAASSSEVRFRFWKEHF

SEQ ID NO: 44095 - protein, 141 aa, Pseudomonas putida GB-1
MAVQRTFSIIKPDAVAKNVIGKITTRFEEAGLKIVASKIKQLSKAEAEGFYAEHSARGFFGDLVAFMTSGPVVVQVLEGENAIALNRELMGATNPKEAAAGTIRADFAESIDANAVHGSDSEAAAAREIAYFFAATEVTTR

SEQ ID NO: 44096 - protein, 548 aa, Coxiella burnetii RSA 493
MRLHRTFLLRVYLKESAVITYPASKKIYCQGKIFPTIRVGMREIQLTNGDSLTLYDTSGPYSDPNISIKSPQGLPRLREPWIKVRPRKTQLAFAKEGVITPEMEYAAIRENQKRELKKNTDQERERRLQGNSLSARIPNPITPEFIRNEIACGRAILPANINHPESEPMIIGRHFLVKVNANIGNSSLTSSVEEEVEKLIWALRWGADTVMDLSTGKKIKEIRETILRHSPVPIGTVPLYEALEKVDGDVKALTWEIFRDTLISQAEQGVDYFTIHAGVLNRFIPLTQKRVTGIVSRGGSLMAKWCLLHREENFLYTHFTEICEIMRAYDVSFSLGDGLRPGSIADANDEAQFAELKIQGELNRIAWKYGVQVMNEGPGHIPLNLIEENMTKQLAYCREAPFYTLGPLTTDIAPGYDHIGSAIGAAFIAWQGCALLCYVTPKEHLGLPNKQDVKEGLIAYKIAAHAADLAKGHPAARQRDYLLSQARFEFRWHDQFNLALDAETARLFHDETLPKEAAKHAHFCSLCGPKFCAYKTSHEVRDTLQKVT

SEQ ID NO: 44097 - protein, 252 aa, Streptococcus pyogenes MGAS10394
MSRKPIIAGNWKMNKNPQEARAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIVCCGESLETYEAGKAVEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEAGSFLALLDFLN

SEQ ID NO: 44098 - protein, 452 aa, Pseudomonas fluorescens PfO-1
MSELSKARIPDAPAIQRLPLLQLILVGLQHVLLMYGGAIAVPLIIGQAAGLSREEIAFLINADLLVAGIATIVQSLGIGPMGIRMPVMMGASFAAVGSMVAMAGMPGIGLQGIFGATIAAGFFGMIIAPFMSKVVRFFPPLVTGTVITSIGLSLFPVAVNWAGGGAGAAQFGSPIYLAIAALVLATILLIHRFMRGFWVNISVLIGMCLGYVLCGAIGMVDLSGMANAPWVQFVTPLHFGMPKFELAPILSMCLVVVIIFVESTGMFLALGKITGQEVCPRMLRRGLLCDAGASFFAGFFNTFTHSSFAQNIGLVQMTGVRCRSVTIVAGGLLIVLSLLPKAAFLVASIPPAVLGGAAIAMFGMVAATGIKILQEADIGDRRNQLLVAVSIGMGLIPVVRPEFFAHLPLWMSPITHSGIAMATLSALTLNLLFNILGGAERAAINDCHAHPH

SEQ ID NO: 44099 - protein, 391 aa, Beta vulgaris subsp. vulgaris
MNRQIKNFTLNFGPQHPAAHGVLRLVLEMNGEVVERAEPHIGLLHRGTEKLIEYKTYLQALPYFDRLDYVSMMAQEHAYSLAVERLLNCEVPLRAQYIRVLFCEITRILNHLLALTTHAMDVGALTPFLWAFEEREKLLEFYERVSGARMHASFIRPGGVAQDLPLGLCRDIDSFTQQFASRIDELEEMLTGNRIWKQRLVDIGTVTAQQAKDWGFSGVMLRGSGVCWDLRRAAPYDVYDQLDFDVPVGTRGDCYDRYCIRIEEMRQSVRIIVQCLNQMPSGMIKADDRKLCPPSRYRMKLSMESLIHHFELYTEGFSVPASSTYTAVEAPKGEFGVFLVSNGSNRPYRCKIRAPGFAHLQGLDFMSKHHMLADVVTIIGTQDIVFGEVDR

SEQ ID NO: 44100 - protein, 131 aa, Glycine max
  misc_feature (102)..(102): Xaa can be any naturally occurring amino acid
  misc_feature (125)..(125): Xaa can be any naturally occurring amino acid
  unsure (1)..(131): unsure at all Xaa locations
MAPLMISSPAATTGNRALAYVGAPFTDLKYMAGLRTRNTNTDITSIASNGGRVQCMQAWPPIGKKKFETLSYLPDLDDAQLTKEVAYLLRNGWIPCLAFELXTGSLYREHITSPGYYDRRYWTCXKLSMFG

SEQ ID NO: 44101 - protein, 181 aa, Shigella flexneri 2a str. 301
MLKLLKTIMRAGTATVKYPFAPLEVSPGFRGKPDLMPSQCIACGACACACPANALTIQTDDQQNSRTWQLYLGRCIYCGRCEEVCPTRAIQLTNNFELTVTHKADLYTHATFHLQRCSRCERPFAPQKTVALAAELLAQQQNAPQNREMLWAQASVCPECKQRATLINDDTDVPLVAKEQL

SEQ ID NO: 44102 - protein, 400 aa, Zea mays
MLASAATVKPSTAAAAATCKAAFKPLHLPPLPAAAGLRPLSLSVSARPLYRQEHVLASVAVAAAGRNERATSPAPPSATADGARPLEVAAPAETGRRAKIGVYFATWWALNVIFNIYNKKVLNAFPYPWLTSTLSLAAGSAIMLASWATRIAEAPQTDLDFWKALTPVAIAHTIGHVAATVSMAKVAVSFTHIIKSGEPAFSVLVSRFFLGEHFPAPVYFSLLPIIGGCALAAVTELNFNMVGFMGAMISNLAFVVRTIFSKKGMKGKSVSGMNYYACLSIMSLVILLPFAVAMEGPKVWAAGWQTAVAEIGPNFVWWVAAQSVFYHLYNQVSYMSLDEISPLTFSIGNTMKRISVIVASIIIFQTPVQPINALGAAIAILGTFIYSQVIAPLHTVCFEF

SEQ ID NO: 44103 - protein, 394 aa, Zea mays
MLRLQKHLSLRLQEHLLPLHRSASLIQLSLQRSLLSTGSATYSSPGHFAADDYLVSTCGLTREQAANAAKCISHWKSSSNADAVLSFLTGPALGLSNAEIALLVAKDPRVLSCSVDNTLRARLARFRSHGFSAAQISEFVRVAPCFFRKFNIDVKLGFWMPFLGSPDRFLRLVKRNFYLLSSDLDKVVKPNIQLLQECGLSIQEIGSLCVANPRLLTSKPDRIRAVLVRAGEMGVPRKTLLFRHAVTAVAGLCPETFASKLKMMANILGCSEAEVARMVQKNPLVLRRSMETIQRACEFLINVVGVGTNFILDKPTILMYSLERRLVPRHYVMKVLQDKGLMRKDHSFYTLAAISASVFCSRYPDVYSARLQLRTWLIASELQKFSITSLRTHE

SEQ ID NO: 44104 - protein, 442 aa, Zea mays
MADLETLATPAPASASTKKKKKHSKKHKAASDAPTNVTVDASLMGGSSYVAAAPVVGYFPSGYDPLTTAAGAESAPGTQLFRHEKHPTWVDLVVRSPGGGHDFVGRSYAGEAAVPQVCDYALGVLDKASGTLRIVPIAGKKILRLEPHLEVQHPAHSQHSEVASEAASAAGNDELKVQDLTMMYGAKTDRDKDNKWRSLKEQRNDPSAYEDIDLGISETNVNANDRQEPVLVRNIPPYDPTADTSENAYLLDEIIPKSMREHLLEIVRHFESGEISSKGYGSFVSKRVHKLKELQGEDKKRFAWILSYIQHLLSLLARNGSMSNRKWKGRNENQISHGPATPQAVYRRLLFMFTEPGSSVMPTEKKELLTNYILVLTLFADDFRSNPSDICEDLKMTRQNLKPYYDQLGCKSVTEGAFKSTFMTLPAPLKFPKEVTRKRRRQ

SEQ ID NO: 44105 - protein, 194 aa, Suillus bovinus
MHNIKCVVVGDGAVGKTCLLISYTTNAFPGEYVPTVFDNYSANVMVDGKTISLGLWDTAGQEDYDRLRPLSYPQTDVFLICFSLVSPPSYENVRTKWWPEISHHAPSTSVVLVGTKLDLREDPATIEKLRDRRMQPIQYTQGVSMARDIGAVKYLECSALSQKGLKTVFDEVIRAVLNPPPKEKKRSGRGCVIV

SEQ ID NO: 44106 - protein, 247 aa, Triticum aestivum
MASPALISDTDQWKALQAHVGAIHKTHLRDLMTDADRCKAMTAEFEGVFLDYSRQQATTETVDKLFKLAETAKLKEKIDKMFKGEKINTTENRSVLHVALRAPRDAVINSDGVNVVPEVWAVKDKIKQFSETFRSGSWVGATGKPLTNVVSVGIGGSFLGPLFVHTALQTDPEAAECAKGRQLRFLANVDPVDVARSIKDLDPATTLVVVVSKTFTTAETMLNARTIKEWIVSALGPQAVSKHMIAV

SEQ ID NO: 44107 - protein, 233 aa, Ostreococcus tauri
MSGDGDDDARALSREDLVYKAKLAEQAERYEEMMDCMSEVTLKSGEEELSVEERNLLSVAFKNVIGARRASWRIVSSIETKEEAKHGKDSDKCKLIASYKANVEKELTSICTRILDLLKNHLEDRCSAGESKVFYKKMKGDYWRYLAEFKGGAERKEAAEETLLAYKSAEQTARRSCNPERAGTRVPNGEESVSMKRSDSTLIMQLLRDNLTLWTSDMNDSQATGGAEEEDDE

SEQ ID NO: 44108 - protein, 117 aa, Flaveria trinervia
DESWCQGLDGLASRSAAYYQQGARFAKWRTVVSIPNGPSALAVKEAAWGLARYAAISQDNGLVPIVEPEILLDGEHGIDRTFEVAKKVWAEVFFYLAENNVMFEGILLKPSMVTPGA

SEQ ID NO: 44109 - protein, 277 aa, Candida albicans SC5314
MSLQKLTAEIYSLFGKGDYQGCQQLLAPIKLELVKHDLLVPLPSNTTDKNQINDLRIAQRILEIGALSSLLTNNYSGFENYFAQLRPFYSNPKLHNLQKVHINTDITKIISLYLLYLLSQGLISKFHVELEVIYNSSQYDAQQDKYLQFPINLESNLMEGNYIKIWKLLKEEKNLPCQEYTHFVDTLINALRFEIAKSLEKTYDSIPISNCKNLLYLPQELSDANFEKTLKETYQVDNWKFEDGVIYFTKNENETNVDNQSVIKNLLGYAEQIESIV

SEQ ID NO: 44110 - protein, 439 aa, Zea mays
  misc_feature (269)..(269): Xaa can be any naturally occurring amino acid
  unsure (1)..(439): unsure at all Xaa locations
MAAVAVSGGHWRRLRTLGRGASGAVVSLAWDAASGELVAVKSAGAIGAAALRREHAVLAGLRSPHVVRCVGGGDAAEEGSSYQLFLEYAPGGSLADEVARSGGSLGERAVRAFAADVLRGLAYLHARSVVHGDVKARNVLVGAGGRAMLADFGCARALSGSGSARRPIVGATPAFMAPEVARGEDQGPPADVWALGCTVVEMATGRAPFGGMGGAGGALAAVHRIGYTDAVPEVPAWLSPEAGDFLAHCFARDAADRWTAARLLEHPFXVAFARHDDKAPRPSPKSALDAAAFWESETESEDEASGSASERIESLACSAGALPDWDGEGGWIDVLGEHCGAPGKASSVLVAVPAGEMDVGGGLPSEDGLEAEEVPFGGGGVPVPVPAADASAGRHEKHCSSSDCHALSCQLVPCNLVFNAIKLWVPTKKNCKKKNNKKK

SEQ ID NO: 44111 - protein, 638 aa, Saccharophagus degradans 2-40
MTTDTLEKPRLSDTAQVDSQSIAPFPNSKKIYVQGSRPDIRVPMREINLSITPTEFGGEQNPPVRVYDTSGVYTDPNVKIDVRQGLPDVRSAWIAERGDTEVLQQKSSSFTQQRLHDASLDTLRFNHQRQPLKAKPRANVTQMHYARCGIITPEMEYIAIRENMSWQQAKEQGVLDQQHAGEHFGANIPDEITPEFVRSEVACGRAIIPANINHPELEPMIIGRNFLVKINGNIGNSAVTSSIEEEVAKLTWGTRWGADTIMDLSTGKNIHETREWIIRNSSVPIGTVPIYQALEKVDGVAEDLTWEIFRDTLIEQAEQGVDYFTIHAGVLLRYVPLTAKRVTGIVSRGGSIMAKWCLAHHRENFLYTHFEDICEIMKAYDVSFSLGDGLRPGSIADANDEAQFGELETLGELTKIAWKHDVQVMIEGPGHVPMHMIKENMDKQLRECGEAPFYTLGPLTTDIAPGYDHITSGIGAAMIGWYGCAMLCYVTPKEHLGLPNKDDVKEGIITYKIAAHAADLAKGHPGAQLRDNALSKARFEFRWEDQFNLGLDPDTARSYHDETLPKDSAKVAHFCSMCGPKFCSMKITQEVRDYAAEHGTDITPIAEDEVVRMIDVEAEMRKKSEEFREKGSEIYGKI

SEQ ID NO: 44112 - protein, 326 aa, Coxiella burnetii RSA 493
MTEIKKLIVLTSGGDAPGMNAAIRAVVRTALHYQFEVYGATAGFAGLVNGQVVPLNSRAVANCIQRGGTILKTGRFENFRFKAVRDKAREFLKKLQIDAMIVLGGNGSFAGASKLYQEGGPQMIGIPCTIDNDIQGTDYCIGFDTACNTALQAIDKIRDTAFSHERNFLIEVMGRSSGFIAVNVGIAGGAEIIALPEFHVDIDTLTQKIKKQHGKKSASIIVAAEANQPGHSFEVAKQIKEKTGIEYRVCVLGHTQRGGTPTVKDRVLASLMGAQAIEALKKGLTEKMIAYQNGKIAVAPLPDPDNGTRYFADEALLRVNNIICAM

SEQ ID NO: 44113 - protein, 591 aa, Oryza sativa (indica cultivar-group)
MAALRDVLLSIAQTPHRLRRRALVTWTPAQETSEVRDRSGARMKRRLEWYDLVGLGVGGMLGAGVFVTTGRVARDTAGPAVFASYVIAGVSALLSSFCYAEFSVRVPAAGGAFSYLRVTFGELVGFFGGANILMEYVLSNAAVARSFTDYLASTCGITEPDAWRIQVDGIAKGYNALDFPAVALILVLTLCLCYSTKESAMLNMVITVFHLLFFVFIILAGLWNGSARNLVSPHGLAPYGVRGVLDGAAIVYFSYIGYDSASTMAEEIRDPARALPVGIAGSVLVVSALYCLMSLALCAMLPYTEIAESAPFSAVFREKAGWEWAGSVVGAGASLGIVASLLVAMLGQARYLCVIARARLVPAWLAKVHPSTGTPMNATIFLDRANGSIKYTNNFTEVKVLTTVSDHENCNAGLCTASIALFTELQVVFEMISIGTLLVFYLVANALIYHRYAKLGANRSLHVLLFLLLLTLSSLGFSLSRRIHGQCRWGMALFGATSVTITAMFHCAVRRDMPEPPSEWMVPLMPWPAAASVFLNVFLMTTLKVMSFQRFGLWSFVIIVFYVCYGVHSTYSAEENEAVNAMIHHANMDIS

SEQ ID NO: 44114 - protein, 384 aa, Rickettsia sp. Chad
DSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKALGQLDNNPLLQIAIELEAIALKDEYFVERKLYPNVDFYSGIIYKAMGIPSQMFTVLL

SEQ ID NO: 44115 - protein, 602 aa, Medicago truncatula
MEKAEFVDMKLEAELQLVDGNKVDWKGRSALKFKYGGMKAALLMLVTLGLENLATFSLAVNSVPYFMGIMHYQLEDAANMLTNYMGVSYILSILVAIVADTWIGRYKSVLFSGFFEFLGLALLTVQAHYPSLKPKECNVNDITVHCKTPSRGQEAILFIGLYLLAFGSAGTKAALPSHGADQFDESDPKEEKKMSTFFNVLLLAVCMGGAVSLTFIVWIQINKGWDWGFGIGTIAIFLGTVIFAAGLPLYRIQVATGNSVLLEIIQVYVAAIRNRNLHLPEDPKELYEIEQDKEASEEIEFLPHRDIFRFLDKAAIDSKPDMQSGKSEAPSTSPWKLCRVTQVENAKILLSMVPIFCCTIIMTLCLAQLQTFSIEQGYTMDTKVTKHFHIPPASLPFIPIMFLIILVPIYDRIFVPVIRKFTGIPTGVTHLQRIGVGLILASVSMAVASIIEVKRKRVANDNNMLDALPVYQPLPISTFWLSFQYFIFGIADIFTYIGLLQFFYSEAPKGLKSTSTCFLWTSMALGYFLSTIVVKCINGATKHTKSGGWLIGNNINRNHLNLFYLFLSIVSLINFFVYLFVSKRYKYRPQGTKVSADGSSKE

SEQ ID NO: 44116 - protein, 508 aa, Brassica napus
  misc_feature (338)..(338): Xaa can be any naturally occurring amino acid
  misc_feature (344)..(344): Xaa can be any naturally occurring amino acid
  unsure (1)..(508): unsure at all Xaa locations
MAMANLARRKAYFLTRNVTSSHTDALKFSFSLSRGFASSGSDENDVVVIGGGPGGYVAAIKAAQLGLKTTCIEKRGALGGTCLNVGCIPSKALLHSSHMYHEAKHAFAHHGIKLASVEVDLPAMLAQKDNAVKNLTRGIEGLFKKNKVTYVKGYGKFLSPNEVSVETIDGGNTVVKGKHIIVATGSDVKSLPGITIDEKKIVSSTGALSLSEVPKKLMVIGAGYIGLEMGSVWGRLGSEVTVVEFAADIVPSMDGEIRKQFQRSLEKQKMKFMLKTKVVSVDASGDGVKLTVEPSEGGDQTTLEADVVLVSAGRTPFTSGLDLEKIGVETDKGGRILXVNERFXPNVSGGYAIGDVIPGPMLAHKAEEDGVACVEFIAGKHGHVDYDKVPGVVYTHPEVASVGKTEEQLKKDGVSYRVGKFPFMANSRAKAIDNAEGLVKILADKETDKILGVHIMSPNAGELIHEAVLAINYDASSEDIARVCHAHPTMSEALKEAAMATYDKPIHI

SEQ ID NO: 44117 - protein, 409 aa, Coxiella burnetii RSA 493
MNGFVVSAVLIGAFLGALFSGHLADYIGRKRLLIIDALIFIVGTAISSMTVSISWLVIGRIIVGIAIGIASYSAPLYISEISPPHRRGALVSLNQLAVTIGIFLSYVVDYYFARHDAWRSMFAAGVIPAALLLLGMIVLPYSPRWIFSRGHEEKALWILRKLRGHGPHAEQELEHIRASLQQQKGDWRTLFSKIIRPTLFIAIGLAVFQQVTGINTVLYYAPTILKMTGFQASQTAILATMGIGAVLVIITIISLPLIDSLGRRPLLFIGVGAMTVSLLVLSWSFKVHGHMDYMRWIAFGSLLVFISGFSISLGPIMWLMFSEIFPLRVRGLGASIGACTNWASNWLVTITFLTLIEYLGPSGTFFIYFIISVITLIFIYTSVPETKGVTLEQIEENLYAGKDMRYLGK

SEQ ID NO: 44118 - protein, 328 aa, Arabidopsis thaliana
MVSKKDKQIHSDHNPQDASPVEWAEIRHKLLAFQENIQSGSDIDARSDDPQMCGLYVSDIYEYLRELEVKPKLRPLHDYIEKIQEDITPSKRGVLVDWLVEVAEEFELVSETLYLTVSYIDRFLSLKMVNEHWLQLVGVSAMFIASKYEEKRRPKVEDFCYITANTYTKQDVLKMEEDILLALEFELGRPTTNTFLRRFIRVAQEDFKVPNLQLEPLCCYLSELSMLDYSCVKFVPSLLAASAVFLARFIILPNQHPWSQMLEECTKYKAADLQVCVEIMLDLYLSRSEGASKAVREKYKQHKFQYVAAIPVYQELPVTFWEDVVTIG

SEQ ID NO: 44119 - protein, 366 aa, Zea mays
SESEAASGRQGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLEEGAMCEPLSVGVHACRRAGVGPETGVLVVGAGPIGLVSLLAARAFGAPRVVVVDVDDHRLAVARSLGADAAVRVSPRAEDLADEVERIRAAMGSDIDVSLDCAGFSKTMSTALEATRPGGKVCLVGMGHNEMTLPLTAAAAREVDVVGVFRYKDTWPLCIDFLRSGKVDVKPLITHRFGFSQRDVEEAFEVSA

SEQ ID NO: 44120 - protein, 227 aa, Coxiella burnetii RSA 493
MSNPTHRVTAVFFDLDGTLLDTAPDLADALNQLLNKHGRDPLPLKVIRPTVAQGTRGILANGFSINQTDPRFNPLRDEFLSIYQSCLTNKTTYFDGMAEVLEYLDVHAIPWGVVTNKPGWLARPLLNHFKLTRRYRCLISGDQLANRKPHPEPLLFACKTVDVQPHTALYVGDTEGDIQAAKAAGMLAVAATYGYLSANSTPQDWKADALIKSPLELIDWLKGNENT

SEQ ID NO: 44121 - protein, 536 aa, Zea mays
MATRMKDVARRSTKKYVEEALYRRLFRKGSTPQAVREEVDGFLDSRKRAFKWEVGVCVRRMRRNALYRPSLKLSEVMARRGMNPTVSDQAIRLDLIAKSRGIAAAEKYFLDLPETSKTHLTYGALLNSYCKELMTEKAESLMEKMKELNFAFTAMSFNSLMTMYTKVNQAEKVPSIIQDMKADDVLPDVFTYNVWMRALAALKDIPGVERVIEEMKRDGRVAPDWTTYSNLASIYVEAGMFEKAEAALKELEKRNTSNDIEAYQFLITLYGRTQNLVEVHRVWRSLKRDNPRMANMSYLNMIQVLANLKDLSAAEACFKEWEARHIHPPKTNTKGSGADNTPGADPKSPSNPPNNQSGTKETGDGTAEDLQPKHPKYDIRVANAMIKAYITEGMLDKAVAMKKRAKMRGGRLNAKTWEIFMEHYLKTGDLKMAHWCADRAMKKGHSSGRIWVPPPAVTETLMSYFEENKDVDGAERYVGALKKVQKDLGAPVFEPLVRTYAAAGKKFPGMRQRLKIENVEVGEGTAQLLDSICADQ

SEQ ID NO: 44122 - protein, 287 aa, Bacillus subtilis
MYDTIVIGAGQAGISIGYYLKQSDQKFIILDKSHEVGESWKDRYDSLVLFTSRMYSSLPGMHLEGEKHGFPSKNEIVAYLKKYVKKFEIPIQLRTEVISVLKIKNYFLIKTNREEYQTKNLVIATGPFHTPNIPSISKDLSDNINQLHSSQYKNSKQLAYGNVLVVGGGNSGAQIAVELSKERVTYLACSNKLVYFPLMIGKRSIFWWFDKLGVLHASHTSIVGKFIHKKGDPVFGHELKDAIKQKEIILKKRVIAAKQNEIIFKDSSTLEVNNLFGLLVSGIPYVG

SEQ ID NO: 44123 - protein, 309 aa, Triticum aestivum
MEKYEKLEKVGEGTYGKVYKAQDKATGQVVALKKTRLEMDDEGIPPTALREISLLRLLSSSLYVVRLLAVEQATKGGGAGGGGKPVLYLVFEFLDTDLKKFVDAYRRGPAPKPLPTQVVKSFLYQLCKGIAHCHGHGVLHRDLKPQNLLVDKEKMILKIADLGLSRAFTVPMKSYTHEIVTLWYRAPEVLLGATHYSTSVDIWSIGCIFAEMVRKQALFPGDSELQQLLHIFKLLGTPTEEDWPGVTALRDWHEFPQWKAQRLTRAVPTLEPEGIDLLSKMLQFDPANRISAKAALEHPYFNSLDKSQF

SEQ ID NO: 44124 - protein, 744 aa, Hevea brasiliensis
  misc_feature (642)..(642): Xaa can be any naturally occurring amino acid
  misc_feature (645)..(645): Xaa can be any naturally occurring amino acid
  misc_feature (659)..(659): Xaa can be any naturally occurring amino acid
  unsure (1)..(744): unsure at all Xaa locations
MEACNCIEPQWPADELLMKYQYISDFFIALAYFSIPLELIYFVKKSAVFPYRWVLVQFGAFIVLCGATHLINLWTFTMHSRTVAIVMTTAKVLTAAVSCATALMLVHIIPDLLSVKTRELILKNKAAELDREMGLIRTQEETGRHVRMLTHEIRSTLDRHTILKTTLVELGRTLALEECALWMPTRSGLELQLSYTLRQQNPVGYTVPIQLPVINKVFSCNRAVKISPNCPVARIRPFAGKYMPGEVVAVRVPLLHLSNFQINDWPELSTKRYALMVLMLPSDSARQWHAYELELVEVVADQVAVALSHAAILEESMRARDLLMEQNVALDLARREAETAIRARNDFLAVMNHEMRTPMHAIIALSSLLQETGLTPEQRLMVETILKSSNLLATLINDVLDLSRLEDGSLQLDLGTFNLRAVFREVLNLIKPIASVKKLPVTLNLAPDLPEYAIGDEKRLMQTILNVVGNAVKFSKEGNISITAFVARPESLRDLRFPDFFPVPSDDHFYLRVQVKDEGLGINLQDIPKLFTKFAQNQSLATRNSGGSGLGLAICKRFVNLMEGHIWIESEGLGKGCTAIFVVKLAILECSNESKHPFMQNGPKPNQGAKQTSFMGPESSLLMDDTGGYQDGNKRTFWGTLXCDXTTVSSSDECLRVVXLDHKVVFMDVCMPDGLELLSAYMKDFTKRHERPLIVALYWNANKVTKENCMKVGMDGVILKPVSVDKMRGVLSDLLEHRVLFEAM

SEQ ID NO: 44125 - protein, 268 aa, Kitasatospora putterlickiae
MPAAGPPISGRTRLFAVLGDPVAQAKAPALLNPLFAASGVDAVLVPVHAPADRLDEVVRGLKAVANLDGLLVTVPHKLAMCGHADELSDAAALLGSTNALRREPDGRWYGDNFDGAGFVRGLAAAGHHPAGLRVALAGAGGAGLAIAAALLTEGAAALTVTDPDRGRVDALLERLGTRWPGRVAAAPRPPSGVDLAVNATPLGLDPADPLPFDPAPLAPGALVADIIMTPAETPLLRAAAALGLATHPGIHMLTEQLPLYRSFFRLPG

SEQ ID NO: 44126 - protein, 467 aa, Ostreococcus tauri
  misc_feature (1)..(1): Xaa can be any naturally occurring amino acid
  unsure (1)..(467): unsure at all Xaa locations
XLHLTGDIHAIGVATNLVAAAIDARVFHEETQSDEALWKRLIPKKKDGSSAFSAIMFKRLKRLGIDKTNPDDLTEEERSKFVRLDIDRERITWRRVVDMNDRFLREITVGESPTEKGKTRKTGFDITVASEIMAVLAMTTSLADMEHRLGAMVVGPDRQGGPVTCDDLGVTGAVMALMKDAIKPTLMQTLEATPVLVHAGPFANIASGNSSIIADQIGLSMVGKGGFVVTEAGFGADIGLEKFVNLKCRKSGLKPNCAVIVATVRALKCHGGGPPVTAGKPLDHSYTNENVDMVRDGMCNLLSIAAGAEDAVLCTHHAKGGAGAVELANAVKAACEKNEDCKDFKFGYDTNLDIASKIEAVAKNIYKASGIELSEKAQEKIALYTKQGFGDLPICMAKTQYSFSHDQNLKGAPSGFTLPIGDVRLSAGAGFLVPLVGAFPTIPGLPTRPAYYEIAVDAESGNVLGLS

SEQ ID NO: 44127 - protein, 197 aa, Streptococcus pneumoniae R6
MTMELNTHNAEILLSAANKSHYPQDELPEIALAGRSNVGKSSFINTMLNRKNLARTSGKPGKTQLLNFFNIDDKMRFVDVPGYGYARVSKKEREKWGCMIEEYLTTRENLRAVVSLVDLRHDPSADDVQMYEFLKYYEIPVIIVATKADKIPRGKWNKHESAIKKKLNFDPSDDFILFSSVSKAGMDEAWDAILEKL

SEQ ID NO: 44128 - protein, 798 aa, Oryza sativa (japonica cultivar-group)
MQLDINNRSWEGDTRSKFASAMNGIAASATYQDPSLPSLVPYMTSRIFISNYTYSFPISPGRIFVRLYFYPVAYGYYASEDAYFGVKTNNLILLDNFNASQTAQAANYAYILREFSLNVTLGSLDLTFFPSTQNGSYAFVNGIEIVPTPDIFTTRTPTHNTEGNLDPSDIDSMTSFQTMYRLNVGGQAIIPQGDSRFYRSWEDDSPYIYGAAFGVTFGKDSNVTITYPGTMPNYTAPADVYATARSMGPNWQINLNYNLTWILSVDAGFYYLLRFHFCEIQYPITKMNQRSFFIYINNQTVQDQMDVIRWSGGIGMATYADYLIVTVGSGQMDLWVALHPDLSSRPQYYDAILNGLEVFKLWDIGKKNLAGLNPPLPPQPKTDVNPKGVSGGGKLKAAVPAAICAVVVLITACFCVCIICRRKKVAKHSGKTDKKCLTYQTELYKSPSNLCRNFTFHEMQIATSSFDETLLLGRGGFGDVYRGEIDNGTTVAIKRSNPLSLQGVHEFQTEIETLSKVRHGHLVSLIGYCQEKNEMILVYEYMARGTLREHLYSTKRPPLPWKERLKICIGAARGLYYLHTGPKETIIHRDVKTANILLDDKWVAKVSDFGLSKVNPDIDATHVSTVVKGTFGYFDPEYFRLKQLTQRSDVFSFGVVLFEILCARPPVNTELPEEQVSLREWALSCKKIGTLGEIIDPYLQGEIAPDCLKKFADCAEQCVADRSIDRPEMGDVLRNLEVALKMQECAENNSKFSEETTSSKTTPDMMTIMDTDKQSTYSTMSITGQRTIFSDMMDPQAR

SEQ ID NO: 44129 - protein, 803 aa, Oryza sativa (japonica cultivar-group)
MQLDSNNRSWDGDTSSTFAPSVKGLAARASYQDPSLPSLVPYMTSRIFISNYTYSFPVIPGRMFVRLHFYPVAYGNYASRDAYFGVTTNNLTLLDNFNASQTALAAKYAYILREFSLNVTSGSLDLTFFPSTQNGSYAFVNGIEIVPTPDIFTTLSPIPPTNGNPDPSDIDSMISFQTMYRLNVGGMTISPQGDSMFYRSWENDSPYIYGSAFGVTFSKDSNVTITYPSTMPNYIAPADVYGTARSMGPIAQINLHYSLTWILPVDAGFYYLLRFHFCEIEYPITKVNQRSFFIYINNQTVQEQMDVIVWSGGIGITTYTDYVIVTVGSGQMDLWVALHPDLSSGPEYYDAILNGLEVFKLQDIGKKSLAGLNPPLPPQPKSDVNPKGVSGGGKSKGAVPASIRGAMGSTATMLIACFSVCIICRLKKVAKHSFMTDKKCMTYRTEFYHSPSNLCRNFTFDEIQVATRNFDESLLLGRGGFGDVYRGEIDNNGENVAIKRSNPLSVQGVHEFQTEIELLSKLRYCHLVSLIGYCKEKNEMILVYEYMAQGTLREHLYNSNKPSLPWKQRLKICIGAARGLHYLHMGANQTIIHRDVKTANILLDDKWVAKVSDFGLSKANPDIDSTHVSTVVKGTFGYLDPEYYRRKQLTQKSDVYSFGVVLFEILCARPAVNIELPEEQASLRDWALSCQKKGMLGKIIDPHLHGEISPPCLRMFADCAKQCVADRSIDRPLMSDVLWSLEAALKLQENAENNKKFSEATTSSKRTPDLITIMGTDKPSTYSTMSITGQKIIFSDMMHPQGR

SEQ ID NO: 44130 - protein, 816 aa, Burkholderia vietnamiensis G4
MSSPETSRPAEASAPLAAIVIGAGFAGIGMAVALQRAGIHDFVIVERSHDVGGVWRDNRYPGAACDVPSHLYSFSFEPNANWSRVFAPQPEIHAYLQHCARKYGLARHLRFGAEVEHARYDEAGALWRVALADGTTLSAAVLISGTGQLSRPALPKLPGIDTFRGRAFHSAQWDRDYPLAGKRVAVVGTGASAIQFVPAIAGDVARLLVFQRSPAYVLPRPDRPYRRWERTLFRRLPGAMKLHRASIYLRYESRAIAFTRLHGLMDFAVGRPFRKLLARDVRDPALRSKLTPDYPIGCKRILLSSDYLAALGRDNVELVTRGIRRVTETGIETDDGVHHQVDAIVYGTGFAATEFLSPMRITGRDGLDLNDAWRRGAQAYLGVTVPGFPNFFMLYGPNTNLGHNSIVYMLESQIAHVMRCLRAMQRDGASAIDVDPRRYRRYNAHVQQRLEGSVWSGCKSWYVDASGHNSTNWPGFTLSYRWITRFTGLSAYRFSRPLAGDTAPTQAVVVAPPAGRVEALAAASLRGFLRAAFRPLIGPPFGARVQRRVVAMLSPLMPGAGGTLRYRTAAAGVPVEVIAPKRGDAGGVILYLHGGAFCVGSPRTHRSVTTRLAAEAGLPVWAPDYRLAPEHPSPAAVDDALAAYEALRAQGYAPHRIVIAGDSAGGALALALAMALRERGEPAAAALLLISPVTDAALGGATLASRRHDDPMIRRGWLEQGLRWYHGAGAGASRGPLDADLRGLPPMLVQVGDQEVLLSDAQRLAAHARACGVPCRLEIHAARWHVFHLQAFYLQSARDALRTLAGFAAQRVAAPV

SEQ ID NO: 44131 - protein, 238 aa, Kitasatospora putterlickiae
MPIDQPAATAPTTRPDGHALAAFLPLRAVVFDLDGVIVDSFDVMRRAFLTAYEEVVGDGNPPFEEYSRHLGRYFPDIMRIMGLPLALEEPFVRESYRLAPQVTVHAGARELLIDLNRRGVRLAVATGKSGPRARSLLDQLGLLHHFDHVLGSDEVPRAKPAPDIVLRALELLDVPAERTVMVGDAVTDLASARGAGVGAIAALWGETDEAALLAERPDAVLRRPGDLLALLPEPVPAH

SEQ ID NO: 44132 - protein, 518 aa, Ostreococcus tauri
MVLRPHAGSHSLTMTHADRSRGPVSQTHTRTILEGSKPWVPRGRAPRRSRFARPRSSMAVTRARPRWATARPTRGRPTRWNGARGRPTRAGPGNGVDETLRFLTANDVVKVAEAHGTPTYVYDAPTLEARAAVAKGFPNAYGLTVRYAMKASPNAAILKIFKKAGLHVDASSGYECERAMRAGFAGDEISLSTQELPSFFPELVEKGVRINACSLDQLERFGAAFPGGEIGVRFNPGLGSGGTGKTNVGGPSSSFGIWYELLPRVKEIVAEYNLKVVRVHTHIGSGSDPAVWQKVSGMSLDLCREFPDVTTLNLGGGYKVGRMSYEKSTDLAVVGVPVKEAFEKFAEETGRKLKLEIEPGTFLLANSCAVVTRVQDKVTTGTAEGHTFLKLDCGMTEVLRPSLYGSQHPLVSVTKDGTLPETQAEYVVVGHCCESGDLMTPAPDEPETISERTMGEVNIGDFIVIEGSGAYCAGMASKNYNSFPEAPEVMRRGAGDMVCIRRKQTLDQILSNEIDYAA

SEQ ID NO: 44133 - protein, 900 aa, Caulobacter crescentus CB15
MNSKMPVETLTKAQWVYAFGGGGADGDASMKNLLGGKGANLAEMSSLGLPVPPGFTITTEACVHYYANGKQYPAELAEQVQAGLAKIEEITGKQFGDVTNPLLVSVRSGARASMPGMMDTVLNLGLNDETVEGLAKLSGDRRFAYDSYRRFIQMYSNVVLNLEHHMFEEILDDHKDRLDVNVDTGLTADDWAAVIKDYKAAVREQLGKPFPQDAQEQLWGAVGAVFASWMNDRAKFYRRMHDIPESWGTAVNIQSMVFGNMGETSATGVAFTRNPSNGDNRLYGEFLINAQGEDVVAGIRTPQSLTKAAREEMGDTAPSMEEAMPEVFGQFKTVVETLERHYRDMQDIEFTVEQGKLYMLQTRNGKRTAKAALKIAVDMAAEGVISTSEAVGRVEPASLDQLLHPTIDPSAHRDVIAKGLPASPGAATGKIVFNSDAAEKAAANGESVILVREETSPEDIHGMHAARGIITARGGMTSHAAVVARGMGRPCVSGAGDVAIFEKEGLFRVRGRDFRAGEIITIDGSTGDILAGAPKMIEPELTGDFATLMGWADQVRRLKVRANAETPLDAKTARQFGAEGIGLCRTEHMFFDDTRIAAVREMILADDEKGRRAALAKIAPFQKADFVELFTIMEGLPVTIRLLDPPLHEFLPHTEEDVQAVAVATGLDAAKLMRRAKELHETNPMLGHRGCRLGVSYPEIYEMQVRAILEAACEVKKAGKQPPAPEIMHPLVAKGEEMKYLRDLTDRVAKAVLEEQGVALEYTVGTMIELPRAALRAGDLAANAEFFSFGTNDLTQTTFGISRDDAGKFLNAYIEKGIFEKDPFVSLDQDGVGDLIRIAAERGRAVRPNVKLGICGEHGGDPASIGFCEKVGLDYVSCSPYRVPIARLAAAQAAMANKVE

SEQ ID NO: 44134 - protein, 556 aa, Coccidioides immitis RS
MTSDYKLKDLASLADLKDGEKREVSIEGLEEAKLLFVKLDGQVHALTARCTHYGAPLVKGVLTPDGRITCPWHGACFNVTTGDIEDAPAPNALEKFDVFEKDSAVYVKADAEALKRNGRQPINQCSIVGDDRIVIIGGGSGTFGAVEALREQGFKGKITIISREPNPPLDRTKLSKALIPDASKLLLRPAQWYASVGIDLVSDNATAVDFDKKTVSTDSGKSFPYTKLILATGGVPRRLPMPGIKDLGNVFVLRFVTDVQEILNAVGDKNKNIVIIGSSFIGMEVGNALSKENKVTIIGMESAPLERVMGAKVGKIFQRLLEKQGVNFHMSASVEKASPSEKDPSKVGAVHLKDGTVLPADLVILGVGVSPATEFLKSNEAVTLEQDGSLKTDESFAVNGLKDVYAIGDIATYPYHGPGAGQGDRTHVRIEHWDVAQNAGRSVGFTLAHALASPPKEVRPKAFIPIFWSALGQQLRYCGNTMNGWDDVILTGDPDNFKFAAFYTLGDTVVASASMNMDPLNSKCAELMRRGNMPTKKELEKGLDILSLDLPSTIRM

SEQ ID NO: 44135 - protein, 543 aa, Oryza sativa (japonica cultivar-group)
MRRGKAALWRPRHGEGETSRRGGDGDGEAADRLSALPDGVLHHVMSFLKAWEVVRTCVLSRRWRNLWASAPCVDLRIRYFRLDSEPPEEPRDFVNRLFRRREASAPVDTLRLQLSDPDNLFDNDDANAWIRTAIKRNARFIHLTGHRKEIGVLKHRALVSTHLKILKLSYVLIDDKILKQLSSGCKSLEELDLKDCVMTGHQISSASLKTLKMDRCKINVDLSITAPNLVFLNIVTPYIRVPSFKNLESLVTCSIILDDLFLGDDYQHISDEDDIDETTDDDDFGYQKNDKAGYRINYAKKGFVFGGNEDGYGYGSDIESDDNTYEYSEIANECGELQYGNNGDGHNSSKDGEYDNAETFGGQNVIHSLSNVRSLELLAGAGEVVLSRELKSCPIFINLKTLSLGEWCMDAEFDALVFLLQRSPNLERLFLEPQLNFNTRKALESGVKPTGRSFTCKDLQMVKIRCSKDDARVHMLAHLFRANGIPFDKIYVHRSGSSRLRSEKVMRDLAKQELEFWGSDEFWGSDYEYCGPDPEFGDSDLEF

SEQ ID NO: 44136 - protein, 710 aa, Pisum sativum
MQSFCDAVTDAVRAIDPKYLKEGEHVLVGLEGPFVSRRVTPRDLLSEFIGSMVCVEGIITKCSLVRPKVVKSVHFCPTTGSFTSRDYRDITSNLGLPTGSVYPTRDENGNLLVTEYGLCKYKDHQTLSMQEVPENSAPGQLPRTVDVIAEDDLVDSCKPGDRVAIVGIYKALPGKSKGSVNGVFRTVLIANNVALLNKEANAPIYSTEDLKNIKKIAERDDTFDLLGNSLAPSIHGHSWIKKAVILLMLSGVEKNLKNGTHLRGDINMMMVGDPSVAKSQLLRAIMNIAPLAISTTGRGSSGVGLTAAVTSDQETGERRLEAGAMVLADRGVVCIDEFDKMNDQDRVAIHEVMEQQTVTIAKAGIHASLNARCSVVAAANPIYGTYDRSLTPTKNIGLPDSLLSRFDLLFIVLDQMDPDIDRQISEHVLRMHRFRSAIDGGEAAHDGSARYGKKEEADTESSVFVKYNRMLHGKKTDRGRKRDTLTIKFLKKYIHYAKHRIQPDLTDEASDQIATAYAELRNANSNAKTGGTLPITARTLETIIRLSTAHAKLKLSRKVTKSDVDAALKILNFAIYHKELTEMDEREEEREKEREREQERKRKADAENNGPDRGSKSKRDSTSEAMELDDTSAAPPAVGLTPERIEAFNSLFGQHMRANPLDQISIADIEDVINRGADSTYSSADILLLLEKLQEDNRLMIVAGMVHMIS

SEQ ID NO: 44137 - protein, 542 aa, Agrobacterium tumefaciens
MIKTIKTTPYQDQKPGTSGLRKKVPVFAQENYAENFIQSIFDALEGFEGQTLVIGGDGRYYNREVIQKAIKMAAAAGFGKVLVGQGGILSTPAASNVIRKYKAFGGIVLSASHNPGGPTEDFGIKYNIGNGGPAPEKITDAIYARSKVIDSYKISDAADIDLDKIGSFKVDELTVDVIDPVADYAALMEELFDFGAIRSLIAGGFKVVVDSMSAVTGPYAVEILEKRLGAPKGSVRNATPLPDFGGHHPDPNLVHAKELYDDVMSPEGPDFGAASDGDGDRNMVVGKGMFVTPSDSLAIIAANAKLAPGYAAGISGIARSMPTSAAADRVAEKLGLGMYETPTGWKFFGNLMDAGKVTICGEESFGTGSNHVREKDGLWAVLYWLNIVAARKESVKDIVTKHWAEYGRNYYSRHDYEEVDSDAANTLVAILREKLATLPGTSYGNLKVAAADDFAYHDPVDQSVSKNQGIRILFEGGSRIVLRLSGTGTAGATLRLYVERYEPDAARHGIETQSALADLISVADTIAGIKAHTADSEPTVIT

SEQ ID NO: 44138 - protein, 707 aa, Thermobifida fusca YX
MNTGTPKTLDWSDLDRRTVDVVRALAMDAVEEAGSGHPGTAMSLAPVAYLLFQKVMRHDPTDPKWIGRDRFVLSCGHSSLTLYIQLYLAGYGLSLNDIKRLRQWGSLTPGHPEYGHTAGVETTTGPLGQGIGNAVGMAMAARRERGLFDPDTPIGESPFDHYIYVLCSDGDVQEGISHEVSALAGTQKLGNLIVIWDDNRISIEDDTQIAFTEDVVARYAAYGWHVQEVEWVGEDGSYHEDVAALYDAIRAAQAETERPSFIRLRTIIGWPSPNKQNTGAIHGAALGAEEVAATKRVLGLNPEAQFDVPNELLEHARGVVARGRAARQEWEALFAKWRANAGERAELFDRLMAGSLPDGWEKAIPTFEPSAKGMATRKASGEVLSAIAPVLPELWGGSADLAGSNNTTPKGEPSFIPEERSTKAFSGHRYGRVLHFGIREHGMGAILNGIALHGPTRPYGGTFLVFSDYMRPSVRLAALMKLPVTYVWTHDSIGLGEDGPTHQPVEHLWSLRAIPGLAVVRPADANETAVAWRTILERNDGPVALALTRQSVPVLDRSELASAELVSRGGYILAEASNGRPEAIIIATGSEVQIALEARSRLEESGTPTRVVSMPCLEWFNEQDDAYRQQVLPPSVRVRVSVEAGVALGWRELVGEYGESVSLEHFGASAPYATLYEQFGLTADRVVAAVHSSAAKLGGDRGSTTGN

SEQ ID NO: 44139 - protein, 1166 aa, Capsella rubella
MKQKWLFVLILCFFTALGIHGKRLINSDFDETALLMAFKQFSVKSDPNNVLGNWIYESGRGSCSWRGVSCSDDGRIVGLDLRNGGVTGTLNLANLTALPNLQNLYLQGNYFSSSSGGDSSSGSYCYLQVLDLSSNLISDYSLVDYVFSKCSNLVSVNFSNNKLVGKLGFAPSSLKSLTTVDFSYNILSEKIPESFISEFPASLKYLDLTHNNFSGDFSDLSFGMCGNLSFFSLSQNNISGVKFPISLPNCRFLETLNISRNNLAGKIPGGEYWGSFQNLKQLSLAHNRFSGEIPPELSLLCKTLETLDLSGNALSGELPSQFTACVWLQNLNIGNNYLSGDFLSTVVSKITRITYLYVAFNNISGSVPISLTNCTNLRVLDLSSNGFTGNVPSGLCSQQSSPVLEKLLIANNYLSGTVPVELGKCKSLKTIDLSFNELTGPIPKDVWMLPNLSDLVMWANNLTGSIPEGVCVKGGKLETIILNNNLLTGSIPQSISRCTNMIWISLSSNRLTGKIPTGIGNLSKLAILQLGNNSLSGNVPRQLGNCKSLIWLDLNSNNLTGDLPGELASQAGLVMPGSVSGKQFAFVRNEGGTDCRGAGGLVEFEGIRAERLERFPMVHSCPATRIYSGMTMYTFSANGSMIYFDISYNAVSGLIPPGYGNMGYLQVLNLGHNRITGNIPDSLGGLKAIGVLDLSHNDLQGYLPGSLGSLSFLSDLDVSNNNLTGPIPFGGQLTTFPVSRYANNSGLCGVPLRPCGSAPRRPITSSVHAKKQTLATAVIAGIAFSFMCLVMLFMALYRVRKVQKKELKREKYIESLPTSGSCSWKLSSVPEPLSINVATFEKPLRKLTFAHLLEATNGFSAETMVGSGGFGEVYKAQLRDGSVVAIKKLIRITGQGDREFMAEMETIGKIKHRNLVPLLGYCKVGEERLLVYEYMKWGSLETVLHEKSSKKGGIFLNWTARKKIAIGAARGLAFLHHSCIPHIIHRDMKSSNVLLDEDFEARVSDFGMARLVSALDTHLSVSTLAGTPGYVPPEYYQSFRCTAKGDVYSYGVILLELLSGKKPIDPGEFGEDNNLVGWAKQLYREKSGTEILDPELVTEKSGDAELFHYLKIASQCLDDRPFKRPTMIQVMAMFKELKADTEEDESLDEFSLKETPLVEESRDKEP

SEQ ID NO: 44140 - protein, 429 aa, Nostoc punctiforme PCC 73102
MISKSLLPLEPASPAHICPFDQACSYLEAAAKELNLNQGLLEILSHPRKVVTVSIPVKLDDGEIQVLAGHRVQHSDVLGPYKGGIRYHPAVTLREVSALAMLMTWKCALLGIPYGGGKGGIPIDPKRYSVGELERISRRYISELLKDIGPSVDIPAPDMGTSAREMAWMMDTYSVNVGHAVPGVVTGKPLSIGGSLGREMATGRGTMIIVREALADRGKSLVGVRVAIQGFGNVGGAAAELLHQAGAKIIAVSTGAGGIFSEAGLDIPALKIYAAENRKSIVGFPQSVPISNADLLTLPCDVLIPAALENQITGENVNQVQAQIVAEAANGPVTLEANLALEARGVTVLPDILANAGGVVVSYLEWVQGLSYVFWDEERVNREMEHLMVQAYRKVIQQSNKRQISLRLAAYTLGVGRVAQALTDRGLYP

SEQ ID NO: 44141 - protein, 525 aa, Shigella flexneri 2a str. 301
MTENIHKHRILILDFGSQYTQLVARRVRELGVYCELWAWDVTEAQIRDFNPSGIILSGGPESTTEENSPRAPQYVFEAGVPIFGVCYGMQTMAMQLGGHVEASNEREFGYAQVEVVNDSALVRGIEDALTADGKPLLDVWMSHGDKVTAIPSDFVTVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVLDMFGDHFGLNIVHVPAEDRFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 44142 - protein, 521 aa, Solanum tuberosum
MAASIGALKSSPSSNNCINERRNDSTRAVSSRNLSFSSSHLAGDKLMPVSSLRSQGVRFNVRRSPMIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIII

SEQ ID NO: 44143 - protein, 259 aa, Streptococcus pneumoniae R6
MKKEVCEMSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 44144 - protein, 519 aa, Triticum aestivum
  misc_feature (207)..(207): Xaa can be any naturally occurring amino acid
  unsure (1)..(519): unsure at all Xaa locations
MAVAGAPPVLQLLPQQWQLILAILLVPLGFLLLRGRSGSGLKLPPGPMRLPFVGNLHQIGPLPHRSLAALARRHGPVMMLRLGMVPTVVLTSPEAAREALKTKDDDCSSRPLSAGPGLLSYGYKDVAFSPWSDYVREMRKLFIIELLSRRRVQSAYYARDAQIDKLIETLTVVGPNPVPLEAHIFATMDRIVGLFAFGESYAGEQFXGQFVPLLNATMDMLGSFSAQDFFPNAVGRLIDRITGVKAHRQRVFRQLDRFFEHIIEQCDGRKATGGGGSDLVQELLDIMKRPAASAAGTFTRDHVKAILMNTFIGSIDTTTVTITWAMAELIRKPRVLQRAQLEIRTAAGGGSRVHQADMPKMSYLRMVLSETLRLHPPATLLVPRETLRPIQVAGYDIPAKTQVIVNAWAISRDPSAWKDPEEFNPERFQDTDVDFNGSHFEFIPFGAGRRICPGLAMGVANAEYILANLLYCFNWALPNGVSREGVNMEEEGVLTYRKKTSLMLVPTPYHPAQEKEEEY

SEQ ID NO: 44145 - protein, 470 aa, Solanum tuberosum
NKIKPGVAYSVITTENDTQTVFVDMPRLERRRANPKDVAAVILGGGEGTKLFPLTSRTATPAVPVGGCYRLIDIPMSNCINSAINKIFVLTQYNSAPLNRHIARTYFGNGVSFGDGFVEVLAATQTPGEAGKKWFQGTADAVRKFIWVFEDAKNKNIENIVVLSGDHLYRMDYMELVQNHIDRNADITLSCAPAEDSRASDFGLVKIDSRGRVVQFAEKPKGFDLKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGIIIILEKATIRDGTVI

SEQ ID NO: 44146 - protein, 859 aa, Oryza sativa (japonica cultivar-group)
MAADNNSTASAPIFLNCGASGVQPDSYNRSWDGDASSKFAPSVKGNVARASYQDPSLPSPVPYMTARFFTSNYTYSFPVSPGRMFVRLHFYPTNYNGNLDSANAYFGVTTNNLILLDNFNASQTALATSSAYFFREFSVNVTSSSLKLTFAPSTRNGSYAFVNGIEIVPTPDIFTTPTPTSANGGDNVQYGIDPVMGLQTMYRLNVGGQPISPQGDSGFYRSWDNDSPYIYGAAYGVTFSKDGNVTIKYPNTEPNYTAPVAVYATARSMGPTAQINLNYNLTWILPVDAGFTYLLRFHFCEIQYPITKVNQRSFFIYINNQTAQNQMDVIVWSGGIGRTTYTNYVVTTVGSGQTDLWVALHPDLSSKPEYFDAILNGLEVFKLQDLGRNNLAGLNPPLPPKPGVNPNGGSSRGKSKSVAPAAIGGAVGGLAVLLIACVGLCIICRRKKKVAKDTGKSDEGRWTPLTDFTKSQSATSGKTTNTGSHSMLPANLCRHFSFAEIQAATNNFDKSFLLGKGGFGNVYLGEIDSGTRVAIKRGNPLSEQGVHEFQNEIEMLSKLRHRHLVSLIGYCEDRNEMILVYDYMAHGTLREHLYNTKNPPLSWKQRLEICIGAARGLYYLHTGAKQTIIHRDVKTTNILLDDKWVAKVSDFGLSKAGPNVDNTHVSTVVKGSFGYLDPEYFRRQQLTEKSDVYSFGVVLFEVLCARNALSPSLPKEQVSLADWALRCQKKGVLGEIIDPLLKGKIAPQCFLKFAETAEKCVADRSVDRPSMGDVLWNLEFALQLQESTEDSSSLTEGTSASTSPLVVARLHSDEPSTDVTTTTTTTTSLSITDRSIASVESDGLTPSNIFSQLMTPDGR

SEQ ID NO: 44147 - protein, 176 aa, Streptococcus pneumoniae R6
MKERKKMNLKDYIATIENYPKEGITFRDISPLMADGNAYSYAVREIVQYATDKKVDMIVGPEARGFIVGCPVAFELGIGFAPVRKPGKLPREVISADYEKEYGVDTLTMHADAIKPGQRVLIVDDLLATGGTVKATIEMIEKLGGVMAGCAFLVELDELNGREKIGDYDYKVLMHY

SEQ ID NO: 44148 - protein, 373 aa, Candida glabrata CBS 138
MVDLNGISPKNKGYYVALGLEGSANKLGVGVIKQFVDGSPTEIVSNIRDTYITPPGEGFLPRDTARHHKNWCVRLVKRALAEAGVTPGQLDAICFTKGPGMGAPLHSVVIVARTVSLLWDVPLVPVNHCIGHIEMGREITGAQNPVVLYVSGGNTQVIAYSNQKYRIFGETLDIAIGNCLDRFARTLKIPNDPSPGYNIEQMALKCKNKERLVELPYTVKGMDLSLSGILAYIDSLAKDLFRKNYSNKLLFDKKTHEQLVTVEDLCYALQETLFSMLVEITERAMAHVNSAHVLIVGGVGCNLRLQEMMEQMCMDRANGHVYATDERFCIDNGVMIAQAGLLQYRMGDYVKDFKETVVTQKFRTDEVLVSWRD

SEQ ID NO: 44149 - protein, 428 aa, Vibrio cholerae O1 biovar eltor str. N16961
MMMDLAFDRCHIWHPYTSTLTPLTCYPVSRADGVMITLEDGRSLVDGMSSWWAAIHGYNHPKLNQAAHQQIEQMSHIMFGGLTHQPAIELCQKLLKLAPNNLQQVFLADSGSVAVEVSLKMALQYWHSKGQPRAKFLTLRHGYHGDTFAAMSVTDPDNSMHSLYKGFLPEHIFANSPEGGFFDAWDERDIADFRHKLTEHHHQIAAVILEPIVQGAGGMRIYHPEFLRQVRALCDEFGVLLILDEIATGFGRTGKLFACEHAGIQPDILCVGKALTGGYMTLSATLTTQQVADTVCAGEAGCFMHGPTFMGNPLACAVASASLSLIEQGDWQQQVANIEAFFAEQLPKLNDSPRVKQTRWLGAIGVVETHLPVNMEVIQALFVEHGVWIRPFGRLIYLMPPYISQPEHLQKLVDAMAAALNQPDCFKQ

SEQ ID NO: 44150 - protein, 314 aa, Glycine max
MEKYEKLEKVGEGTYGKVYKAREKASGSLVALKKTRLEMDEEGVPPTALREVSLLQLLSQSIYIVRLLSVEHVDKVPKSQKSSSNPLTKPILYLVFEYLDTDLKKFIDSHRKGPNPRPLPPPLIQSFLFQLCKGVAHCHSHGVLHRDLKPQNLLLDQHKGILKIADLGLGRAFTVPLKSYTHEIVTLWYRAPEVLLGSTHYSTGVDIWSVGCIFAEMVRRQALFPGDSEFQQLIHIFKMLGTPTEENWPGVTSLRDWHVYPRWEPQSLAKNVPSLGPDGVDLLSKMLKYNPSERISAKAALDHPYFDSLDKSQF

SEQ ID NO: 44151 - protein, 113 aa, Arabidopsis thaliana
MAALSTTFYYHPLCTNHRTKRQASSRHGVRSMRVMSCRKQKLPEENEGVIQRTLRRMISEAGKIGKNLKPEKKKGDVKDLMLMSLSFAVYVYISQLLVCAYFSWQHLSFPKSS

SEQ ID NO: 44152 - protein, 569 aa, Caulobacter crescentus CB15
MARILITSALPYINGIKHLGNLAGSMLPADVYARFKRAQGHETLYICATDEHGTPAELAAAAAGQDVATYCAEQHVLQHEVGRAFGLSWDHFGRSSSPQNHRLTQHFCQALEDHGLIEERVDQMVYSVDDKRFLPDRYVEGTCPHCKFEKARGDQCDNCGNLLDPTDLIDPYSVISGSRNIEVRDTKHLYLLQTKMQDKIRAWVDAHADWPPLARSIAYKHLDEGLIDRGITRDLAWGIPVAQDGVPRPGFEEKVFYVWFDAPIEYIAATQEWAEGSPDRDWKRWWRTDAGADDVRYVQFMGKDNVAFHTVSFPATILGSEEPWKSVDMLKAFNWLNWYGGKFSTSNKRGVFMDAALEILPPDLWRWYLTANSPEGSDTAFTWEQFASAVNRDLADVLGNFVNRILKFNESKFEGVVPAGGEPGPLEEKLFADVSARLADLAEQMDAIEIRKSAQALRALWVVGNEYLQEAAPWTAIKTDRDRAAVIVRTALNLAALYAKISAPFIPFAAEKIGDAFGLDFPASWPSNDAKAELNTLSVGRPITVPEVLFKKIEDEQIAEWTARFGGAE

SEQ ID NO: 44153 - protein, 794 aa, Candida albicans SC5314
MVQLALFTNNNHNNNSNNNTTNTLNDDTQYDSTTMNTEDTPIIPDKTDKLNGSDSRSSSRNRTRSISFTRFLFNSNNNNNNNKDHTEQSRCPSNETSDNSVGSPEQQNSGFNKLKKMFKTNSSLTQEDGKNSGRTRSASTPLTPPKVKKETSVPVITTTKAPNKEETTTTKIHSPPESPVVQSNPYFQYQGVPAHTNTSQNPQIETAPGRSDMSVALRHNDSVFSLNENGVLKPPKIHYSELSSSSEDNSEPSSPALPKTPMRDLVEKDELHLKPIEDERDLAIPASPFQRALRRVASAPLVHRLLNEKSPEDANNNNNNNTGNNLGGPFSTSTQTSPKKDEPFDINKHIGEVKITGRPRTYTQDRTYSNAATRIVDVQVGPNSFEKVRLLGKGDVGKVFLVREKSSNKLYAMKILNKKEMIERNKIKRALAEQEILATSNHPFIVTLYHSFQSKDHLYLCMEYCMGGEFFRALQTRDTKTICEADAKFYAAEVTAALEYLHLMGFIYRDLKPENILLHQSGHIMLSDFDLSKQSERAKNPEISFHKSGMHLSSAGSSNHHNGPAIDTKACIDGFRTNSFVGTEEYIAPEVIRGKGHTSAVDWWTLGIFLYEMLFGTTPFKGQDRKKTFANVLKKDVKFSDTQQSISSNCRNLIKKLLIKDEEKRLGSKTGASEIKNHAFFKDTQWALLRHQKPPMIPVLTKSTSTSNSNKKYEKPMEDTEEIDDVTSISKSINEQIDDPFSQFNSVTLRYGGEFEDLNQSPMYNPDSSAYTSVAYTMTSNNENSFRQKSFLKR

SEQ ID NO: 44154 - protein, 255 aa, Acidobacteria bacterium Ellin345
MRLKGKHALITGGDQGIGRGIALRFAQEGADVAIGFLSNDDHAKSAVEEMRSHGVNAAALQIDVSNIGALAKFYADATRALGPLDVLVNNAGIEKRDEFLKSTEDDFDSVIAVNLKGPYFLSQLFARDLAEAKRPGKIINISSVHEELPFPNFASYCAAKGGLKMLCRNLAIELAPYGITVNNIAPGAIKTPINDKLLHDPSKLKPLLEHIPLKRMGTTDDVAGCAAFLASSDADYITGTTLVVDGGLLFNYHEQ

SEQ ID NO: 44155 - protein, 427 aa, Corynebacterium glutamicum
MRLWFTDILGHLKSVVVAPAELESALEEGIGFDGSAIEGYARISEADTIARPDPSTFQVLPLEAGISKLQAARLFCDVTMPDGQPSFSDPRQVLRRQVQLAADEGLTCMISPEIEFYLVQSLRTNGLPPVPTDNGGYFDQATFNEAPNFRRNAMVALEELGIPVEFSHHETAPGQQEIDLRHADALTMADNIMTFRYIMKQVARDQGVGASFMPKPFQEHAGSAMHTHMSLFEGDTNAFHDPDDSYMLSKTAKQFIAGILHHAPEFTAVTNQWVNSYKRIVYGNEAPTAATWGVSNRSALVRVPTYRLNKEESRRVEVRLPDTACNPYLAFSVMLGAGLKGIKEGYELDEPAEDDISNLSFRERRAMGYNDLPSSLDQALRQMEKSELVADILGEHVFEFFLRNKWREWRDYQEQITPWELRNNLDY

SEQ ID NO: 44156 - protein, 358 aa, Betula pendula
IGSEVIGGVGGTCVIRGCVPKKILVYGATFRGELEDARNYGWELNEKIDFNWKKLLHKKTEEIVRLNGIYKRLLTNSGVKMHEGEGKIVGPNEVEVTQLDGTKLSYTAKHILIATGSRAQRPPIPGQELGITSDEALSLEELPKRVVIVGGGYIAVEFASIWNGMGVTVDLCFRKELPLRGFDDEMRAVVARNLEARGVNLHPRTSLSEIIKTGDGIKVNTDHGEELIVDVVMFATGRAPNTKRLNLEAVGVELDKTGAVKVDEYSRTNIPSIWAVGDVTNRLNLTPVALMEGTCFAKTVFGGEPSKPDHRDVPCAVFSIPALSVVGLSEEQAIEQANGDILVFTSTFNPMKNTISGR

SEQ ID NO: 44157 - protein, 513 aa, Synechococcus sp. WH 8102
MTIKNQVNPYFAEKKLNKIEKSKLEKDGLLVGSEIEKFAKIGWENMDETDLKLRLKWYGMFWRPKTPGKFMLRLRIPNGVLTSNQIRVVASIVERYGENGSCDITTRQNLQLRGILLCDLPEILRRLREAGLSSIQSGFDNPRNVTGNPLAGIDPNEIVDTRPYTTKLQNFLTNNCEGNSEYSNLPRKWNTAVAGSKDNFLLHNDIVFHPVENNGVMGFSIWIGGILSPQMNAYAFPMNVWVLPDEICNILDTVIRLWRDNGEREKRTKGRFRMYLDEIGHEEFRSQVEKLYGTLTPDPGSIFENSPRSHFGINQQKQAGLYFAGIHVPVGRLTAEDLQDIATASLKYGNGEIRLTEDQNIIITGLTSEKVEELKTDTLLQRFPLAPSNISAGTVSCTGNTYCSFALTNTKDQALKAAKELDEELNLPEEIKVHWTGCPNTCGQAYMGAIGLTGTKAKNAEGVMGEGYTMTIGGSQGRNPTIGQIYRKAIPAAEIKTALKEVLISKFGATEKK

SEQ ID NO: 44158 - protein, 500 aa, Thermobifida fusca YX
MSIWRTKSIEQSIRDTDEPGYRLRRDLNGFDLIVFGIGVIIGTGIFVVTGRQAAENAGPAIVLSFLAAGAVCALAAMCYAEFASTVPVAGSAYTFGYATLGEFVAWIIGWDLILEFTLAASVVSVGWSEYAGDLLALPTTVTLAGLPVNLGAVAIAVLLGLVGMLGAKLSGRVTAVVVAIKVGIVLFIIAVGAAYVDPANWTPFIPPAQPAAADTTGVSDATLTHVLFGLEPTSFGPWGVVAAASVVFFSFIGFDIVATTAEETRNPRRDIPVGIFGSLLIVTLLYMAVAAVVTGMRPYTELNVTAPLSDAFRSVGADWAATLISLGGVIGITTVILVLMMGQARVAFAMSRDGLLPRALSRIHPRFGTPYVTTLLTTAAVALLGGLVPISTLEEMVNIGTLFAFVVVSVGVVVLRSLRPDLPRAFRVPWSPVLPLLAALSCLWLMLNLTALTWIRFAVWLVIGVAIYFLYGIHHSRLAAPPAQPSGEEGEGVGEGFLGA

SEQ ID NO: 44159 - protein, 355 aa, Gibberella fujikuroi
MSRSNPPNAAGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPQDLGSALDLLEKLLAFNPVKRITVEEALKHPYLEPYHDPEDEPTAPPIPEEFFDFDKHKDNLSKEQLKQLIYQEIMR

SEQ ID NO: 44160 - protein, 409 aa, Azoarcus sp. EbN1
MKIVDLIYFNAGGGHRATAVALGAVLRQRKPEWQVRLVNLFEVLDPQNRYRSITGSAPEDWYNKRLARGWTIGMAPELKLLQTVIRLAHRPLVKQFQQHWAQTEPDLVVSLVPNFNRALFESLASALPGVPHVTMLTDLADVPPNFWIEPDQDQHFICGTPKAVEQARALGHAEERIHATSGMIIRPDFYDVIRLDRARERHRYGLDPLRPTGVVLFGGHGSKAMLGIAKKLAESTQLILFCGHNKALARQLRALPQRAPRLVIEFSLDIPCYMRLADFFIGKPGPGSISEAVQQGLPVIVVENAWTMPQERYNAAWVRDNHLGIVHGSFRTIDRAVAQLLSQFEKFRVSVRSIDNRALFEVPEILDDILDEATRIHSDEAQAACHPPRFLRTSSSAAAAASTSASLSD

SEQ ID NO: 44161 - protein, 409 aa, Sphingomonas sp. CB3
MIGSVAIVGASAAGVAAATTLRDEGYEGEITLIGGETDLPYERPAVSKDILLTGAAPPIIPEQRYAELNIKLLLGTRAERIDARYGQIELSDGRTMVSDRLLLATGGWPRRLPVPGAELGGLHYVRDARDGQAIRSGLRPGARIAVVGGGLIGAEVAASAVQAGCEVDWIEAEGLCLARALSRPLAEAMMDVHRQRGVRVHANALVVRLIGERSVQAVELADGRRIDADMVVVGIGITPAAELAEEADLTVSDGIVIDPFCRTSAENVYAAGDVARHQTRYMATPSRLEHWRNAQEQGVTAARAMLGHRQPYDELPWFWTDQYDLHIEGCGVMRADDETILRGNLADGNATVFHLRAGSLVGACALNRQGDVRGAMRLITRGLTPSADILSDPTKDLRKIEKELSRASA

SEQ ID NO: 44162 - protein, 261 aa, Thermobifida fusca YX
MATAKRKPLIAGNWKLNNNHLEAIALVQKMAFALNDADYDAADIAVLPPFTAIRSVQTLVEGDKLRITYGAQDISQHEKGAYTGEVSGPMLAKLNCTYALAGHSERREYHHEDDAVVNAKVKAAFASGITPILCLGEGLEVRKAGRHVEHTLAQLEGALKGVTEEQVRTLVVAYEPVWAIGTGEVATPEDAQEVCAALRKRIGELYSPEAAQQTRILYGGSVKSGNVAAIMAQADVDGALVGGASLDADEFVKLIRAAVQG

SEQ ID NO: 44163 - protein, 291 aa, Pseudomonas fluorescens PfO-1
MTVTKTSEYLETLYEGYGQRFRMEKLLHEVRTEHQHLVIFQNPRMGRVMALDGVIQTTEADEFIYHEMLTHVPILAHGTAKRVLIIGGGDGGMLREVTKHASVEHITMVEIDGTVVDMCKEFLPNHSSGAYDDPRLNLVIDDGMRFVATTTEKFDVIISDSTDPIGPGEVLFSENFYQACHRCLNEGGILVTQNGTPFMQIEEVKTTAGRLRSLFPDWHFYQAAVPTYIGGSMTFAWGSTNPAYRKLSREVLQQRFIGSGIVTRYYNPEIHIGAFALPQYVLQAVNKPSND

SEQ ID NO: 44164 - protein, 395 aa, Thermobifida fusca YX
MRTIEDLDVAGKRVFVRADLNVPLDGDRITDDGRIRASLPTITALRERNARVIIGAHLGRPKGKVDPAYSLKPVAARLGELLGTEVRFASDTAGESAQAISRELADGEVALVENLRFEPGETSKDDAERGEFADRLAALAELYVGDGFGAVHRKHASVYDLPKRLPHAAGGLVLAEVNVLRKLTESPQRPYVVVLGGSKVSDKLGVIDNLLNTADRILIGGGMAYTFLAAQGYEVGASLLERDQIDTVKGYLRRAEERGVELVLPVDVVAAEKFAADAAHDVVDVREIPADRMGLDIGPASAELFASKLADAATVFWNGPMGVFEMEPYAKGTRSVAQALADSSAFTVVGGGDSAAAVRALGFDEKAFSHISTGGGASLEYLEGKTLPGIAALEE

SEQ ID NO: 44165 - protein, 335 aa, Thermobifida fusca YX
MTIRVGVNGFGRIGRNFWRAVQAAGGSDVEIVAVNDLTDKATLAHLLKYDTVLGTLPGEVEVGEDSITVGGTTMKALAQRDPAQLPWGDLGVDIVVESTGFFTKAEDAKKHLDAGAKKVIISAPAKGEDLTVVMGVNDDKYDPANHHILSNASCTTNCVAPMAKTLMENFGIVKGLMTTVHAYTNDQVILDYPHKDLRRARAAAQNIIPTTTGAAKATALVLPELKGKLDGLAMRVPVPDGSVTDLVVTLEREVTKEEVNAAFKAAAEGALKDILVYTEDPIVSSDIVGTPASCTFDASLTMAFGTQVKVVGWYDNEWGYSNRLVDLVKLVGSNL

SEQ ID NO: 44166 - protein, 195 aa, Rhodobacter sphaeroides
MRKAEISRKTAETDISVTVDLDGTGRYDIRTGVGFFDHMMDQARPARADRHPLRCEGDLHIDDHHTVEDCGIALGQALTRALGDKARIRRYGSFHLAMDDALVRAALDLSGRPFLVWNLPFPTEKIGSFDTELVREFFQALATHGGITLHVDLIHGVNSHHIAEAAFKAVARSLREAVEPDPRRADAIPSTKGML

SEQ ID NO: 44167 - protein, 402 aa, Pseudomonas putida GB-1
MAIPGSPRRFARIDRLPPYVFNITAELKMAARRRGEDIIDLSMGNPDGATPPHIVEKLVQVAQREDTHGYSTSRGIPRLRRAISNWYKERYEVDIDPESEAIVTIGSKEGLAHLMLATLDQGDTVLVPNPSYPIHIYGAVIAGAQVRSVPLVPGVDFFNELERAIRESIPKPKMMILGFPSNPTAQCVELDFFERVVALAKQYNVLVVHDLAYADIVYDGWKAPSIMQVPGAKDIAVEFFTLSKSYNMAGWRIGFMVGNPELVNALARIKSYHDYGTFTPLQVAAIAALEGDQQCVRDIAEQYRQRRNLLVKGLHELGWMVENPKASMYVWAKIPEQYAHLGSLEFSKKLLAEAKVCVSPGIGFGDYGDDHVRFALIENQDRIRQAIRGIRQMFRADGLTNK

SEQ ID NO: 44168 - protein, 250 aa, Bacillus caldolyticus
MKKKCIAMLLAGGQGSRLRSLTKNIAKPAVPFGGKYRIIDFTLSNCTNSGIDTVGVLTQYQPLLLHSYIGIGSAWDLDRRNGGVTVLPPYSASSGVKWYEGTANAIYQNMNYIEQYDPDYVLVLSGDHIYKMDYQQMLDYHIAKQADATISVIEVPWEEASRFGIMNTNENMEIVEFAEKPANPKSNLASMGIYIFNWPLLREYLQIDNADPHSSHDFGKDVIPRLLRENKRLVAYPFKGYWKDVGTVKS

SEQ ID NO: 44169 - protein, 473 aa, Triticum aestivum
MDVPLASKTFPSPSPSKREQCNIDGHKSSSKHADLNPHVDDSVLGIILGGGAGTRLYPLTKKRAKPAVPLGANYRLIDIPVSNCLNSNISKIYVRTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 44170 - protein, 348 aa, Staphylococcus aureus subsp. aureus NCTC 8325
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFVNIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLFVDACSMHLITNPKQFDVIVCENLFGDILSDEASVIPGSLGLSPSASFSNDGPRLYEPIHGSAPDIAGKNVANPFGMILSLAMCLRESLNQPDAADELEQHIYSMIEHGQTTADLGGKLNTTDIFEILSQKLNH

SEQ ID NO: 44171 - protein, 845 aa, Triticum aestivum
  misc_feature (82)..(82): Xaa can be any naturally occurring amino acid
  unsure (1)..(845): unsure at all Xaa locations
NSFYKKAGWYRSGIPGISSTHASAMLMGSPTALEATKALLDRFERRLTLCQSASSSSAENIDHLLKRLATPKRKAPPSRERXTRVAAKRPARTSETSRLSRYSLRVVLCAYMILAHPSAVLSGDGEQEKLLMESAANFVREFELLVKTILEGPGRASRQPSLDAAESSSCQKSYDVASQSKFKTQLVNFDKAWCTYLYGFVVWKVKDARSLEGDLVRAACKLELSMMQTCKLAADGQSHNLTHDMKAIQKQVSDDQKLLREKVQHLSGDAGIERMDSALSDARSKFFEAKENGSPLAAPVANVSTPLSIDSSGKLPPTEVNMNSKTDAEGSRSVVRSLFGASGASSSTSPVNLPTENEQMVNEMLHEDGGAIAGNSNDARTIEKGFQDKVRETMEKAFWDVVTDSMRGDKPDYSQLINLVKEVRDSLHDLAPKEWKEEICENIDLEILSQVLKSGSQDTQYLGQILQYSLDMVRKLSAAAKDDEMKASHDKLLSELAASSEDNDNGVSSFVIAVIKGLRFTLEEIKQLQVEVSKAYVQLMQPTIKGSAGVEYLQKAFGDRYGPPANASASLPVTLQWISASKSIVDAEWSEHLGSLSVLPAANHAQPLVTVLRAGHGAPAAAVASAGSSGLPECKGEKIDKLVRVGLLQLISGMEGLQLQSTPESFHLNFLRLRAVQGQFQEVIVMATSMLVLRQVLMSENSKITPPELETVISELFGALVKLLDNSPEAGTEEIVEAMMSASASAGSLSDAKIQARRQIITRVLLKSLQADDVVFKKVSRAVHCAFRGVLLGGSGAKGQKLADAALRRVGAGKLADRVVKAAEVLIRVATVSEKVHGPWYKALA

SEQ ID NO: 44172 - protein, 449 aa, Listeria monocytogenes str. 1/2a F6854
MEKHYDYIAIGGGSGGIASINRAAMHGAKCALIEPKFLGGTCVNVGCVPKKVMWYGAQIKEAMDLYADAYGYQVDASFNFQKLVENREAYIERIRGSYKNGLDNNKVEWIKGYAEFVDEKTLRINGELVTADHILIATGGEPALPSIPGAEFGITSDGFFALKELPKKVAVVGAGYIAVELAGVLQQLGSETHLFVRKHAPLRNFDPLLTDTLTEIIEQSDMTLHKHAIPQKVEKNPDGSLTLSLEDGRTETVDTLIWAIGRKPVIKDLQIENAGVELLESGHIAVDKFQNTNVAGIYAVGDVTGHYELTPVAIAAGRRLSERLFNNKKDAHLNYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 44173 - protein, 664 aa, Listeria monocytogenes str. 4b F2365
MFDNTDSLAVNTIRTLSMDAIQKANSGHPGLPMGAAPMAYALWSRVLNTNPKNSHWFNRDRFVLSAGHGSMLLYSLLHLSGFKLELEDLKNFRQWESKTPGHPEYRYTDGVDATTGPLGQGIAMAVGMAMAERHLEAKYNKDGFPVVDHYTYALCGDGDLMEGVASEAASYAGHQQLGRLVVLYDSNDISLDGDLDKSFSENVKQRFEAYGWEHLLVKDGNDTAEILAAIEKAKQNTSQPTMIEVKTVIGFGAPNAGTSKVHGAPLGDEGILEAKKAYGWNYEEKFFVPEEVTARFKETIGERGEKAETAWNELFASYKAEYPELAKQLEDSLNNKLPADWDEDLPVYDDSKALASRASSGEVINALAGKIPTIFGGSADLAGSNNTTIKTDGEFTKATPAERNIWFGVREFAMGAALNGMALHGGLQVYGGTFFVFSDYVRAAIRLSAIQHLPVTYVMTHDSIAVGEDGPTHEPIEQLASLRAMPGLSVIRPADGNEVVEAWKLAITSTSTPHVLVLTRQGLPTLPNSAKLTAEGVKKGAYVISPAKGDVPEAIILASGSEVNLAIEAQKELQAQGTDVSVVSVPSFDLFEQQSAEYKESVLPNAVRKRVAVEMGASFGWERYVGLDGKVIGIDKFGASAPGETVIKNYGFTVENVVNTVKSL

SEQ ID NO: 44174 - protein, 269 aa, Brassica napus
IKERIGAGSFGTVHRAEWHGSDVAVKILMEQDFHAERVNEFLREVAIMKRLRHPNIVLFMGAVTQPPNLSIVTEYLSRGSLYRLLHKSGAREQLDERRRLSMAYDVAKGMNYLHNRNPPIVHRDLKSPNLLVDKKYTVKVCDFGLSRLKASTFLSSKTAAGTPEWMAPEVLRDEQSNEKSDVYSFGVILWELATLQQPWGNLNPAQVVAAVGFKNKRLEIPRNLNPQVAAIIETCWTNEPWKRPSFATIMDLLRPLIKSAVPPPNRLDM

SEQ ID NO: 44175 - protein, 150 aa, Brassica napus
PRVRVLVTSLHSGYSENLKSMYWEYPTLTGEIIGVHQPSQEGYQQTEKKMHIGKALAEMYLLSMTDSLVTSAWSTFGYVAQGLGGLKPWILYKPENRTAPDPACGRAMSMEPCFHAPPFYDCKAKTGVDTGKLVPHVRHCEDMSWGLKLV

SEQ ID NO: 44176 - protein, 428 aa, Gloeobacter violaceus PCC 7421
MRQVTAIILGGGRGTRLYPLTKRRAKPAVPIGGKYRLIDIPVSNCINSGIQHIYILTQFNSASLNRHVSQTYQFSRFSDGFCEILAAEQTDENPNWFQGTADAVRQYLWLLEPSGSTEYLILSGDHLYRMDYSKFVRRHRETNADVTIAVLPCDLERASDFGLIKTDADGRVVQFTEKPKGAELERMRVDTTTLGLTLEEAERRPFVASMGIYVFRHDVMLKLLRDDPSRTDFGKEILPACLDDYNVQAYLFDDYWEDIGTIEAFYKANLALTSQNAPPFSFYHPAPIYTRPRYLPPSKLIDCQIAESIITEGCIIKQARIFHSVLGLRSRIESGVRIEDSLLMGADFYETPIQREESLRRGLPPVGIGERCVLQKAIIDKNARIGNDVRILNKERPDSADHPERGFYIRHGIVIVPKDTVIPDGTVI

SEQ ID NO: 44177 - protein, 59 aa, Zea mays
LAATDGCGRVGGLAFHPLDGILQAMPHVLALFLFPTHFRTHIALVFLEGVWTTNIHDWP

SEQ ID NO: 44178 - protein, 391 aa, Pseudomonas viridiflava
MEQQCDVAVLGLGAMGAATLYQLTREGADVLGIDQYAPPHKQGSSHGDTRITRLSVGEGPQYLPLVRNSHRIWRELEALTGESLFEQCGVLVMTSSPAYDPNDPEDFTHKTIALAREYGVKHEVLSAGAIRERFPQFSPVLDTAIGYFEPDGGFVRPERCIEVQLQLARKLGARIRMNETVTRLQAHGDQVRITTDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFQTQVSGKIAGIKADVVKSSVCAYTVTPDYHFIIDDHPHLKNVTVVSACSGHGFKHSAGLGLALAQRCLRGTSDVDLSAFSLKRFGKTA

SEQ ID NO: 44179 - protein, 391 aa, Pseudomonas viridiflava
MEQQCEVAVLGLGAMGAATLYQLARQGADVLGIDRYAPPHTQGSSHGDTRITRLSVGEGPQYLPLVRHSQRIWRELEALTGESLFEQCGVLVMTSSPAYDPHDPEDFTHKTIALAREYGVKHEVLSAGAIRERFPQFSPILETAIGYFEPDGGFVRPERCIAVQLQLAEKLGARIRMNETVTRLQPQGDQVRITTDQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFNTQVSGKIAGLKAEVVKSSVCAYTVTPDYHFIIDDHPHLKNVTVVSACSGHGFKHSAGLGLALAQRCLRGTSDVDLSAFSLKRFSKKA

SEQ ID NO: 44180 - protein, 174 aa, Triticum aestivum
  misc_feature (97)..(97): Xaa can be any naturally occurring amino acid
  unsure (1)..(174): unsure at all Xaa locations
MASEKDAALAAVPNDNPTIFDKIIKKEIPSTVVYEDEKVLAFRDINPQAPTHIVIIPKVKDGLTGLSKAEERHVEILGCLLYAAKVIAKQEGLEDGXYRIVINDGPSGCQSVYHIHVHLLGGRQMNWAPRLKNSWVPAISREVFLCIQSNIPVIAYIVQGIALWMNTCCVQELN

SEQ ID NO: 44181 - protein, 491 aa, Listeria monocytogenes str. 1/2a F6854
MVFLSIKETALPKVQTKLFINGKWTDGDNKETKDIVNPANGDVIAKIAQAGPSETKKAIKAAKDAFPDWAKMELADRVKLLHKIADLMEEKADTLAKIMTLEQGKPLKESKGEVLTGVENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFDDANLDAAVNDLVAAKFRNNGQVCVSPNRIFVAKEIKEKFTKALVAKVEQLKVGNGLDNVNVGPLIREDAIDKIDKQLKNATDKGAKVLTGGGRLTGSDYDNGNFYKPTVLDNVTREMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 44182 - protein, 498 aa, Aspergillus oryzae
MSPRPFTLNDPSLLHEASLLNGEWVAAQSNKRLSLTDPGSRHVFATCPTNGPEDVDKYVETSHAAFERYRHVNPRERAKFLLKWHELITKAREDIATIVVYETGKPMAEALGEVDYALGFAWWFAGEAERVRGSIALPSVSNRRTFVIKQPIGVSAALVPWNFPVAMIVRKVAAALAAGCTMIVKPSPETPLSVMALADLALRAGLAPGVLNVITTDNEYTPSVSERLCKHPLVRKVTFTGSTRVGSIIAKHCSEGLKKVTMELGGNCPFIVFDDGNLEQAVAALMILKWRTAGQACTHANRVYVQAGVYDKFAQMMLEATQKLKVGHGTDSGTTMGPLTTERGVEKLKKLVSDAISKGGKVLCGGKQPNGPQGYFFEPTIISGMTSEMLASQEEIFGPLLGLHRFETEEEAVKMANDTSMGLASYFFTKDIDRTWRLLESLAAGMIGMNTGNSSCAESPFGGIKESGYGKEAGKDVAIEEYLISKTGTLTVEGAPGP

SEQ ID NO: 44183 - protein, 121 aa, Ustilago maydis 521
MASQSSIGAARQHSRILFVKNLNYNTTGADLYQVFGRYGAIRQIRLGDATGTKGTAYVVYEEMADVKRALDHLNGFHLNERYIVVLYHMPARLAAKADLARREAELADLKALHNITDEVLH

SEQ ID NO: 44184 - protein, 286 aa, Arabidopsis thaliana
MSQAPNPEEEDDTIEIREVWNHNLEQEMALIEQSIDDFPYVAMDTEFPGIVCKTVTANPNPNPYSIHYEYNYDTLKANVNMLKLIQLGLTLSDEKGNLPTCGTNKQCIWQFNFREFNVISDMFALDSIELLRKSAIDLEKNNECGVDAKRFAELLMGSGVVLNDKIHWVTFHCGYDFGYLLKLLSGKELPEEISDFFDQMEKFFPVVYDIKYLMGFCTNLYGGLEKIAELLGVKRVGISHQAGSDSLLTLRTFIKMKEFFFTGSLLKYSGFLFGLDNPRLLTGSKN

SEQ ID NO: 44185 - protein, 390 aa, Wolbachia endosymbiont of Drosophila simulans
MFLIKPSPTIAVTDKANKLKNEGKKICVLAAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTAELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVVPGIAFGLENFIRISYATSQEQLEIGCDSITKACQELK

SEQ ID NO: 44186 - protein, 357 aa, Vibrio cholerae O1 biovar eltor str. N16961
MSKQQKILFIDRDGTLIVEPPVDFQVDRLDKLKLEPYVIPSLLKLQEAGYRLVMVTNQDGLGTSSYPQADFDAPHNMMMDIFESQGVKFNDVLICPHFERDNCSCRKPKLGLVKEYLQGGKVDFKSSAVIGDRMTDLQLAENMAIRGIQYHPQTMGWLDIVKDLTTKPRVAQVVRKTKETDIQVLVNLDQTGGNQIETGLGFFDHMLDQIATHGGFQLQLKVVGDLHIDDHHTVEDTALALGQALREALGDKRGIGRFGFTLPMDECLAQCALDLSGRPYLKFDASFSRPQVGDLSTEMVYHFFRSLTDTLACTLHLSSSGDNDHHIIESLFKAFGRTLRQAITVQGNDLPSSKGVL

SEQ ID NO: 44187 - protein, 1447 aa, Candida glabrata CBS 138
MTFLKKIAGSNGHSKSGSVSSIRYSANSQASPSASVSSSRSFKTHVRNSSNSTDYSGSTYVFGTGNTASSGSNHGTPTSSKTFSKMGSSYNRRSIDSPRSTSNRNSEYTLDNSSLNSHPQANKGGDNVSRPTSLEKNADTDSSTYSRKSSGSTSSLSFDNLILSWDPTNPDEWTLSRVIAWFKFHDFPDSWIAVFKRHQLCGQRFLRLLAYDNFAIYEKHLPISKNASFDKFQALLKDTMKKNVSSSHSRQRSGNSVAAMHIEPNKGVNLRHKSSRSQDDIVGSRSASESGINNEQLNLGKPPEKGVVKSHKKTKSTGSLYRRSFISLMGSSSHSSAENTQMEKNNPNIKIHIPSRPQSVVESEPSTAKTLSPLSPPYSALFNKLDQKNRSDPTLFEISDEKYSRLKNDDYNDDIAAQSSSTNFNGKQQHSSSATYSKSKKNEKGGFNVRNSAVMPEDKSTFWEKLKRKSQTISPSTQNHTQLNSANLSKNRVSLQQIQGGFDMTDQVKPDNIVTPKIHQAHKSSSIDTKSQNFENVFDKFLLDKKYYPAKIKSSTNEEDFVLITKDNVSFIPLLISELPNECSKLKEYFMRKLRIVSGECSVHMTDFGCDIGASLNDTLLDTIRNSLFMNTSRKLFIRDTGTHKYSPGKPIINSSQREMLRKKESIKSINSSILASNDEISTITSSSDIASFDDRSSAPGRQYPQTPSYFYDASNVNDDVNYWNFKENQSSLVPGKVPDVKPEAQFTLKIPDKIKHKGLEDDLQRNSFHVLRKDEGKEIDFNNRRRSPYTNPELAPKREAPKAPITGSPMRLQKSRSLSKSVSIVTNNDRSRRDELSPSRKSYKNSETNSPSSEKIVSSYTPGSSHVLVPQPYKGVGDISRKGKLEDDHMFSMTEVLRSRVNRSTSSVSNNSVIYSTSPILKRGSSKRIVSSASAADVFEENTINFNDVPELSDSDEDSASSEDIIWGSETKISETEVVPENNNFNKTDSEDDDKIYSMNNKLTPVRKMTLRPTAEIVYQNLERFFPRAHLDKPVVEELHNSKSPVSKTSDKARINSILEQHSNISEKGVKSQNNDNVIKEKKSNTSLPRRTRTIRAIAHEAGEARRNSMKVKRSNTKMWGTKIVEITDKNTIEINKSKNARGEYKEFAWMKGEMIGKGSFGAVYLSLNITTGEMMAVKQVEVPKYGTQNELVKDMVEALKSEVATLKDLDHLNIVQYLGSEIRGNIYSLFLEYVAGGSVGSLIRLYGRFDEKLIRHLNTQVLSGLKYLHSKGILHRDMKADNLLLDEDGICKISDFGISKKSKNIYSNSDMTMRGTVFWMAPEMVDTKQGYSAKVDIWSLGCVVLEMFAGKRPWSNLEVVAAMFQIGKSKSAPPIPDDTIQLISSKGKDFLSKCFEIDPEKRPTADDLLEHSFSKVDPAFNFSRTRLYEFIKTNDKLNSSVLRNT

SEQ ID NO: 44188 - protein, 571 aa, Oryza sativa (indica cultivar-group)
MAAAAPAGAQNRCVFGTGPLPPASLSPSSAWFDPELSSGEGAHVGNIPYDATEEQLVQICEEVGPVVSFRLVIDKETGKPKGYGFCEYKDEETALSARRNLQGYEINGRQLRVDFAENGRNADRNREKVEDPQFLTVEETHFSTSNSYVKMRACIALVPMNDNSSVFSNHHVSVVEDLEWHPVLVGIISFITPKFMYTQKQLAGTPVVGDTGLHQPVGLPSAIHAASVMAGILGGSQTANVQNGLPVQYGLGNDPLTHYLARMSKHQLYEIMSELKSLTSQNKDVANKLLQGIPQLSKALFQMQMAKSQQPSSSLAQSSSHISEPFPQPDAMISSVPRPSASLPNPNVLQDPSAQLHNFPQYPHSSQPAGTIFPHGSQSGVGIHPPIVSQPLGASSSVPPLPLATSGSLISQVQPPFMPHHPRPPAMPAGMQQLPLTHPHVPQVPAIPDIAQKEMRFPEQANRSTEFAHHPKLRKLEDGTSTPGIVNNNPAVYPAPSQGMLPGGPSGSYNSAAVSFQQPENEVPQLTPDVESALLQQVLQLTPEQLSSLPVEQQQQLLQPVSDFWKNILLD

SEQ ID NO: 44189 - protein, 129 aa, Zea mays
  misc_feature (77)..(77): Xaa can be any naturally occurring amino acid
  unsure (1)..(129): unsure at all Xaa locations
MAATLPLSPINHQLCRFGNNSLTTHRFCSPGFLISSPCFIGLTGMGSATQLRARRSLISSAVATNSLLHDVGATVAXLGGAYALVLSFESLTKRNVIQQSLSRKLVHILSGLLFVLAWPIFSGSTEARY

SEQ ID NO: 44190 - protein, 145 aa, Ehrlichia canis str. Jake
MEIILLERTLSILKPDVVKRNITGQVNSYIENSGLKIVTQKMCLLTRFQAEEFYAIHKSQHFFIPLVDFMVSGPIIVQVLEGENAISLYRELMGATDPKKANPGTIRGDFAENIDANCVHGSDSLDNAVREIRFFFSDYELLSLK

SEQ ID NO: 44191 - protein, 383 aa, Gloeobacter violaceus PCC 7421
MARDLYETLNVSRDASKEDIKRAYRKLARQYHPDVNKDAGAEDTFKELSRAYEVLSDDDQRARYDRFGEAGLNGGVGGGPGDFAGAAGFGDISDIFESFFGGFAGAGTGGRRATRPGGPTRGDDLRYDMVLEFQEAIFGGEKEITINHLITCETCRGSGSKPGSGPMTCRNCGGQGQIRQARRTPFGLFTQVAACPNCQGTGEVIESPCPTCSGRGRNQKQTTIKITIPAGVDAGSRLRVQGEGDAGMRGGPPGDLFIYVSVRNHPVFRREGQDIYSIAEISYLQAILGSQMSVETVDGPQTVVVPPGTQPETVLTLDGKGVPRIGNPTRRGNHYLQLKVVIPTKLGAEERELLTKLAKARGEKVSKKEGLEGLIDSIGNLFH

SEQ ID NO: 44192 - protein, 560 aa, Ralstonia eutropha JMP134
MYQYDQYDQRIVNERVAQFRDQVRRRLSDELTEEEFLPLRLQNGLYMQRHAYMLRVAIPYGLLASKQLRKLAHIAREYDRGYGHFSTRQNIQYNWMELERVPDVLAELASVEMHGIQTSGNCVRNITTDHFAGVAPDESVDPRVLAELLRQWSTFQPEFAFLPRKFKIAISASKDDRAVVQMHDIGIYVYKNDAGETRIRVLAGGGLGRTPILGTIIKDDLPWQHMLTYVESAIRVYNRYGRRDNKYKARIKILVKAIGAEKFAEEVEEEWQYSKDGPGTLTQDEFDRVAQYFTPPAYEKLADTDASYEKHLLEDKAFARWVSRSVHGHKVPGYAAVTLSTKPGPVSPPGDATAEQMEAVADLADQFGFGELRVAHEQNLVLPDVKKHDLYDLWQLAKKAGLATANIGLLTDIIACPGGDFCSLANAKSIPIALAIQERFDNLDFVHDLGEVSLNISGCINACGHHHVGNIGILGVDKDGSEWYQVTLGGAQGNSTALGKVIGPSFSAEEMPDVISRIIETFVANRIEDERFIETVNRIGIAPFKERVYADKQPRERAEA

SEQ ID NO: 44193 - protein, 498 aa, Zea mays
  misc_feature (475)..(475): Xaa can be any naturally occurring amino acid
  unsure (1)..(498): unsure at all Xaa locations
MKSLVKVLVDCAEDATKSLRGLVDHALDHMHDEEILARTLFAMKEKLDLLHQDALEAKVQAFPKIAKYEGDDISVEPTSPSTPPTVTEPSVDEEEFYCPDVSDEWYFSDSDSMDPANNATSSQAMSNPSNAQQFPPPPPIWPTGYMQQNPVDCNIMGNINFPSPGQGPTTMWAPIQPGNTSSQSTMIPASQSALYWNHYMNFVRNPLGSVGMSPYTDSYPPSLSSTPLQGSNTIPEMPVHLESDAEHSVQDINSPGKNAPPVLKQKKSKEQNFTAPEDRLLCTTWLQISSDPIVNTGQRREGLWARIEKRYNEQRGEFPCRLNRALSSRWDKIRADVSKFSGYYARVLREKQSGLSDEDKTSKAATLFAHEESKPFHYMHCWHQLKGEPKWESICQGHSFRGLHARSIPSSGCPSVEAPESDSGSAGLTGKRPRGRDYSKAERKKAGSSSSPEYLSRLQEITEKQIQRSIEKGEXKEKSTEEDREIQKKRLELEAQKL

SEQ ID NO: 44194 - protein, 361 aa, Desulfovibrio vulgaris subsp. vulgaris str. Hildenborough
MLCIGIETSCDETGLALVRDGRLVHAVMSSQADIHALFGGVVPEIASREHYRLIGPLYDLLLREAGVGPTELDAVAVARGPGLLGSLLVGMAFAKGLALGFDIPLVGVNHLHAHLLAAGLERELVFPALGLLVSGGHTHIYRIESPVSFRLLGRTLDDAAGEAYDKVAKMLRLPYPGGRILDQQGRRGIADPRLFPRPYTDNDNLDFSFSGLKTAVQTHLSRHPELVPSPDAAQAVAGGHDAPEGLRNMCASFNEAVAETLCIKLGRALDGDDGVGVRALIVAGGVAANSYVREHTARLAVSRGLELIVPSPPLCTDNGSMIAYAGWLLRQGGLSHSLDLEAVPRGRAIPDDYRQGPAGCS

SEQ ID NO: 44195 - protein, 503 aa, Triticum aestivum
  misc_feature (164)..(164): Xaa can be any naturally occurring amino acid
  misc_feature (278)..(278): Xaa can be any naturally occurring amino acid
  unsure (1)..(503): unsure at all Xaa locations
MARKMLKDGEAPAVADGGGGEGEGSYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGXSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPGTNLTELSKNSXDGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAEAKNDLLVYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 44196 - protein, 347 aa, Symbiodinium sp. JCUCS-1
MATKIGINGFGRIGRMVFQAICDQNLLGTKLDVVGVVDMSTDAEYFAYQMKYDTVHGRFKHDVKIGEKDELIVNGNKIKCIQASREGPKALPWKEMGVEYVIESTGLFVEAEKAAGHIEAGAKKVIISAPGKGDLKTLVCGVNHTEYDKANHNVVSNASCTTNCLAPIVHVLLKEGVGIEKGLMTTIHSYTATQKTVDGVSAKDWRGGRAASCNIIPSATGAAKAVGEVLPTTKGKLTGMAFRVPTPDVSVVDLTFTAEKDTSIEEIDALFKKASETYMKGVLSFTDEELVSADFIHNVNSSIYDSKATLQNNLKGEKRFFKIVSWYDNEWGYSNRVVDLLMHMISA
